United States Patent 9,254,311 (MODIFIED POLYNUCLEOTIDES FOR THE PRODUCTION OF PROTEINS) - sequence listing, part 5

SEQ ID NO: 4684 - DNA, 5394 bp, Homo sapiens
gtcttacaacaaagccaaggaatctcgctgctgagggttctgtgctttattatgaagaataatggacgatgatgatgcaaagctcaaagcagaaatagaagctgaattggataaactcagcatttcctccttggaaaaagaagacattgagagtgatgcaaaatcagaaacccagagtgatgatagtgatacagattcagttgaattaccagaatcagttcttcactgtattaacatcataaagaacaggagtaaagctgttgaagagctcattcttcaggacctggaagatactgatattttaagctgtagttatggagcagtttctaataatcatatgcatttaagaacaggactatcaactgaatatgaagaaagttcagagcaattaattaagatattatctgaaatagaaaaagaagaatttatgagaagtaaaaccgattgtgccactcctgattttgttcctgagcctagtcctcatgacttgcctatggatgaacatgttttaccagatgatgctgatataaattttggatactgtgaagtggaagaaaaatgtagacagtcttttgaggcttggcaagagaaacagaaggaattagaagataaagagaaacaaactctcaaagctcagagggatagagaagaaaaacaatttcaagaagaagaagaaaagcgacattgctggatgaaacaatttaaagttgaaaagaagaaattagagaacattcagaagcaagaacaggacaagatgaatgatgaactctataaagaagagaaaatttggaaagagaaatttaaacagcatgaggagtatattagaaacttgcatttacaaatggaagaagaaagaacaagatttaaagaccaacaagaaaaagaaaaaaattctttgttaaaacagcagaataatgcagctgttaaaattcaagctaaatataaagcatttgttgcctatcaaaaatatggcccaattattaaagagcaaattgaaagtaagaaaaggaaagcacaagagtggaaggaaaaggaagcaaaaatacgacaaaaggaggaagaaaatcgaaaaagattagaggaggaacaaaggataaaagaagagagaaaaaagcaaaaggaagaggaaaggaaaaggagagaaaaagaatatgaagaaaaaaagaatattgtgaaacaggaaagagagcaactaataagcaaggaaaaaataatattaagagaagatgcaagccaacagctaataataagtagtgcattaaagaagagcggatataataacaaacatttaagtcttgaagatatttcaaatgataagggtgatatagccaaaaatctagtggatgaaaattcaaagaagcaggaagatgttctcctttggctagttgaggaatcaaatatgaaagaaaatgtagatagacagactatattaaaagaatcaatacaagtaaagttaaaagaatctatatcaagccaaacaattctggcagattttaaaatggaagaaaaaaatgaaaacctagcaaaaaaacgatgttcagaagaattggtcaagcaagaaagaaaatatgaaaatacagataacaaaactgaattgggaaactctgatctaaaaggaaatctgaaagaacagtttccattgcaagaattaaagtctgatgcacaaaaagaagaaaaaatcatgaaacatgtcataaatgagaatacaggacaaaaaacccagataatattaggacataaccaagaaatcagtgaggtgaaaaccaatgaagagcagaaaataatcaaagataatcagcagaaaaagatacaaaaagtagaaaaagaagagatacaagaacagaatggattattatataaagataaggatactttagttatttcagtgaaacaaagatcactctcactaacatcagaaaattccaaagatgtaagagaaaacgtaatattacaagaaaaagaaatttattcaaaatccaaagaaattgaggagaacccaaaagacaatgcttggaatagtggcattgtgatttttaacacaactgataccatgataaatatagaaggcaaaagaaatgaccaagattatgtgttaggtagacatgctccttgtgagggcttgagtaactataatgcagaaagctccatggtatctaaagaagtcaactctcttaaatctgagattagaaatatttcagaaaaatgccatgaaaatgcacctgaacctgatagcatgacctgctgtgtatcagagtcaacccttctatattctattgaagaaaggagactagcctggataaaatcatttaaaccttggcttgaaattttcaagcaaaatcaacaaaagaaaattgttagaagaaagagacctgtgaaatgcccagccaacatgacacccgctttggataaactggaaattcttcgatgtggcccttgggatactttacagcaggttacaacagttacatttcaagatttgccaggctgtgttctctccacactggcagagtgtacaaatcttcagtttctatcccttcgacgctgtggattaacttctttgcacagcctgagtaattgtaaaaaacttaagtacattgatgcacaggaaaaccatattgaggctattgagtgtgaaaatttggaaaatctctgtgttgttcttcttaataaaaatcaactgacttctcttcatggtttggatggctgtactaatattcagtgtcttgaactttcatataataaaattactcgaattggatattccttctttctggaagaaaaacttgttgacaatgcagggttctgccatcacttgggcacctccacttcttacttatccctggcacaagtctggattccaactggattatgttggtcctggatacctattacctcacttacaaaaaattcagattgtaatttccttatctcccacttatactggaattgtggtttagaatctttgaaaaatcttcaacaactaattttggaccacaatcagttaattaatacaaaaggtctttgtgatacacctaccattgtatacctagattgctcccataatcatcttactgatgtagagggcgttgaaaattgtggattgctccaaatattgaagttacagggaaattatctgagtgagcttccatccttggagaatcttgttttactaagagaattgcacttggatgataacagcatttcaactgtggaagcattttcttcatactggctgcctttactacaaaatattactatctctcaaaacagcttgactaaaatcgtaccactttttcattttgtttcattggaaaagctagatgtcagccacaattgtctttctgatcttaaaagtgccataaaatggtttgatgcatgctattctctccatgaattgtctcttactggaaacccacttcttcaagaaacaaactggagggattctctacttaaagtgttgcctgctctgagaatcctcaatggcaatatactaaactctaattcagaaagccgcactgaagaacacaatcaactgggatcagcaggtttcctggcactttgtcagtctcagattcgagaattcaacttgctaattgaaaattatataactggaaaaggagatgtatttaccttggatactgcagaaaatctctgtcattattttaagaaattgatgatacttagtactgaataccgacatgcacacgaacgaggggatgtaactatcaccaagaaagatgaatcagaagcccagaaaaatcatttggcccctacaaacagtgacagcactctgcaaaatggagtcttctactcttgtgcacgtgaaggtgagccagactcaccagatattcctgagaaatggatggactctgtctccagccactccccattaagcaaatccgccacatgtgaaaatatggaaggaagacatcaggaaatattagtatgtcagaagagagaagacagcaaggcaagcagtattcccaccataagaatcccatttaaggaagtagtaatgacaaattctttgctgaggaatcaccaaaatattgagcctagtgaaaaaattatggcagctgtggtaatccagtcatactggcgtggttacctcatgcgcagacagactcatttctccacaaggctacatactgctgcaacagaaggcctgccaaattcttccatcaagaatcagactattttaaagaaaggaaaaagagaaaatattgtgaatatccgaaaacagagggagaaggctgctattcttattcaggcagtttggaagggctttattttgcgaaagaaactgacaacagctctagaggctattaagaatgaagaatccgatgaagaatacagagaaatagatttagaggattttatatttgatgaagctgccttagaagaagaatggctagcattagattccacccgcttcccttcacaaacactgcttctttcaaaccagctgcattggccaaagattcctggaaacttaaaatgggatgatacttcatttaatttaccaagtaatccagctcaagcatggttatgtaatgacaaagaaaatttgtcttcttcagaacacacacaatttaatagcagatcagaaaataaaacttcttcctggacacctgaatcaaagaccagtagaaagagtttgctaaaatctgaaaaagaaaaaaaaatttcagaagaatggggctttaaggatatttctactgctcagcaaatgttgaagagggcacagaaaatgaaatcgaagaaactaaagaaaaaaatagattccactgtgcgtctagccttattcaaaaacaatgaaaataaagtgtctcttccaaaatcaccaaagatggtacagcccagaagagatggttactttgaaggtatagaagaagaccctatccacaaagataccactgcaaatgaaaaattagaacggaatagagaatatacataccaatggcttcacacacaggttggggttcatgaaacgactagttccagaaatatgaaatgcaatcactttttgcctgagttagatccagatgtacttaatggtggaagagttcagcttgtggcaagacttgtaagcagagaagacacggatttagaccttttttccatgaccaatggaagtgctttgtctgtgaacagagaaaaaaaaaatcaggcacacagacactcagcaggatcttcaagtaagttgtggtttccttcaaaattaatttagaaatcacaaacgaattgatggaacctaatgccaacaagcattctttttcagatagggggtaggatgccagcaacctgaactgcccaaaaatgtgtatttaaattttttctttctttaaatatcctcttttgatataaacaaaattaaattatttctaaaattaa

SEQ ID NO: 4685 - DNA, 2849 bp, Homo sapiens
gtcgcccacgtaaccacgcccccggagcgccttggctggcgcccggaaaaccatgatgtggagaacttggatgttgtcttgtttctctagcaacggtctcaggagcagatggccgcccagcgatttgtctgactgtgttggggctgggccacttgtctccaactcataagggcttgcagcccagttgacccgatgtttcatggaacagtcacagaagagctaaccagtcatgaagaatggagtcactataatgaaaacataagagaaggtcaaaaagattttgtttttgtgaagttcaatggccttcatttaaagtctatggaaaatttgcagtcttgcatctctcttagagtatgcatcttctcaaacaattttattacagatattcatccacttcaaagttgtataaaattaatcaaacttgatctccatggaaatcagataaagagtctaccaaataccaaattttggaatggattgaagaacctaaaactactctatcttcatgacaatgggtttgcaaagttaaagaatatatgtgtattatctgcctgtccaaccctcattgccctcactatgtttgattgtccagtaagccttaaaaaaggatatagacatgttcttgttaacagtatatggcctctcaaagcgctggatcatcatgtgatttctgatgaagaaataattcagaactggcatcttcctgaaagattcaaagcatgtaaccatcgacttttctttaatttctgcccagctttgagaaagggaacaacctatgaagaggaaattaataatattaaacatattacttcaaaaattaatgcaattctggctcataattcaccagttttgattgttcaaagatggatacgtggtttcttagttagaaaaaatttgagccctgtgtttttccacaaaaaaaaacagcaggaaaaaattattagaggatatgaagcaaaatggatttacataaccaaagggtatgaagataagctccttaaggatctctttttcaaacctgaaactaatataaaaggaaagcttgcatattggaaacataatatatattatcctgttgatttaaaaaattccagtgaacacagaaaacatgtgtcatctattttatgtgaattaaaaccaaaagatctaggcatgaaatcaaaaacatcaagacatctcattcaaaaaggtcaggagtctgaagatgaaattgtggatgaaaaattggataccagttttaggatatcagttttcaaactacccatatacacttcaggttcattgaagaataatgcagtattgagagagaaaaaacaacatttttttcctgcatatcctcagccaatctatactactcatccaaagccaatcattaaaaaagacatacgattggagcggagtatgaaagagttttttgcaccacaaagagctggtatgaaactccgaacatttagtgatattgacaaatattacacagaacaaaagaagcaggaataccataaagaaaaagtaagagttgtagccatggcacaagttgctcgagaaagagttagagtagctgttaatgaacatttgaatcagaaaaaatatgctacacaaaaactaattgaagaaaataaagagacaattcagaacagtttacgacaagtttggcaaaacagattcaactaccttgaaaaagctagagagagaaaagctctgtttctaaaagaaaaatcccaaaaggcttcagagcgtttattagttcaaaacttaaataatgagcgcactcttttgaccagaggactacttaaaattgacagactggagaagaatgaggctgtcctaaaagagaaaagcctgattgttaagcaaaaactaaaagcagaaaaatatagaaagaatttacttaaagaaatgaaaaaagttagatctcaagaaatatataaaagacattgtgaagaaaaatttgttatggatatgattgcctttgaaaaagcctgtgaaagacttcaagatgctaaaacaaaagtagcaattgtgaaaacaaatttagactttaaagttcccaatggactgataaaatgaatcaatgccagatcacatcctatgatcatcttaaattatagtcattatttttagttgaaggaatttgaaataatactctaaagcaagaaatactctacatcacaagatggatttatatataagtcttctaaaaatataaagattagttaaaatgtttctcttattggtcataatttaacttaaagttgacttagcacctctgaaaaatttcttagatcagatgcctaaggaacaattaaactgatttaatgtattgcagacaatgttgcaatgacattgctgatattctgtttcatattctttctaaatatagcaattcataagctaatttaggtttttctggaaaccttagaatagtaatttctactccaactgctgacttttattaagacactgtgtacgttgatgacttttattacctgcttttatatatttcctgcttattttgttaaaacaatttctgaatttattttttaaagtatggtttcaatattttgtcagtgatatatgctgttataaaaattcagaaaatatgaactatgaaaagtaaattaaacattcttatcaccttccttgaagactgtaagatttttgtatatttacttttgatgggtttgccctgtttggtatacatgtgaagacagggaaaagacagaggagagaagcaagagacaacccatataattatatattggaatcataaaatatacagaaatggtatatattaaccataagtctgtttaatacataccaatggtagaaaatttgaaaaataaactgtt

SEQ ID NO: 4686 - DNA, 1046 bp, Homo sapiens
cggaaaaccatgatgtggagaacttggatgttgtcttgtttctctagcaacggtctcaggagcagatggccgcccagcgatttgtctgactgtgttggggctgggccacttgtctccaactcataagggcttgcagcccagttgacccgatgtttcatggaacagtcacagaagagctaaccagtcatgaagaatggagtcactataatgaaaacataagagaaggtcaaaaagattttgtttttgtgaagttcaatggccttcatttaaagtctatggaaaatttgcagtcttgcatctctcttagagtatgcatcttctcaaacaattttattacagatattcatccacttcaaagttgtataaaattaatcaaacttgatctccatggaaatcagataaagagtctaccaaataccaaattttggaatggattgaagaacctaaaactactctatcttcatgacaatgggtttgcaaagttaaagaatatatgtgtattatctgcctgtccaaccctcattgccctcactatgtttgattgtccagtaagccttaaaaaaggatatagacatgttcttgttaacagtatatggcctctcaaagcgctggatcatcatgtgatttctgatgaagaaataattcagaactggcatcttcctgaaagattcaaagcatgtaaccatcgacttttctttaatttctgcccagctttgagaaagggaacaacctatgaagaggaaattaataatattaaacatattacttcaaaaattaatgcaattctggctcataattcaccagttttgattgttcaaagatggatacgtggtttcttagttagaaaaaatttgagccctgtgtttttccacaaaaaaaaacagcaggaaaaaattattagaggatatgaagcaaaatggatttacataaccaaagggtatgaagataagctccttaaggatctctttttcaaacctgaaactaatataaaaggaaagcttgcatattggaaacatgatataaaaaagttatatagtaatcaccat

SEQ ID NO: 4687 - DNA, 1827 bp, Homo sapiens
atgtcaaaagacataaaatcagtagaacattcacctaaaattcatcagagaaatgatccacagcacgtcaatgatagaacatttttcattgatgcctctaatcagagcttgactgccattcctttggagatcttcacattcacagaattagaagaagtgcatttggagaataaccagattgaagaaattccccaggagattcagcgtttaaagaacatcagggtcctctacctggataagaacaacctgaggagcctgtgcccggcgctggggctgctgagcagcctggagagcctggacctgagctacaaccccatcttctcctcctcccttgtcgttgtcagcttcctccacgccctgcgcgagctccggctctaccagaccgacctgaaggaaattcccgtcgtcatctttaaaaacctccaccatctcgagctgctcggactgaccggaaaccacctgaaatgtctgcccaaggaaatagtgaaccagaccaagctgagggagatctacctgaagcgaaaccagtttgaagttttcccccaggagctctgtgttctctacaccctggaaatcattgacctggacgagaacaaaataggtgccatcccagaagagatcggacacctgacggggctgcagaagttctatatggcttctaacaaccttcccgttctgcccgcgtccttgtgccagtgtagccaactgtcggtgctcgatttatcccacaacctcctccactccatcccgaagagcttcgccgagctcaggaagatgacggaaatcgggctgagcgggaaccgcctggagaaggtgccacgcctcatttgcaggtggacctcgctgcacctgctctacctgggaaacaccggcctgcacaggctgcggggctccttcaggtgcctggtcaacttgcgcttcctggacctaagccagaaccatctgcaccactgcccgctgcagatctgtgcactgaagaaccttgaagtcctgggactggatgacaataaaataggacagttaccttcagaattgggctcactttcaaaactgaagatacttggactaacaggaaatgagttcctttcctttccggaggaagtcctttctttagcgtctttagagaaattatacattgggcaagaccagggattcaaacttacctatgtgccagaacacattaggaaactgcagagtctcaaagagctatatatagagaacaatcatctggagtacctgcccgtatccttggggtcaatgcctaacctagaagttcttgattgccggcacaatttgcttaagcaacttccagatgccatttgccaagcacaagctttgaaagaattacggctggaggacaacttgctcacccatcttccagagaatttggattccctagtgaatcttaaggttctgacactgatggacaatcccatggaagaacccccaaaagaagtgtgtgctgaaggcaatgaggccatatggaaatacctcaaggaaaacagaaacaggaatataatggcaacaaagattcaggcatggtggcgtggaacaatggtacagagaggatttgggaaattcggtgaactactaaaaccacaaaagaaaggaaagacctctccaaaagataagaaaggaaagaaggatgtaaaaggaaaaccaggaaagggaaaaaagaaataatcctgtaaattgataaattggggtaatggaccttgatagattaagaagacaaaatatctaggaattagatgcctactacattaaaattattcataaaattacacttatgtgtaaaaataaatgattcttacttttactgaaata

SEQ ID NO: 4688 - DNA, 2210 bp, Homo sapiens
ggttaagggaaagcgtgggtgtgagtaggagtcttcggaaaccctttttctttcttttcgccccgctgctgttcgggagatggacttctggagtccccgtcgtagctggtgttgtcccctctaccttcaggaaagaagggcagatggccctcttgcctactgaagccgaggaggggcgcgtatacagcgggctaagggcgctcaagagatccgagtggaagaaaaagcagcggcacagcactggaatgggcgggagtggcagaagagttgtgaaggctattggctagcaagggtggtgggcggggcgtagaccgagctacccagtttactggtcgatttcggatccagttttccagttatagccacgttggcacctcttgaacctctgtggccgttagcacggttttctgcccgcgtgcccgagaaaccaacggattagaaggacttttaaagatgtgtgaggaaagagctcaccgctgaagaaggctgctgcatcactgaacttcttatcactaacatagcgagattttagtttggacgaatttgaggttataggggagatagcgatggcagaagactaggtggaaatggcacatctaggttggctgcagtcgaaacggtttgagcgtggtcgctgtggctcatcgtcggcaccaattaacgaagcgatgacatctgcgttgttaggggtttcttaaactgagttggtagaaatgcgaagcgtcagggttcccgccggcttcgagcctttcttggcgtatttgtatcttgagctgatttctgcgtcagcccacatctcgctctgatccgcacgccccccgggttgttttgcagtagcagtctcagccctcttctcgtctcattcccaaatcgtaatttcagttcacagctttttatctataatagctttatcaactctttttccgatgctctgcaccagatctcttaaaatataaaattaccttgcaaggtattgtttggaatacacggtattttcatgaagacaactattaatagaaaaatcagagtccagaactatggttctccatttctggtatactggtttgcagaagccttacattaagatttcataaatgattgttttgctgttaagtgcaacaacatcacagtagagctacataaagattgaaaggagatattttatcaagtggcaccagaatggactgattaaaatagaatggcctaattggaaagaatttcaggatcaccggtttctcctgcttcatggacaggccttcagtatttggcatcacctttacatggagcacaaagatgatgatgatgatgatgtgtcttttgccaaatggatgagcagcttctggggccacagctggagagaggaggatcagagaggactccgggaacgccaccgactgcaagccaccagtcacaggaaaacctccctgccctgcccacttcctgtgcttcccagaattccatcatctgactgccatcctagaaggcattctcatgaggaccaagaatttcgatgccgtagccacgtacgggattacagaaaatactcagaggatgggtcattcaaggagccactggaatcaaaaggaagatcccattccaaaattgagaaattttcagagtcctttgaacggcaactgtgctttagaaccaagcgttctgcctctttgggacctgaaagcagaaaggagagaaatgaaagagaatgcctgaggatggagataaaatcccgaaagaaagtagaggaagaaaggagctctaggaaagaagagcatggagaagcacacatggctcccctgtttgaaaaagggcctgaataatactctgcttctgcctcatgacatcagatgctactgttttggtttttttctttgagccccaattcaccatttcaggatgtggatgggggcggggttgggggtaaaaacagctataaaaagcaactgcagatgctgactgactgcagtgggcagggtatgtagctgctccaagatgacttgcatcataccccaattactgctggcatcttagttgagagtataatctgcttggttgcctttttatgggaataaagagaataaaaggtattttaatagaataaagaaaaatttgaaaatataatggaaggtatttaaagagccacccacatagcttcaccaacccttctcacacatcaactcataaatcatcttaaataaaagtcattggtatga

SEQ ID NO: 4689 - DNA, 1890 bp, Homo sapiens
catccctctgcagagcgcggggtcaccggaaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctgcctcacacgccaaggattacacagtggagaatctcatccgcatgggcatggcaggcttggtcctggtgttcctcgggattctgttatttgaggctcagcacagccagagaaacccccaagatgcagccgggaggtgaacagcggagaggacaatgcacccttcagcgtggtggagcctcagggacagatctgatgatcccagaaggctctggaggacaatctaggacctccagaggggggtgagatttcaggccacacactgtggaaggtaatcatgtctgatcacaaattttgggtctccaccttacttccaatctatgttgtgaatgcccagttgagacccacggaaaagagctcatgggtgagtgtgaagtgcttctctgtcttaagttcccagagatccttgcctcttggaggccagcaaacactaactcttgaggaattcatgacaatatcatctgattcctccttcccagcttgtatggcagtctcccaccctcatgtgttcaatctgatgatcccaggaggttctggaacaaaa

SEQ ID NO: 4690 - DNA, 1532 bp, Homo sapiens
tgcgtctctgctgatctgagtctgcctgcagcatggacctgggtcttccctgaagcatctccagggctggagagacgactgccatgcactgagggctcatccctctgcagagcgcggggtcaccggaaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcagcctcacacgccaaggattacacagtggagaatctcatccgcatgggcatggcaggcttggtcctggtgttcctcgggattctgttatttgaggctcagcacagccagagaaacccccaagatgcagccgggaggtga

SEQ ID NO: 4691 - DNA, 2066 bp, Homo sapiens
ccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacaacagatttgttctgtataaggagggggaacgtgacttcctccagcgccctggccagcagccccaggctgggctctcccaggccaacttcaccctgggccctgtgagcccctccaatgggggccagtacaggtgctacggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctcaccccagtgagcccctggagctcgtggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 4692 - DNA, 1924 bp, Homo sapiens
ccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 4693 - DNA, 2066 bp, Homo sapiens
ccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 4694 - DNA, 1977 bp, Homo sapiens
gcagagcgcggggtcaccggaaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggtgagggcgctgaccccgtcctctctgagctcaaaggctcagctcaggcccaggcccccaggagagctctcggctgggatggaccgagggaggctgtgagggaggcttagccagagggcacccagccctcagaggggaggaggccaacaggggttctcctaggcgtggccacccgttctcccctgcctggcatgcagaaggcaccaggtgggcagagagatggttccagggaatccactgggcggaagcaggagagtgggagtggaagggtgcactccatggacggcccccgcccctcacccgcctcccgtgctccttccaggacactctggaggctccagcctcccacccacagggccgccctccacacctggtgagtcactgaggcctcgtggggagcgcggcctcccccagggcagtctgagtctcccaaaggatcccactcccctcccctcaaggacgggcttgtgtcccaggggctctgaggctgggctggtgaagagtggggggttcaaggcagagagagatgttggggcccagccaggaggaggagccgggctgatgtggggagcaaggtagccccaggcttcacctccctgtcctgacccaggaggtcctgaggaccagccccttaaccccccagggtcaggccctcagaatcgtgagtgaggggctctgagtgggagat

SEQ ID NO: 4695 - DNA, 2170 bp, Homo sapiens
ctgagggctcatccctctgcagagcgcggggtcaccggaaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctcaccccagtgagcccctggagctcgtggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaat

SEQ ID NO: 4696 - DNA, 1542 bp, Homo sapiens
aacgcctagcattcgctgtgataaagggcgtctcagccaatcacctgtcgctacaggccagggggccgtaccaactaattcggaaccaatccgcggtcgaagtagggacaagaaaaaggggggcatcctctcgccaatcggaagtgcaaagaggcgggcgtgccagtccctggacagctacgacgccatgaatatcttgcccaagaagagctggcacgtccggaacaaggacaatgtcgcccgcgtgcggcgtgacgaggcccaggcccgggaggaggagaaggagcgtgagcggagggtgctgctggctcagcaagaggcccgtacagaattcctacggaagaaagccagacatcagaactcactgcctgagcttgaagcagcagaggcgggagccccaggttctggccctgtggacctgtttcgggagctgctggaggaagggaaaggagtgatcagaggcaataaagagtacgaggaagaaaagcgacaggagaaagagaggcaagagaaagctctgggcatcctgacatacctgggccagagtgcagcggaggcacagactcaacccccttggtaccagctacccccagggcgagggggccccccgcccggcccagccccagatgagaagatcaagagccgtctggaccctctgcgggagatgcagaagcatctggggaagaagagacagcacggcggtgatgaaggcagtcgcagcagaaaggaaaaggaggggtctgagaagcagcgacccaaggagcctccatccctggaccagcttcgagctgaacgtctgcggagggaagcagctgagaggtctcgggcagaggccctgctggcccgggtccaaggccgggcactacaggagggtcagccggaagaagacgagacggatgaccggcggcggcggtacaactcccaattcaacccccagctggcccggcgcccccgccagcaggaccctcaccttactcactgactcctgagggggtacaggagaggccgctgctgccagccgtcatataaaactatttattcataaatattttccaaaatgaaaataggtttaccaaaaaatgtccctcactggggaggggaggagggggcagccctcgcccccgggcccccagggtggggctgagaggaaaacctcccggccccctccctgcttcctgggagagggggatgccccgtggcttggggcctccctccagtcttccagggcagggccctcacctgggcagggggatcagcatgcgggggaagggggtgggtagagggaggggccggtgtcactggaggtcccggtcctccaggtagcggtactcaaaggtgaagccttccttcttccgctggccccacttctcgtagtcaaagtagatgtaggtgccctggccgggggagaaggcggtcagtgagtggacgaggaggtggtctgggatctgggccggaccaacagacaaaggggacaattcttagggctgtggatgtgtcaggcaccgggccagctgccctgcacgcacacactctcatccatcc

SEQ ID NO: 4697 - DNA, 2825 bp, Homo sapiens
ccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctggttggcagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaagcccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagcccgatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgtctcaagttgtataaagttgtctccgtgtcccctcctccctctgcccccagtgtttcttctgatttttttttcccctttccctccctccctctccgcattcttcccttggttcagcacaggtaaaacggttcccccctccctccctccctcttctgccatgtaa

SEQ ID NO: 4698 - DNA, 3991 bp, Homo sapiens
ccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctggttggcagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaagcccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagcccgatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaaccttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagagcgtgcacgctcctgctttgtc

SEQ ID NO: 4699 - DNA, 309 bp, Homo sapiens
cagagccagccgggtggcacagcggtgtcgtggccgtgttgctgatcgcctgggtggttgttggcgtgtccctgcagcgaaggatcctggcagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggacagaagcggcatcgactgccgcctcagcctggcgcagctgtcagccttctga

SEQ ID NO: 4700 - DNA, 1073 bp, Homo sapiens
cggtcaggacgtcgaagccaaagaagaccagagccagccgggtggcacagcggtgtcgtggccgtgttgctgatcgcctgggtggttgttggcgtgtccctgcagcgaaggatcctggcagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaagcccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagcccgatgactggccccaggacatgaaagagtatgtggagcgctgct

SEQ ID NO: 4701 - DNA, 463 bp, Homo sapiens
tcctgcgcgtctttctggggcgtggtgcgcaggcgcggcctgggcagtggctccgtggctagtcgtggggatccgagcggcctcctccacccggcgtcctcctttgccttcgcccagcctgcgggacggccaggcagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagca

SEQ ID NO: 4702 - DNA, 3966 bp, Homo sapiens
ccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctggttggcagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaagcccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagcccgatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaaccttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagag

SEQ ID NO: 4703 - DNA, 1914 bp, Homo sapiens
aggctctccaccaaggagggactgggccagagtcctcgcgagggcacgcggcgtggtccccagagctaggccggagcgcgggccgctgacgccactgtcgggtgaggctcggtgcatccatggggagccgccctccgtgcggggcgacctcgtctgcgcggcgggcgtgccagttccccgcacccatggcagcggccagagagccggagttgccgcaggaagcccccgccacggaacccgcgcccccgccggcctgccgcttcttcctggaaggccgctgccgcttcggcgcccgctgccgccagccccaccctggggcgccggcgccgcctggccgcgaggcgcagccggaggccggggccaagaagccgccgctgcgcacagccgcggacgtcatccagcgcatccgctgggacccgcgcctcgaccccgccgacttctcggtgggctacgtcgaccgctttctgggtgtgcgcgaggagcccttcagcgccttttgctgggaccagccgctggcggcgctcgggccgggcgtgctggcagtgccccagcaccgcgtgcgcttcttccgcttccatggccgccttgtgtgggaccgcgcctcgcgcaccgacctcgtctttggctctggctcggcggcgggacgcgggcccaccatcctggacgcaccgaacaccgagggcgcccacggggcagagggtgccgagtggacactggcggggacaggtcaggaggcccaggctgcccccaagcgagggagcacaaggccgctctgcacagggcaccaggaaccaggcgtggaggaacccggagagctggaggcggcccaggagagggcgctgggcacagctgctgatttgggaacactggccccaagaggacgcctcgccggagtgactgaggaggcactgaagccaacagcagccaccaggaccacattgctggggggcaaggaagcacaggccctgggagtcccggggggctccgctgagacgacagaagccgagtggggtcctgcggcctggcccgaggacaaaagggcccgccttagtgttgcagccccttgccaaccgcgccccacacattttgtggccctcatggtgaccgagcctgggctacaagcagaagtgaccaaggcccaggaatacctggtccacgtggccccacactgcgccaacttcctagtgccctctcagaacctacacctgaccctggccctgctgcgactggcaggcgctggggaggaggccgctgccattggagctctgagacgggccctcttggccccggggctaaatgcaccccctcggctgagctttagaaagctggtcctcctgggcccgcatgtgctgtgtgccccaccctctcccacactggaaagcatggcacaagtgctgagccagaggctggaagccgaggggctgagtacactacagtctccagggcagctgcacccccacctcaccgtggccaaggtgccccatggttcccaggtccacctccccaagctggagttcaccctcagccaggaagtggggtgccagcccctgcagacactctggctgtgccgtatagggaggacaggggggcctttccagcccctggctgagatccgcctggagtgacacccccagacctctggaggagacaatggatgcaaacagcccacacaggaaagacaaagcaggagcgtgcacgctctctctttctctctttaattttggtttctctcaagcttccaaatggtgctcagtgctccaaggaaaggaaggaaggaaggaaaaggaggggagaggaggggaaggggaggcagaggaggaacatctggaaaaaaagcagcctgacagtccagctgtttgcaaactcatagcacatcctccagttacatggcagaagagggagggagggagggcc

SEQ ID NO: 4704 - DNA, 6165 bp, Homo sapiens
cgacggcggcggccgtcctcatcccggcgcttgagaggacgcggggctgcgcaaatggcttgtcccgctctcggtctggaagctcttcagcccctgcagcccgagccgccccccgagcccgccttctccgaggcgcagaagtggattgagcaagtaactggcagaagttttggtgataaagattttcggacaggtttagaaaatggaatcctcctctgcgagttgctgaatgctataaagccaggacttgttaaaaagatcaatagattgcctacccccattgcaggactggacaatattatcttattcttgagaggttgtaaagagctcggccttaaagaatctcaactttttgacccgagtgacctccaggatacatccaacagagtaacagtcaagagccttgattatagtaggaagctgaaaaatgtattagttaccatttactggctgggaaaagcagcaaacagctgcacatcctacagcggaacgacactaaacctgaaggagtttgaaggattgttggctcagatgcgaaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacacctcagtttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagaaaagtccccgagagcacttccaggctgggcctttctctccctgttctcccacccctcccggtcagtcaccaaacaggtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaaaagaaaaattgttttgaaaatgtacagatcaagtccaatattttgattatccacctgcatgttttattaaatattttgataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaaaatgtgctttcccataatgaacactagtcaccagcacagaataatctccaacattttctaaattctaattgccaactgtttctatttatatttgatttatatttcatttggagtctgttacatggcagcttaggcagactagatcttgttttttccaatgcagcataatgagtatgatctatttcttttcaaataatctttgagatcccaggaaaaaaaaaatgctctgctccattgagctataatgtaaatgtgtttgtttaaaaaacaggtgaggcaagtgagtgatttattgttcctgaggaagtatatctgattttttttctcatactccaaaagctagtccctactctttaataaaaataatgggtaactttttgtttttcactagcgaacttccatgacatttcctttctatgtagtgtgattaatgcaatacatattatagttatctatacacagtgtaagatttaacaaactgaaatgatccacctcatatgtgagtccgtccaaaagatgttactgctctgggtgggccagtgttctatatcggttatactaactttcatttaaagtatttattctaaaatgcctctgagaaacagtaaaaaataaaaacaacaagttgtctaaaatgcaacagcttttatagtaaatgtacatttataaataaaatactcaaatcaa

SEQ ID NO: 4705 - DNA, 7258 bp, Homo sapiens
aggaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagctttcctgaaacgatagaggaagaggggagtgaagtggggtctgctggtgaagacaacccagctggccaaatgaatcctggttggaagccttccgatggtgggtgtgaattacctgacggcagtggtaaggagcacccttcttcagacggggctgtggtggcaccagctcccaagtctgaagaaaaagatgctgctgagatccaaaagcgcaaaaggctagagcaagctggaatcaaggtcatgccagcagcacagcgctttgccagtcaaaaacaattaagtgaagagaaagaagctattcgtgatattgtccttcgcaaagaaaactctttcctgacccaccaacatggcaacgattcagaggcagaaggtgaagttgtgtgtcgactgcctgatcttgagaaggatgactttgctgcaaggagagcaaggatgaaccaaaccaagccaatggtgccattaaatcaactcctctatggcccttatccaaagaaaggggcagagaaatcagatggcagcaaacagctctcaaagggaatctcaaaaaaaagaagtctagaatataaaagaaaccagggccacacagaagaggtgaagttgatagtgacctgtaacatgagggctcaggaaagtgaacctgtggaaggaggactcaggaaggtgccagatcttcacaaggatgacctggcccagcagagaattcagggcagccttgcccctcaccgcgagcccccgagcttcattacgctctccaacataacagaagctgacttggagacgtgggagagactcaaagtgtcagaaaaggcgagggatggagatgttcagcacatctgtgcttctgagccttccccagaaattaaagcagaaactgccattcgtgatgactttgccaaccgcaaagcaagggcctctaagaaagcttccagccccaggcaaaagtttgtgcactttgggccagtgacggagctagatcagcagaaatggaagcggcttagcattggcaaggctgggcctagagaggatgaagaagaagtcatctgtcatggcagcaagattcaaatggactctgtgtctcctgtctcagcggccacttccagcttaaagggccaccaaatatttaatcgacaaaatgactgcagaacaatgaattgtggccgaggtgactattgcagaagggcctcgtggctggctcctgtgccggagtctcaggaagagtgggtctgcagtttgggcgagtgcccgagggggacagaggaagttacatccaaacagctgccacaggatggcaaagaagaaacagaaagcgctccaagagattctgagaggctgtcaaaggcagaaagatcagaggacagcagccagccactggtgtgtcctctggcctctgagtgtgaggcttcagggacagaagagaagttggagaagatgacagctcctgcctggagtggcagtggactgaaaggccagcgaaagttggatgattcacgaaaagatgacatgatggccaggagaactgggatgtcccttagacacactggatccaacccaaaccagttccttccagttccatttgcaaagcaacaggatgtggaagaatcttctaaaggtctacccatgaaagatcagagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagaaaagtccccgagagcacttccaggctgggcctttctctccctgttctcccacccctcccggtcagtcaccaaacaggtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaaaagaaaaattgttttgaaaatgtacagatcaagtccaatattttgattatccacctgcatgttttattaaatattttgataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaaaatgtgctttcccataatgaacactagtcaccagcacagaataatctccaacattttctaaattctaattgccaactgtttctatttatatttgatttatatttcatttggagtctgttacatggcagcttaggcagactagatcttgttttttccaatgcagcataatgagtatgatctatttcttttcaaataatctttgagatcccaggaaaaaaaaaatgctctgctccattgagctataatgtaaatgtgtttgtttaaaaaacaggtgaggcaagtgagtgatttattgttcctgaggaagtatatctgattttttttctcatactccaaaagctagtccctactctttaataaaaataatgggtaactttttgtttttcactagcgaacttccatgacatttcctttctatgtagtgtgattaatgcaatacatattatagttatctatacacagtgtaagatttaacaaactgaaatgatccacctcatatgtgagtccgtccaaaagatgttactgctctgggtgggccagtgttctatatcggttatactaactttcatttaaagtatttattctaaaatgcctctgagaaacagtaaaaaataaaaacaacaagttgtctaaaatgcaacagcttttatagtaaatgtacatttataaataaaatactcaaatc

SEQ ID NO: 4706 - DNA, 5705 bp, Homo sapiens
agagcaggaatttcccttcaaggtagcaggagatgaacgcgtgctgctccaggattttacagaactgattctgcagcaaagacaaatgttgcctgtatttgccagatagtataaacaggagcaaaagttgcacagctaaaccaggggctcattcccaggacagacatgcagttatggattccgaaagacaagtcaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcaggagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaaaagaaaaattgttttgaaaatgtacagatcaagtccaatattttgattatccacctgcatgttttattaaatattttgataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaaaatgtgctttcccataatgaacactagtcaccagcacagaataatctccaacattttctaaattctaattgccaactgtttctatttatatttgatttatatttcatttggagtctgttacatggcagcttaggcagactagatcttgttttttccaatgcagcataatgagtatgatctatttcttttcaaataatctttgagatcccaggaaaaaaaaaatgctctgctccattgagctataatgtaaatgtgtttgtttaaaaaacaggtgaggcaagtgagtgatttattgttcctgaggaagtatatctgattttttttctcatactccaaaagctagtccctactctttaataaaaataatgggtaactttttgtttttcactagcgaacttccatgacatttcctttctatgtagtgtgattaatgcaatacatattatagttatctatacacagtgtaagatttaacaaactgaaatgatccacctcatatgtgagtccgtccaaaagatgttactgctctgggtgggccagtgttctatatcggttatactaactttcatttaaagtatttattctaaaatgcctctgagaaacagtaaaaaataaaaacaacaagttgtctaaaatgcaacagcttttatagtaaatgtacatttataaataaaatactcaaatcaa

SEQ ID NO: 4707 - DNA, 5740 bp, Homo sapiens
agagcaggaatttcccttcaaggtagcaggagatgaacgcgtgctgctccaggattttacagaactgattctgcagcaaagacaaatgttgcctgtatttgccagatagtataaacaggagcaaaagttgcacagctaaaccaggggctcattcccaggacagacatgcagttatggattccgaaagacaagtcaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaaaagaaaaattgttttgaaaatgtacagatcaagtccaatattttgattatccacctgcatgttttattaaatattttgataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaaaatgtgctttcccataatgaacactagtcaccagcacagaataatctccaacattttctaaattctaattgccaactgtttctatttatatttgatttatatttcatttggagtctgttacatggcagcttaggcagactagatcttgttttttccaatgcagcataatgagtatgatctatttcttttcaaataatctttgagatcccaggaaaaaaaaaatgctctgctccattgagctataatgtaaatgtgtttgtttaaaaaacaggtgaggcaagtgagtgatttattgttcctgaggaagtatatctgattttttttctcatactccaaaagctagtccctactctttaataaaaataatgggtaactttttgtttttcactagcgaacttccatgacatttcctttctatgtagtgtgattaatgcaatacatattatagttatctatacacagtgtaagatttaacaaactgaaatgatccacctcatatgtgagtccgtccaaaagatgttactgctctgggtgggccagtgttctatatcggttatactaactttcatttaaagtatttattctaaaatgcctctgagaaacagtaaaaaataaaaacaacaagttgtctaaaatgcaacagcttttatagtaaatgtacatttataaataaaatactcaaatca

SEQ ID NO: 4708 - DNA, 5467 bp, Homo sapiens
agcatttcagccgcagcagcctgcttgtggacagagcaggggttggcagtggtgacgactgttttgggaaaggaaatgtaagggcatttcggctgctgtgctggggctgacgaggagcacacaggagagatgcccctcccatctcccagagtgggttggctggagttcattgcggagcatgaggacgtgtgggggacaatattatcttattcttgagaggttgtaaagagctcggccttaaagaatctcaactttttgacccgagtgacctccaggatacatccaacagagtaacagtcaagagccttgattatagtaggaagctgaaaaatgtattagttaccatttactggctgggaaaagcagcaaacagctgcacatcctacagcggaacgacactaaacctgaaggagtttgaaggattgttggctcagatgcgaaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagctttcctgaaacgatagaggaagaggggagtgaagtggggtctgctggtgaagacaacccagctggccaaatgaatcctggttggaagccttccgatggtgggtgtgaattacctgacggcagtggtaaggagcacccttcttcagacggggctgtggtggcaccagctcccaagtctgaagaaaaagatgctgctgagatccaaaagcgcaaaaggctagagcaagctggaatcaaggtcatgccagcagcacagcgctttgccagtcaaaaacaattaagtgaagagaaagaagctattcgtgatattgtccttcgcaaagaaaactctttcctgacccaccaacatggcaacgattcagaggcagaaggtgaagttgtgtgtcgactgcctgatcttgagaaggatgactttgctgcaaggagagcaaggatgaaccaaaccaagccaatggtgccattaaatcaactcctctatggcccttatccaaagaaaggggcagagaaatcagatggcagcaaacagctctcaaagggaatctcaaaaaaaagaagtctagaatataaaagaaaccagggccacacagaagaggtgaagttgatagtgacctgtaacatgagggctcaggaaagtgaacctgtggaaggaggactcaggaaggtgccagatcttcacaaggatgacctggcccagcagagaattcagggcagccttgcccctcaccgcgagcccccgagcttcattacgctctccaacataacagaagctgacttggagacgtgggagagactcaaagtgtcagaaaaggcgagggatggagatgttcagcacatctgtgcttctgagccttccccagaaattaaagcagaaactgccattcgtgatgactttgccaaccgcaaagcaagggcctctaagaaagcttccagccccaggcaaaagtttgtgcactttgggccagtgacggagctagatcagcagaaatggaagcggcttagcattggcaaggctgggcctagagaggatgaagaagaagtcatctgtcatggcagcaagattcaaatggactctgtgtctcctgtctcagcggccacttccagcttaaagggccaccaaatatttaatcgacaaaatgactgcagaacaatgaattgtggccgaggtgactattgcagaagggcctcgtggctggctcctgtgccggagtctcaggaagagtgggtctgcagtttgggcgagtgcccgagggggacagaggaagttacatccaaacagctgccacaggatggcaaagaagaaacagaaagcgctccaagagattctgagaggctgtcaaaggcagaaagatcagaggacagcagccagccactggtgtgtcctctggcctctgagtgtgaggcttcagggacagaagagaagttggagaagatgacagctcctgcctggagtggcagtggactgaaaggccagcgaaagttggatgattcacgaaaagatgacatgatggccaggagaactgggatgtcccttagacacactggatccaacccaaaccagttccttccagttccatttgcaaagcaacaggatgtggaagaatcttctaaaggtctacccatgaaagatcagagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagaaaagtccccgagagcacttccaggctgggcctttctctccctgttctcccacccctcccggtcagtcaccaaacaggtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtatta

SEQ ID NO: 4709 - DNA, 3439 bp, Homo sapiens
agcctgcttgtggacagagcaggggttggcagtggtgacgactgttttgggaaaggaaatgtaagggcatttcggctgctgtgctggggctgacgaggagcacacaggagagatgcccctcccatctcccagagtgggttggctggagttcattgcggagcatgaggacgtgtgggggacaatattatcttattcttgagaggttgtaaagagctcggccttaaagaatctcaactttttgacccgagtgacctccaggatacatccaacagagtaacagtcaagtattagttaccatttactggctgggaaaagcagcaaacagctgcacatcctacagcggaacgacactaaacctgaaggagtttgaaggattgttggctcagatgcgaaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaa

SEQ ID NO: 4710 - DNA, 5071 bp, Homo sapiens
gcttgagaggacgcggggctgcgcaaatggcttgtcccgctctcggtctggaagctcttcagcccctgcagcccgagccgccccccgagcccgccttctccgaggcgcagaagtggattgagcaagtaactggcagaagttttggtgataaagattttcggacaggtttagaaaatggaatcctcctctgcgagttgctgaatgctataaagccaggacttgttaaaaagatcaatagattgcctacccccattgcaggactggacaatattatcttattcttgagaggttgtaaagagctcggccttaaagaatctcaactttttgacccgagtgacctccaggatacatccaacagagtaacagtcaagagccttgattatagtaggaagctgaaaaatgtattagttaccatttactggctgggaaaagcagcaaacagctgcacatcctacagcggaacgacactaaacctgaaggagtttgaaggattgttggctcagatgcgaaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcaggagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagagtcgcctggcactgccagtgttccgcttagagttcagaactcttggcgacgatcccagtttttctcccagtcagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaaaagaaaaa

SEQ ID NO: 4711 - DNA, 5057 bp, Homo sapiens
ggcgacggcggcggccgtcctcatcccggcgcttgagaggacgcggggctgcgcaaatggcttgtcccgctctcggtctggaagctcttcagcccctgcagcccgagccgccccccgagcccgccttctccgaggcgcagaagtggattgagcaagtaactggcagaagttttggtgataaagattttcggacaggtttagaaaatggaatcctcctctgcgagttgctgaatgctataaagccaggacttgttaaaaagatcaatagattgcctacccccattgcaggactggacaatattatcttattcttgagaggttgtaaagagctcggccttaaagaatctcaactttttgacccgagtgacctccaggatacatccaacagagtaacagtcaagagccttgattatagtaggaagctgaaaaatgtattagttaccatttactggctgggaaaagcagcaaacagctgcacatcctacagcggaacgacactaaacctgaaggagtttgaaggattgttggctcagatgcgaaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacacctcagtttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaa

SEQ ID NO: 4712 - DNA, 1706 bp, Homo sapiens
atggttaatgttgctgtgaaaataggagcccatgctctttcttaaagctacccagttttattttgttttttaaaatatttatccctataatcataaagaatattgtgttcttccatataaatcatgctaaaaattgagggtaggattttgacacacagtaacagcaatagataagcgagaggtcaaaaacataaaaatagacgctgaaatggtaaagctcacatatagttaaaaatgaataaaatagtgccatgaatctggacagatgtaactccattgcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaag

SEQ ID NO: 4713 - DNA, 5054 bp, Homo sapiens
ggcgacggcggcggccgtcctcatcccggcgcttgagaggacgcggggctgcgcaaatggcttgtcccgctctcggtctggaagctcttcagcccctgcagcccgagccgccccccgagcccgccttctccgaggcgcagaagtggattgagcaagtaactggcagaagttttggtgataaagattttcggacaggtttagaaaatggaatcctcctctgcgagttgctgaatgctataaagccaggacttgttaaaaagatcaatagattgcctacccccattgcaggactggacaatattatcttattcttgagaggttgtaaagagctcggccttaaagaatctcaactttttgacccgagtgacctccaggatacatccaacagagtaacagtcaagagccttgattatagtaggaagctgaaaaatgtattagttaccatttactggctgggaaaagcagcaaacagctgcacatcctacagcggaacgacactaaacctgaaggagtttgaaggattgttggctcagatgcgaaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaa

SEQ ID NO: 4714 - DNA, 3224 bp, Homo sapiens
agcgataaggcggtggcggcggcggtggctcggggaccactggtagcggcagcagctcgcgcccgcgccctcctcgtacccgtgcgcccccggagaccgatcccgccccgcggcccaggccgggcctgaacccagcgggtgccgcttctccacccgaggcttccacctccaacgagccatgttccaggctgcaggagccgcccaggccaccccctctcatgacgccaaaggcggcggcagcagcacggtgcagcgctccaagtccttcagcctgcgggcccaggtgaaggagacctgcgccgcctgccagaagaccgtgtaccccatggagcggctggtggccgacaagctcattttccacaactcttgcttctgctgcaagcactgtcacaccaagctcagcctgggcagctacgccgcgctgcacggggagttctactgcaaaccccacttccagcagctgtttaagagcaaaggcaactacgacgaggggtttggccgcaagcagcacaaggagctctgggcccacaaggaggtggaccccggcaccaagacggcctgaggcctctgtaaccttccaccccctctgcggaaggcctggagccggcagggggaaggtgggaaggaggtcgagctgggcttgcgtgggggccaggtgggaaggggatgaggcttgctcaggcgtaggggaccagggcagggctctgctccaggactccttccttcttccttctcccgcagccggtgagggtttggaaaccaggattggggtctgcccaccaccctgcttcctgcttcgttcagcctccctccccacctcaccccaggaccccctgggaggcccccaagcccagctcccctatctaggtgccttttctccagcaaggagtcagcatgcccccctcagggtcccaagctccctcactgccaccggagactgtgtggcccccacgtctccccatctacctctacccttaacctgtttctgagccacggagacagggaggaaggagcgcgacagtgccacctgttgggcatcataaatgcccctgcagcccatgggggaggagatggggaagtggagccaccctgcctctgcagggcaaggcagggcctgccccagtggggcttgggaccatctcgaaccaccagcgtggagaagcagaagcaaaagcactcgccaggctgcagcctcaggcactggcaggggctggtgcggccccactcccctcccccgctcccatttgtgcccatcctgttgtgaccaaccccgttttaaacatgtttcaatagatccagattctctattgtgtggcctgctgggggatctgtcacaggaagggtgcagactcaccatggggcgggcatggggggacagggccagccccgactacctcggccctgatgggggcagggagctagaagtgggtgtcagttccctgacacaccattgagaaatgggagggctcctcttcacagcgagggcttcatgctgtcacacccacagtggttttggaactgaaactccacctcacccctcagttctgggttggttcagacccaccaacttaccatatgcaccccattgtgaagaggcctgagagcgggagggccaggctgccagtgggtgatggcgcctgtcctcgctgcacttcagtgcctggggtgcaagctgccgcgttccctggctggttccagctgtctagctccctcccttcttcccagccctttgacctggaagtaagttagcgaagaatggcggtaaccagcagacccagcaagtgctgcccaaggttttagtgacccctggattgtcccccctcatcattacccctcgctgctgtcatcatccccttgccttttcaagctctgcggaggtgcagtcacagctactgtctcaggaaatccaaagagaaactacctctgcttctctgaaaacccagggacaatgagggatgagttcacagcagagcaaaccaggcaagttgggaggacctgagggcgccccggtgggacacaggcagaagtctgggttgtcctgctccagattcaacttcctgatgtctccagacatgggatcgatgagaacagagactcctggagggtttgctgccaccacaccatacaactgcctgagttcctaagtggcctccccgtggaacagggcagggagctgggccacaggctccagtgtcacataagtcactatgctgaggcaggcactgctcctcgagggagcagagcgaatactcagcagagatggtgccccggcctggatcctcccaagtgtgaagtgagcgcctcagagcctctcagggcaggccaacttcctgcaccagaggtctcagatggcaaggatcatcttggttcggttaagcaacagtagcagatgaccacaagggggtactggagaggtggctcttggagacacctgacccctgccctgcaaagatgggactgaaggaagtcctctgggccaggaagaccctaccaaatatcatgaaagctccgggaactcagccactggtgacgttcaggttgtgagggccagcagtgccaccctggtaaatcagccctgttgggaccaccccagtggagctcctggaggggcaactggaggaaaggggcagacacctctggactgacaatggtatcagccagatcaccccaggacccctctacttggagtcaagttctcttctgcttgaaaggcccaggctcgttgccaggcaccatacctggcccctgctaagcaaaaacctacctccaccccccacaactgaaagcactgccacaggacccctctgatataaatgatcccttttattgtaagtaatgcgcaacactggcctggctttgcactgcaagccctcggtcaagatatagtcaaataactatggctgcaggttccacagttccacaataaccatggctgcacgatccacaattcagacacagacatagagctggggtgggtggaaggggcaggagggtggcagagtgcggactgtccccagccctggcctctccatgcagagttggcccaggcagacacaccccatggaatgatgagaaagtgacggcacggccccttcccacagcaagcctggggctgccaggaactgcccttcagaacctttgggcccaggtcaccctgaagccccacaactttttatctggattagttattaaaaaacaataaattaagcaacaacttggtcctg

SEQ ID NO: 4715 - DNA, 3219 bp, Homo sapiens
cccggccgcccccagccccagccccgccgggccccgccccccgtcgagtgcatgaggttgacgctactttgttgcacctggagggaagaacgtatgggagaggaaggaagcgagttgcccgtgtgtgcaagctgcggccagaggatctatgatggccagtacctccaggccctgaacgcggactggcacgcagactgcttcaggtgttgtgactgcagtgcctccctgtcgcaccagtactatgagaaggatgggcagctcttctgcaagaaggactactgggcccgctatggcgagtcctgccatgggtgctctgagcaaatcaccaagggactggttatggtggctggggagctgaagtaccaccccgagtgtttcatctgcctcacgtgtgggacctttatcggtgacggggacacctacacgctggtggagcactccaagctgtactgcgggcactgctactaccagactgtggtgacccccgtcatcgagcagatcctgcctgactcccctggctcccacctgccccacaccgtcaccctggtgtccatcccagcctcatctcatggcaagcgtggactttcagtctccattgaccccccgcacggcccaccgggctgtggcaccgagcactcacacaccgtccgcgtccagggagtggatccgggctgcatgagcccagatgtgaagaattccatccacgtcggagaccggatcttggaaatcaatggcacgcccatccgaaatgtgcccctggacgagattgacctgctgattcaggaaaccagccgcctgctccagctgaccctcgagcatgaccctcacgatacactgggccacgggctggggcctgagaccagccccctgagctctccggcttatactcccagcggggaggcgggcagctctgcccggcagaaacctgtcttgaggagctgcagcatcgacaggtctccgggcgctggctcactgggctccccggcctcccagcgcaaggacctgggtcgctctgagtccctccgcgtagtctgccggccacaccgcatcttccggccgtcggacctcatccacggggaggtgctgggcaagggctgcttcggccaggctatcaaggtgacacaccgtgagacaggtgaggtgatggtgatgaaggagctgatccggttcgacgaggagacccagaggacgttcctcaaggaggtgaaggtcatgcgatgcctggaacaccccaacgtgctcaagttcatcggggtgctctacaaggacaagaggctcaacttcatcactgagtacatcaagggcggcacgctccggggcatcatcaagagcatggacagccagtacccatggagccagagagtgagctttgccaaggacatcgcatcagggatggcctacctccactccatgaacatcatccaccgagacctcaactcccacaactgcctggtccgcgagaacaagaatgtggtggtggctgacttcgggctggcgcgtctcatggtggacgagaagactcagcctgagggcctgcggagcctcaagaagccagaccgcaagaagcgctacaccgtggtgggcaacccctactggatggcacctgagatgatcaacggccgcagctatgatgagaaggtggatgtgttctcctttgggatcgtcctgtgcgagatcatcgggcgggtgaacgcagaccctgactacctgccccgcaccatggactttggcctcaacgtgcgaggattcctggaccgctactgccccccaaactgccccccgagcttcttccccatcaccgtgcgctgttgcgatctggaccccgagaagaggccatcctttgtgaagctggaacactggctggagaccctccgcatgcacctggccggccacctgccactgggcccacagctggagcagctggacagaggtttctgggagacctaccggcgcggcgagagcggactgcctgcccaccctgaggtccccgactgagccagggccactcagctgcccctgtccccacctctggagaatccacccccaccagattcctccgcgggaggtggccctcagctgggacagtggggacccaggcttctcctcagagccaggccctgacttgccttctcccaccccgtggaccgcttcccctgccttctctctgccgtggcccagagccggcccagctgcacacacacaccatgctctcgccctgctgtaacctctgtcttggcagggctgtcccctcttgcttctccttgcatgagctggagggcctgtgtgagttacgcccctttccacacgccgctgccccagcaaccctgttcacgctccacctgtctggtccatagctccctggaggctgggccaggaggcagcctccgaaccatgccccatataacgcttgggtgcgtgggagggcgcacatcagggcagaggccaagttccaggtgtctgtgttcccaggaaccaaatggggagtctggggcccgttttccccccagggggtgtctaggtagcaacaggtatcgaggactctccaaacccccaaagcagagagagggctgatcccatggggcggaggtccccagtggctgagcaaacagccccttctctcgctttgggtcttttttttgtttctttcttaaagccactttagtgagaagcaggtaccaagcctcagggtgaagggggtcccttgagggagcgtggagctgcggtgccctggccggcgatggggaggagccggctccggcagtgagaggataggcacagtggaccgggcaggtgtccaccagcagctcagcccctgcagtcatctcagagccccttcccgggcctctcccccaaggctccctgcccctcctcatgcccctctgtcctctgcgttttttctgtgtaatctattttttaagaagagtttgtattattttttcatacggctgcagcagcagctgccaggggcttgggattttatttttgtggcgggcgggggtgggagggccattttgtcactttgcctcagttgagcatctaggaagtattaaaactgtgaagctttctcagtgcactttgaacctggaaaacaatcccaacaggcccgtgggaccatgacttagggaggtgggacccacccacccccatccaggaaccgtgacgtccaaggaaccaaacccagacgcagaacaataaaataaattccgtactccccaccca

SEQ ID NO: 4716 - DNA, 897 bp, Homo sapiens
ccgtggcccacgaagctcatctttgaactgtccccgccttctcccgccttgacttgtgaccctaggccctttggggcgcctctgacccagctagccagatcccggacccaaaccatgttccctgtgaaggtgaaagtggagaaatcagagctggagatggtcaaagcccggaaccaactggatgctgtcttgcagtgtctgctggagaagagtcacatggacagggagcgtctggatgaggaagctgggaaaacaccctcagacacccacaataaggactgctccatcgcagccactggcaaaaggccatctgcccgcttcccccaccagcggaggaagaagaggagggagatggatgatgggctggctgagggagggccgcagcgatccaacacatatgtgatcaagctgttcgaccggagcgtggacttggcccagttcagcgagaacacgccactgtacccaatctgccgcgcctggatgcgcaacagcccctctgtgcgcgagcgtgaatgctctcccagctcacccctgcccccgctgcctgaggatgaggagggctcagaggtaaccaacagcaagagtcgtgatgtgtacaagctgccgccacccacacccccggggccacccggagatgcctgcagatcccgcatcccatctccactgcagcctgagatgcagggcacccctgacgatgagccctctgagcccgagccctcaccctccacactcatctatcgcaacatgcagcgctggaaacgcatccgccagaggtggaaggaggcctctcatcggaaccagcttcgttactcagaaagcatgaagatcctacgagagatgtacgaacgacagtgatgttcccaggtccccccacaccagtaaacatcccccagctcc

SEQ ID NO: 4717 - DNA, 1798 bp, Homo sapiens
gtcacgtgacatgggttggaagatggcgtctcccacagacgggacagatctggaagcatctttgctaagttttgaaaaacttgaccgtgcctcaccagatctttggccagaacaattaccaggtgttgctgaatttgcagcttccttcaaaagtcctattactagttctccacccaaatggatggctgagatagaacgtgatgacatcgacatgttgaaagaactggggagtctcaccacggctaatttgatggagaaggttcgaggcctacagaacctagcctatcagctggggctggatgagtccagagagatgacacgggggaaattcctcaatattctagagaagcccaagaagtagcagctgcttgcggacaggatgtcctggggtccgaaaccaagctcccttcccggtgcacctctaacaatgcacacctcactgcttgcttgggagaggccagagggtgtacctccaggactgccctctcccctgctcctggcactctacacgtctgaggacattcagcagcaagagaagaatctgctctacccaaggatcattgcagttactcaatcaactttcagacttgaaccttcttagcctcggatattggtaacagctgagggcatatcattcttaaaggtcgaagtcctgctttctcatttctggaagtgattcaggagccccaggatcttacggttgatttgactcagtcatggcagtcagttgtgacatgttgattggatgggttcttttgaattgttcttgatctcttagaaagtgtttacgatgtgaggagaccagagaccaagtagattctggaccagaccatgcagcctgacctgtgaactctccagtatatactaagttcccagaatccccagctgaagaaaccagaatcttctcgaaatgtatatctgttttttaaaacttctatacctcttatgatagtcccatttgcttttcattccttacttcccagccccaccttctagttctgacttcgggcagagggatccctgagtccctcctggaattagcttgtatagtgaaaggcccatccaaggttgtctaaagaccaatgtgaaggtgacagaaaggacttttgagttctaattaatctgttacagcttcaagcaagaaagtcagtatagcctgaaagacaagagaaacgggatggtttataggagttcccatttggttgaaagctagaagccctaattgaccttaaagtaacatgctatgggatggtgggattgtcccctctgacagcacatatgaaatagttcatctatataatagaaacgcacacacacgaaaaagaatcttctgacttaaatacaactttcatggagttcttcaccacttatctgtctctgttaaaatctgaaaatctagcccatggctaaaatctattatatgtgttctccatatttcttgtataagccagtccccagcatctgatgttttgagaagtgcatggagtttcctaaactttgcacaaaagaatatcctggggccgggcatggtggctcacgcctgtaatcccagcactttgggaggccgaggcaggtggatcataggtcaaaagatcgagaccatcctggccaatatggtgaaaccctgtctctactaaaatacaaaaattagctgggcatgatggtgcatgcctatagtcccagctacttgggggcctgaggcacgagaatcgcttgaattcgggaggtggaggttgcagtgagccgaaattatgccactgcactccagcctgggcaacagagtgagactctgtctcag

SEQ ID NO: 4718 - DNA, 2774 bp, Homo sapiens
aacatccgcgtaaggggcgtggctatacttaggggcggggctaggcaaagattgccctatgaggcgagggaatgagactgggctgcgagttggggatagggtttctctttgggggcgtggcttatggaacctcgttttcccgccgacggttggccacgtcacgtgacatgggttggaagatggcgtctcccacagacgggacagatctggaagcatctttgctaagttttgaaaaacttgaccgtgcctcaccagatctttggccagaacaattaccaggtgttgctgaatttgcagcttccttcaaaagtcctattactagttctccacccaaatggatggctgagatagaacgtgatgacatcgacatgttgaaagaactggggagtctcaccacggctaatttgatggagaaggttcgaggcctacagaacctagcctatcagctggggctggatgagtccagagagatgacacgggggaaattcctcaatattctagagaagcccaagaagtagcagctgcttgcggacaggatgtcctggggtccgaaaccaagctcccttcccggtgcacctctaacaatgcacacctcactgcttgcttgggagaggccagagggtgtacctccaggactgccctctcccctgctcctggcactctacacgtctgaggacattcagcagcaagagaagaatctgctctacccaaggatcattgcagttactcaatcaactttcagacttgaaccttcttagcctcggatattggtaacagctgagggcatatcattcttaaaggtcgaagtcctgctttctcatttctggaagtgattcaggagccccaggatcttacggttgatttgactcagtcatggcagtcagttgtgacatgttgattggatgggttcttttgaattgttcttgatctcttagaaagtgtttacgatgtgaggagaccagagaccaagtagattctggaccagaccatgcagcctgacctgtgaactctccagtatatactaagttcccagaatccccagctgaagaaaccagaatcttctcgaaatgtatatctgttttttaaaacttctatacctcttatgatagtcccatttgcttttcattccttacttcccagccccaccttctagttctgacttcgggcagagggatccctgagtccctcctggaattagcttgtatagtgaaaggcccatccaaggttgtctaaagaccaatgtgaaggtgacagaaaggacttttgagttctaattaatctgttacagcttcaagcaagaaagtcagtatagcctgaaagacaagagaaacgggatggtttataggagttcccatttggttgaaagctagaagccctaattgaccttaaagtaacatgctatgggatggtgggattgtcccctctgacagcacatatgaaatagttcatctatataatagaaacgcacacacacgaaaaagaatcttctgacttaaatacaactttcatggagttcttcaccacttatctgtctctgttaaaatctgaaaatctagcccatggctaaaatctattatatgtgttctccatatttcttgtataagccagtccccagcatctgatgttttgagaagtgcatggagtttcctaaactttgcacaaaagaatatcctggggccgggcatggtggctcacgcctgtaatcccagcactttgggaggccgaggcaggtggatcataggtcaaaagatcgagaccatcctggccaatatggtgaaaccctgtctctactaaaatacaaaaattagctgggcatgatggtgcatgcctatagtcccagctacttgggggcctgaggcacgagaatcgcttgaattcgggaggtggaggttgcagtgagccgaaattatgccactgcactccagcctgggcaacagagtgagactctgtctcagaaaaaaaaaaaaaaaaaaaaaaaaaaaaagaatatccctgtggcaatagtctgatggtgtttggacacaagaaaagttatggttttgagtcgtgagtgtttgctagggcatggcactcttcagtttaacagctgatccattaaaccttttctgacatttgtgccttgttctcatgctagaattaatgctggatttttctctcatttgaccatcaatgtagttttacttattgaaaggaaaaaagacttaacacaagataggaaagatgagtatgagaagtaaaacattctgctggggtgctacatagaaggttaggttgtaggggctttgattttaatttaaacttattatcgattgatatttctgtatctcactaaatgcggttgaagagtgtgtgtgtgtgtgtgcgcgcgcgcatgtggccaaaaaatagtgccataatgtcaaattcttcctttgctctgtttttgagagttgatgacatcaggcacttttcagtgtttggggaaattgattgggatacctcccccaaaccaactcaagtctgtaactggaagccaggtggttggttttctggtccgctttgtcctctttcttttaccgtcatcctattcaccagcacttaatgtaagtagatgttttagaattgcaatatttattggtttagtatttgtcatccttagaaatgttaatgatgtatttttatattgataatataaatttatgtacagtatgtgtgtatatgtatttcaggatgttatagtattgtactttgtatgtgatggtttttgtgtcttcataataaatatgtccctttta

SEQ ID NO: 4719 - DNA, 3849 bp, Homo sapiens
gagatcgggaatcctctcagtccttagttacaaggctccatcctcactttgttcgctcctcagtcgtccaggcggattcctttttcgccaggcaccaaggcacagcttagagtagacccgagtcctgctctgcggagttcgtcttcccagcgaaggtacagaggcggatgaactgctgagacttgattgacgtattttaagatttttttaacttctgaagtctagcaggcctgtaagaacaaaaatcattctgtaggaattaaaaacagaatccagtcttgacaacatatccacaatgtctgatgtatctactagtgtacaatcaaaatttgctagacttgcaaagaaaaaggaaaatatcacctatatgaaaagagagcagttaacagaaactgataaggacatagctccggtattagatttaaaatgcaaggacgtatcagcaattatgaataagtttaaggtcttaatggaaattcaagacctgatgtttgaggagatgagggaaactcttaaaaatgacctaaaagcagttttagggggaaaagctacaatacctgaggtaaagaattcagagaactccagtagtaggacagagtttcagcaaataatcaatttagcattacaaaaaacagggatggtagggaaaatagaaggagaaaactctaaaataggtgatgataatgaaaatttaacctttaaattagaagtaaatgagctgagtggtaaattagacaacactaacgaatacaatagtaatgatggtaagaaattaccccagggtgaatcacgaagttacgaagtcatgggaagtatggaagaaaccttatgcaatatagatgacagagatggaaatcgcaatgtccatttagaatttacagaaagagagagtaggaaggatggagaggatgaatttgtcaaagaaatgagagaggaaagaaaatttcagaaattgaagaataaagaggaggttttaaaagcctccagagaagaaaaagtgttgatggatgaaggagcagtacttaccctggtagccgacctttcatcagcaacactggatattagtaagcaatggagtaatgtcttcaacattctgagagaaaatgattttgaacctaaatttctgtgtgaagttaaattagcatttaaatgtgatggtgaaataaagacattttcagatctgcaaagccttagaaaatttgccagccaaaaatcttctgtgaaagaattactgaaagatgtactcccacaaaaggaagaaataaatcaaggaggaagaaaatatggaattcaagaaaaaagggataaaaccctaatagactcaaagcatagagctggagaaataaccagtgatggcttgagcttcctatttcttaaagaagtaaaagttgctaagccagaggagatgaaaaacttagagactcaagaggaagagttttccgagctagaggagctggatgaagaggcctcagggatggaggatgatgaagatacctcagggctggaggaggaggaggaagagccctcagggctggaggaggaagaagaagaagaggcttcagggttggaggaggatgaggcctcagggctagaggaggaagaggaacagacttcagaacaggactcaacctttcagggtcatactttggtagatgcaaagcatgaagttgagataaccagtgatggcatggaaactactttcattgactctgtagaggattctgaatcagaggaggaagaagaaggaaagagctctgaaacaggaaaggtaaagactacctccctgactgagaaaaaagcctcacgtagacaaaaagaaattccctttagttatttggttggggactctgggaagaaaaagttggtgaaacaccaggtggtgcacaaaacccaggaggaagaggaaacagctgtgcccacaagtcaaggaactggcacaccctgtctgaccttatgtttggcctctccctcaaagtcactagagatgagtcatgatgagcataaaaagcattcacatacaaatttgagtatttcaacaggagtcaccaaacttaagaaaacagaagaaaagaaacacagaactctgcacacagaagaactaacatccaaagaagcagacttaacagaggaaacagaagaaaacttgagaagtagtgtgattaatagcatcagagagataaaagaggagattggaaatttgaaaagttcccattcaggtgtcttggaaattgaaaattcagtagatgatctgagtagcagaatggacatacttgaagaaagaatagacagtctagaagatcaaattgaagaattctctaaggatacaatgcaaatgaccaaacagataattagtaaagaaaggcaaagagatatagaggagagatctagaagttgcaacattcgtttgataggaattccagaaaaggagagttatgagaatagggcagaggacataattaaagaaataattgatgaaaactttgcagaactaaagaaaggttcaagtcttgagattgtcagtgcttgtcgagtacctagtaaaattgatgaaaagagactgactcctagacacatcttggtgaaattttggaattctagtgataaagagaaaataataagggcttctagagagagaagagaaattacctaccaaggaacaagaatcaggttgacagcagacttatcactggacacactggatgctagaagtaaatggagcaatgtcttcaaagttctgctggaaaaaggctttaatcctagaatcctatatccagccaaaatggcatttgattttaggggtaaaacaaaggtatttcttagtattgaagaatttagagattatgttttgcatatgcccaccttgagagaattactggggaataatataccttagcacgccagggtgactacaaacaatatgctttcctcccccagcatgcatccaaaaatcaacaagtaaaacgaaaatacacttctacccagaaggatggacagctaatagcgtacttggggatgaggagcaaggaatattacagatattacctagatgttaataaagggtatgtttaaaaaaaataggctggtctcaatgtagtgagttatttcagttgatcacagtcagttacagatagaattccttgttttacttcccccccaccacctccctactgcagttgactagtctttttagaatttatattatctggctgggcacggtggctcacacctgtaatcccagcactttgggaggccgaggcgggtggatcacgaggtcaggagatcgagaccatcctggctaacacagtgaaaccccgtctctactaaaaataaaaaaaattagccgggcatggtggcgggcgcctgtagtcccagctacttgggaggctgaggcaggagaatggcgtgaacccaggaggcggagcttgcagtgagccgagatcacaccactgcactccagccggagccacagagcgacactccgtctcaaaaaaaagtatattgtgctagcttgtctaagaataaacttctatactgttgggggagggctgcacctgtcaagataacctgtcaatgtagtaggaaaacaggaggggacagtaacagaaaagcacgggaaaagatggcaaggttagttaaaatagaaaagtgctcagttcctcatacctgtaatcccagcagtttagggggccaaggcaggtgggtcacttgagcccaagagttcaaggccatcctgggcaatgtggcgaaagtgtctacaaaaaaatacaaaaagaggaagaaatgatatttcacaagtttgtatcatttgtcatgatgtgactcgaatatattaaatctttttcctttgaa

SEQ ID NO: 4720 - DNA, 4821 bp, Homo sapiens
ctctgcgcatgcgggaggaggtgccagcttgtactttctgtgaactacggtggcccagagcgggcatttgtgttccctcaaatggcggtgtgaagagagttcgcctgagccagatcccaggtttcactgaagaaacttcttagagattcattgcacttctgagatttaatgtttacaacttggagttgtcgaccttcttataagatacattttggaagtcaaaatgaaagttttctgtgaagttttagaagagttatacaagaaggtacttcttggagccacacttgaaaatgacagccatgattacatcttttatctcaacccagcagtttcagatcaagattgttctacagccacctccttagaatgggcaaacacctgtggtatccagggcaggcatcagcccatctctgttggtgtggctcccattgctgtagcacctgtgtgtttgaagaccaactctcagatgagcggttccagagaagtaatgctccttcagttaacagtgatcaaagtgatgacaacccggatattgtctgtcaaaaccgagttccatgcaaaggagcagtacagagatgtaattaaaattctcttagaatcagccaaagtcgattctaaattaatctgcatgttccaaaattcagataaattgttatctcacatggctgcacagtgccttgcattgcttctatatttccaattgagagaaaagataaccttaagtaattcctggattgctttttgccagaaaaatctttctgaatactctgagagtaataaagcaatatactgcctctggactcttacagcaataataaaagaaatctttaaagattcatgttcacagaaaacagaaattctaaagcagttcctgactcatttcgacaccatttttgaagtgttttacaattccttattctctcagcattttgaaaactgccgggatacttctaaaatagtaaacatcctgatgtgtttcctggatttgcttgagcttctcatcgcctccagaatccacctgaagttacatttcacttgccagaggattttatttttgaaaccatcttgcatgctagaagttattacctggcctattcaggcttttgttaaaaggaaggtcatcatattcctcaaaaagtgccttctctgtaaagtgggtgaagacctctgtcgtggatctgtgcctgccttaatgccgccagaccatcatgtagcggtggacatgctggctttagctaatgctgttttgcaagctgtgaattcggggttgttgaagacactgtctgtttatgaaaaacattccttttttggaggtgatgaagttcaacctgaatgtgaacttatcactagtccagatcatgtgatccttagagcagcaagcttagttataatgaaatccttagaaatcaagtttcaaaattattcttcagcaagtgaagtgaaagttgacttacagaggttcatgtctgagttactgaccttcttaaagcctcatcttcagccctctctgcaattacacaatccgtgcaaatggctgtctcgggttttcatagaacaagacgatgacatgctggaggctgccaaggcatcactgggcatctacttaacactgaccagaggatgtgaagccactgaaagcttgactcagggaaaagaaatgtgggaccatcacacacatgaaaatggctataatcctcactgtattttcttgttcttcttgaaaaatataggatttgattccacagttcttcttgactttttgatttcatcagaaacctgttttcttgaatattttgttagatatttaaaattactgcaaaaggactgggataattttttcaccatttgcaataactttgatgcaactgaatctaaatatgacataagtatttgtggctgtgtcccctcacttgtccaagaccaaagctccaaccaaacaataccccatcgtttgactgctcctcatagtcacagagatgtgtgtgctcggcactcctgggcttccgatgctccctctgaaccactgaaagctgtgatgtccaagggggctcacaccatgtgtgcttctagtctgtcttccccccgggcctctcaaagtctggtagattacgacagctctgacgattctgacgtggaatccacagagcagtgtttagctaacagtaaacagacatctttacaccagcaagcaactaaggagattcaggatgcagctgggacaagcagggataaaaaagaatttagccttgagcctccatcaaggcctctggttctgaaagaatttgatactgccttctcctttgattgtgaagtagccccaaatgatgtcgtctctgaagtgggaatattttacagaatagtaaaatgcttccaggaactacaagatgccatctgccgtttgcaaaagaaaaatcttttcccatataatccaactgcacttttgaagttgttaaaatacatagaggtgataagtaataaaactatgaacactttgtaaaacattgacattttattttccaggtattgtttttccttaatataaattatgtctcaatgaggtaatagtataaaatcatcaccataaaagggttttcttttttttttttttttttgagacagaatctcattctgtcgctcaggccggagtgcagtggcgtgactcgactcactgcaacctccacctcctgggttcaagcaattctcctgcctcagtctcccgagtagctggaattacaggtgcccgccaccacgcccagctaatttttgtatttttagtagagacgggggtttcaccatgttgccaggctggtctcaaactcctgacctcaagtgatccgcctgtccgccctcccgaagtgctgggattacaggcatgagccactgtgcccggctgggttttctagacaagttcttactttttgccttattggaagcaacctagtgactgaaaaagagacatcaagtgacaagtcactcattatagctatataccactggagatttatggcagttctaagtgacacaaaatcgggggtggtgattgcgttcctcagctagggctgccgtaacaacttgccacgtgtgccgcagcttcagacacctggaattatcctcatagttttggaggccagaatccaaactcaggcttcagcagggcaatgccctcagggtctggagaagaatcccaccctgcccctttctggcttctggtggcagccagccagccatggtgtcccttgtcttgtagtggcgtcactccagttcctgcctcacatggcattttcctgtgtctgtgtccagtttccctcctacaaggacatcggtcattggactaggacctaccctcatccagtatgatctcaacttgatgacagctgcaaagaccctaatcccagatatggccactttcatgtgtccttgatggacttgaatccaggagagtcactaaccaaatacagttactatttccttctggggtatttacacagaaagcgatatattacaaatgtaaaatcttagccgtttctttgagaagtgattatacctggcctactgtatgaacatgattctttctaaaaaaaaatttaatcactaattttcctatttaaaattgtgacatgaataattatgttccatattcttgaggggaagccgtaaattccattgtaatatgtttgtgtaataggagcaatagctatattgtgctgcgaagtctggcattaaggcagtctaaaatattgcctgtacatttttttttaatgatctctttgcagagaaacagaacaaagactaaacctaccgcacattaaaatatatattaaggctatggtattcgaaacagtttagtacttaattcaggtagacatggaaaaatcagtggagctaaatagaaggttgccgattaaaataacagcgaagtaccagtgttagccaaatagcaatgcaaaggtcaaaaggtttgcgttttaacatgctgtcggtgaggctatgcgttaaggcagtttctaccgtaattgaaaaagcacgtcaaagaatgtgtattcaaggatgccacatagtttgtaaaaaatgttaaggttttagagttttactagaaatacctggtaaagtaagtcagaatttgtatagtcagtggaatggtagatgcgttctatgcacgtttgtggatgtgaaacatctccagtaaaaaacaagtaaatacatggggcttgcaattatttagggaaagaagcagggcgggagtaatacacattcatatatatgcttttgtgcatgtataaaatatgtatgtaagactacataagaaagtcataatagtggttgccttgggagacaggtctgatgtggaagacaaagtctcatctttttgtactatttttagtgggatacatgcagcactgcattaggatgtttcaataacagaccacatagtacagtggtcccataagactatcaagccgttatttttactgtgactgtcctatgtttaggcatgtttagatacacgcatacttactattgtgttacagttgcctacagtattcagtacagtaacatgctgtgtacaggtttgtagcctaggagcaatgggctataccatatagcctaggtgtgtagtaggctatgccatctaggtttgttgagtatactctgtgacatacatgacatgacaacaaaattgccttacagctcatttctcagaacatgtccctgtcatgtgacacatggctgttttttgatggaaataactgggaaaaaaaaatcgactcttgttcctaagggtacataaatgttgaatgcattataactcatgcttatgca

SEQ ID NO: 4721 - DNA, 827 bp, Homo sapiens
ggcggtgtgaagagagttcgcctgagccagatcccaggcagttttaacaagggaggcatgagacatcaatcaagatatgtaaaatgaacattggttcagtccagaaaggtgggacaactcttaagctgggagggggcttccaggtcacaggtttcactgaagaaacttcttagagattcattgcacttctgagatttaatgtttacaacttggagttgtcgaccttcttataagatacattttggaagtcaaaatgaaagttttctgtgaagttttagaagagttatacaagaaggtacttcttggagccacacttgaaaatgacagccatgattacatcttttatctcaacccagcagtttcagatcaagattgttctacagccacctccttagaatgggcaaacacctgtggtatccagggcaggcatcagcccatctctgttggtgtggctcccattgctgtagcacctgtgtgtttgaagaccaactctcagatgagcggttccagagaagtaatgctccttcagttaacagtgatcaaagtgatgacaacccggatattgtctgtcaaaaccgagttccatgcaaaggagcagtacagagatgtaattaaaattctcttagaatcagccaaagtcgattctaaattaatctgcatgttccaaaattcagataaattgttatctcacatggctgcacagtgccttgcattgcttctatatttccaattgagagaaaagataaccttaagtaattcctggattgctttttgccagaaaaatctttctgaatactctgagagtaataaagcaatatactgcctct

SEQ ID NO: 4722 - DNA, 872 bp, Homo sapiens
agagcgggcatttgtgttccctcaaatggcggtgtgaagagagttcgcctgagccagatcccagttttaacaagggaggcatgagacatcaatcaagatatgtaaaatgaacattggttcagtccagaaaggtgggacaactcttaagctgggagggggcttccaggtcacaggtttcactgaagaaacttcttagagattcattgcacttctgagatttaatgtttacaacttggagttgtcgaccttcttataagatacattttggaagtcaaaatgaaagttttctgtgaagttttagaagagttatacaagaaggtacttcttggagccacacttgaaaatgacagccatgattacatcttttatctcaacccagcagtttcagatcaagattgttctacagccacctccttagaatgggcaaacacctgtggtatccagggcaggcatcagcccatctctgttggtgtggctcccattgctgtagcacctgtgtgtttgaagaccaactctcagatgagcggttccagagaagtaatgctccttcagttaacagtgatcaaagtgatgacaacccggatattgtctgtcaaaaccgagttccatgcaaaggagcagtacagagatgtaattaaaattctcttagaatcagccaaagtcgattctaaattaatctgcatgttccaaaattcagataaattgttatctcacatggctgcacagtgccttgcattgcttctatatttccaattgagagaaaagataaccttaagtaattcctggattgctttttgccagaaaaatctttctgaatactctgagagtaataaagcaatatactgcctctggactcttacagcaataataaa

SEQ ID NO: 4723 - DNA, 558 bp, Homo sapiens
agagcgggcatttgtgttccctcaaatggcggtgtgaagagagttcgcctgagccagatcccaggcaggtttcactgaagaaacttcttagagattcattgcacttctgagatttaatgtttacaacttggagttgtcgaccttcttataagatacattttggaagtcaaaatgaaagttttctgtgaagttttagaagagttatacaagaaggtacttcttggagccacacttgaaaatgacagccatgattacatcttttatctcaacccagcagtttcagatcaagattgttctacagccacctccttagaatgggcaaacacctgtggtatccagggcaggcatcagcccatctctgttggtgtggctcccattgctgtagcacctgtgtgtttgaagaccaactctcagatgagcggttccagagaagtaatgctccttcagttaacagtgatcaaagtgatgacaacccggatattgtctgtcaaaaccgagttccatgcaaaggagcagtacagagatgtaattaaaattctcttagaatcagccaaagtc

SEQ ID NO: 4724 - DNA, 562 bp, Homo sapiens
gttaatctggaactgccatagcttcaggtttcactgaagaaacttcttagagattcattgcacttctgagatttaatgtttacaacttggagttgtcgaccttcttataagatacattttggaagtcaaaatgaaagttttctgtgaagttttagaagagttatacaagaaggtacttcttggagccacacttgaaaatgacagccatgattacatcttttatctcaacccagcagtttcagatcaagattgttctacagccacctccttagaatgggcaaacacctgtggtatccagggcaggcatcagcccatctctgttggtgtggctcccattgctgtagcacctgtgtgtttgaagaccaactctcagatgagcggttccagagaagtaatgctccttcagttaacagtgatcaaagtgatgacaacccggatattgtctgtcaaaaccgagttccatgcaaaggagcagtacagagatgtaattaaaattctcttagaatcagccaaagtcgattctaaattaatctgcatgttccaaaattcagataaattgtta

SEQ ID NO: 4725 - DNA, 1612 bp, Homo sapiens
gtgttccctcaaatggcggtgtgaagagagttcgcctgagccagatcccaggtttcactgaagaaacttcttagagattcattgcacttctgagatttaatgtttacaacttggagttgtcgaccttcttataagatacattttggaagtcaaaatgaaagttttctgtgaagttttagaagagttatacaagaaggtacttcttggagccacacttgaaaatgacagccatgattacatcttttatctcaacccagcagtttcagatcaagattgttctacagccacctccttagaatgggcaaacacctgtggtatccagggcaggcatcagcccatctctgttggtgtggctcccattgctgtagcacctgtgtgtttgaagaccaactctcagatgagcggttccagagaagtaatgctccttcagttaacagtgatcaaagtgatgacaacccggatattgtctgtcaaaaccgagttccatgcaaaggagcagtacagagatgtaattaaaattctcttagaatcagccaaagtcgattctaaattaatctgcatgttccaaaattcagataaattgttatctcacatggctgcacagtgccttgcattgcttctatatttccaattgagagaaaagataaccttaagtaattcctggattgctttttgccagaaaaatctttctgaatactctgagagtaataaagcaatatactgcctctggactcttacagcaataataaaagaaatctttaaagattcatgttcacagaaaacagaaattctaaagcagttcctgactcatttcgacaccatttttgaagtgttttacaattccttattctctcagcattttgaaaactgccgggatacttctaaaatagtaaacatcctgatgtgtttcctggatttgcttgagcttctcatcgcctccagaatccacctgaagttacatttcacttgccagaggattttatttttgaaaccatcttgcatgctagaagttattacctggcctattcaggcttttgttaaaaggaaggtcatcatattcctcaaaaagtgccttctctgtaaagtgggtgaagacctctgtcgtggatctgtgcctgccttaatgccgccagaccatcatgtagcggtggacatgctggctttagctaatgctgttttgcaagctgtgaattcggggttgttgaagacactgtctgtttatgaaaaacattccttttttggaggtgatgaagttcaacctgaatgtgaacttatcactagtccagatcatgtgatccttagagcagcaagcttagttataatgaaatccttagaaatcaagtttcaaaattattcttcagcaagtgaagtgaaaggtaattctccaaactccttttgtatgcagtgtgtaattatttacttaagtacagtaattcataattatcaaatctcaggactagtttaaattccagtaatttaagctgtatgttatcctatttgtaacttattacattttcaaaaaaaaaaaaaagaactggatttacctttaagaaacatgtcagctttttgtgcctacaatgaatttgtaaagcataaggaatgatttaggttt

SEQ ID NO: 4726 - DNA, 2360 bp, Homo sapiens
attatcttgctccctgtctattggagtgtatctctcttcctctctgtgtgactttttgtgtttatgtgtgtgtttagtgtgtgtccatattttcctgttctcttgtgtctctctgctgtgtctctctctttttctttctgttttttgagacggagtctccctctgtcacccaggctggagtgcagtggtgcgatctcggctcactgcaacctctgcttctgaggttcaaacgattctcctgcctcagcctcccgagtagctggaattacagacacatgccaccatgcccagctaattttgtatttttaatagagacggggtttcaccatgttggccaggctggtcttaaactcttgaccttacgtgatccacccgcctcggcctcccaaagtttttggattacaggtgtgagccacctcgcccggtcctatctctctttcttctctttctccctctcactttgtttctcttctctctctctctcccgcctccttcccccgtctcccctcccttccccccaccgccctcttcatagctgagcctgtccggcagtgcggcggatgtacggatgattcagtggctggcaggaagcccgccctgcccgcccgccagtgtcagtggtgttggcatcagcttgggcaggtgtgcgggctcaggatggggcggccgtggtgaggaaccctggactctcagcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaaggaagcagacacgggtcggaggaagcctacatagaccccattgccatggagtattacaactgggggcggttctcgaagcccccagaagatgatgatgccaattcctacgagaatgtgctcatttgcaagcagaaaaccacagagacaggtgcccagcaggagggcataggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaaggtcatggggcaactccagagagaagcatcccctggcccggtgggaagcccagacgaggaggacggggaaccggattacgtgaatggggaggtggcagccacagaagcctagggcagaccaagaagaaaggagccaaggcaaagagggaccactgtgctcatggacccatcgctgccttccaaggaccatttcccagagctactcaacttttaagcccctgccatggttgctcctggaaggagaaccagccaccctgaggaccacctggccatgcgtgcacagcctgggaaaagacagttactcacgggagctgcaggcccgtcaccaagccctctcccgacccaggctttgtggggcaggcacctggtaccaagggtaacccggctcctggtatggacggatgcgcaggatttaggataagctgtcacccagtccccataacaaaaccactgtccaacactggtatctgtgttcttttgtgctatgaatttggattcctaattgctattgttggttgctggggttttaaatgattgataagcttgtacagttaacttatagagggggagccatatttaacattctggatttcagagtagagatttctgtgttgtctcctagaaagcattacatgtagtttatttcagcatccttgttgggtggggccctggctctcttcccctttggtgggacctcccctttctttgggcttcagttcactcaggaagaaatgaggctgtcgccatctttatgtgcttccagtggaaatgtcacttgctacagacaatagtgcatgagagtctagagaagtagtgaccagaacagggcagagtaggtcccctccatggccctgaatcctcctctgctccagggctggcctctgcagagctgattaaacagtgttgtgactgtctcatgggaagagctggggcccagagggaccttgagtcagaaatgttgccagaaaaagtatctcctccaaccaaaacatctcaataaaaccattttagttgaaaa

SEQ ID NO: 4727 - DNA, 1869 bp, Homo sapiens
agtgtcagtggtgttggcatcagcttgggcaggtgtgcgggctcaggatggggcggccgtggtgaggaaccctggactctcagagatggaatttcaccgtgttgcctaggctggtctggagctcttgatctcaagcgatcctccctgcctcggcctcccaacgtgctgggattataggcgtgagccaccgctcctggccaggcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaaggaagcagacacgggtcggaggaagcctacatagaccccattgccatggagtattacaactgggggcggttctcgaagcccccagaagatgatgatgccaattcctacgagaatgtgctcatttgcaagcagaaaaccacagagacaggtgcccagcaggagggcataggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaaggtcatggggcaactccagagagaagcatcccctggcccggtgggaagcccagacgaggaggacggggaaccggattacgtgaatggggaggtggcagccacagaagcctagggcagaccaagaagaaaggagccaaggcaaagagggaccactgtgctcatggacccatcgctgccttccaaggaccatttcccagagctactcaacttttaagcccctgccatggttgctcctggaaggagaaccagccaccctgaggaccacctggccatgcgtgcacagcctgggaaaagacagttactcacgggagctgcaggcccgtcaccaagccctctcccgacccaggctttgtggggcaggcacctggtaccaagggtaacccggctcctggtatggacggatgcgcaggatttaggataagctgtcacccagtccccataacaaaaccactgtccaacactggtatctgtgttcttttgtgctatgaatttggattcctaattgctattgttggttgctggggttttaaatgattgataagcttgtacagttaacttatagagggggagccatatttaacattctggatttcagagtagagatttctgtgttgtctcctagaaagcattacatgtagtttatttcagcatccttgttgggtggggccctggctctcttcccctttggtgggacctcccctttctttgggcttcagttcactcaggaagaaatgaggctgtcgccatctttatgtgcttccagtggaaatgtcacttgctacagacaatagtgcatgagagtctagagaagtagtgaccagaacagggcagagtaggtcccctccatggccctgaatcctcctctgctccagggctggcctctgcagagctgattaaacagtgttgtgactgtctcatgggaagagctggggcccagagggaccttgagtcagaaatgttgccagaaaaagtatctcctccaaccaaaacatctcaataaaaccattttagttgaaaa

SEQ ID NO: 4728 - DNA, 2527 bp, Homo sapiens
ggagtgtatctctcttcctctctgtgtgactttttgtgtttatgtgtgtgtttagtgtgtgtccatattttcctgttctcttgtgtctctctgctgtgtctctctctttttctttctgttttttgagacggagtctccctctgtcacccaggctggagtgcagtggtgcgatctcggctcactgcaacctctgcttctgaggttcaaacgattctcctgcctcagcctcccgagtagctggaattacagacacatgccaccatgcccagctaattttgtatttttaatagagacggggtttcaccatgttggccaggctggtcttaaactcttgaccttacgtgatccacccgcctcggcctcccaaagtttttggattacaggtgtgagccacctcgcccggtcctatctctctttcttctctttctccctctcactttgtttctcttctctctctctctcccgcctccttcccccgtctcccctcccttccccccaccgccctcttcatagctgagcctgtccggcagtgcggcggatgtacggatgattcagtggctggcaggaagcccgccctgcccgcccgccagtgtcagtggtgttggcatcagcttgggcaggtgtgcgggctcaggatggggcggccgtggtgaggaaccctggactctcagagatggaatttcaccgtgttgcctaggctggtctggagctcttgatctcaagcgatcctccctgcctcggcctcccaacgtgctgggattataggcgtgagccaccgctcctggccagggtctgttcctagttgcaacagttcttggaaacccactcgagagggccacgcctccattcaccaggccacgcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaaggaagcagacacgggtcggaggaagcctacatagaccccattgccatggagtattacaactgggggcggttctcgaagcccccagaagatgatgatgccaattcctacgagaatgtgctcatttgcaagcagaaaaccacagagacaggtgcccagcaggagggcataggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaaggtcatggggcaactccagagagaagcatcccctggcccggtgggaagcccagacgaggaggacggggaaccggattacgtgaatggggaggtggcagccacagaagcctagggcagaccaagaagaaaggagccaaggcaaagagggaccactgtgctcatggacccatcgctgccttccaaggaccatttcccagagctactcaacttttaagcccctgccatggttgctcctggaaggagaaccagccaccctgaggaccacctggccatgcgtgcacagcctgggaaaagacagttactcacgggagctgcaggcccgtcaccaagccctctcccgacccaggctttgtggggcaggcacctggtaccaagggtaacccggctcctggtatggacggatgcgcaggatttaggataagctgtcacccagtccccataacaaaaccactgtccaacactggtatctgtgttcttttgtgctatgaatttggattcctaattgctattgttggttgctggggttttaaatgattgataagcttgtacagttaacttatagagggggagccatatttaacattctggatttcagagtagagatttctgtgttgtctcctagaaagcattacatgtagtttatttcagcatccttgttgggtggggccctggctctcttcccctttggtgggacctcccctttctttgggcttcagttcactcaggaagaaatgaggctgtcgccatctttatgtgcttccagtggaaatgtcacttgctacagacaatagtgcatgagagtctagagaagtagtgaccagaacagggcagagtaggtcccctccatggccctgaatcctcctctgctccagggctggcctctgcagagctgattaaacagtgttgtgactgtctcatgggaagagctggggcccagagggaccttgagtcagaaatgttgccagaaaaagtatctcctccaaccaaaacatctcaataaaaccattttagttgaaaa

SEQ ID NO: 4729 - DNA, 1839 bp, Homo sapiens
aggcccaggtccccatccaggccaactttgatgccagccaggtgtgcccagccctgtttcctcctcatctccaatgagtcctcccggctttggtgctgcaccccgggtccctgtccacaccctctttgatccaggctcagcagggctaggggcaggggaaacccccacctcacccgctccgtctgactggagtaggggttggctggggaagactgcagcctccatcctaccttttcagttgcatcccccaacaatccccagggcccaaaatagggacaagttggttgcctgtgcctcactgtcccccacccaccccacaaagacctgtgaccttgccacagccccacccatccagccgtaccccctgggtgccagctgcagacaggccggtgctgggctggtgggggccagttgctcatgtactgaggcccccctccctcagttctgcatcggggtcgagatgtgtacagcagcccctgccgtggccaggaagcagctgtgtcggggcagaatgtggtgggctcaggcccagggcacaggggcggcctcccagccttccctgcacttgccctgcagttccagggcacctggtacatggtcggggtggtgtcagatgaccaggacttcctggactccaaggacaccatgaagatggctgtggtcttagtgacccccttggggaatggtgacctggccctcaagtttggataccccacgccccatggcgggtgccagaaaatggacacgaccttcaccgagggtgctgtaccggggcagttcagcaacccagccatggccctgagtgacatccgagtggccttctccgactaccagcactttgccttgctgtacttggagatgcggaaagggggcctgcggaaccagtggctgcagctctacggtgggcgggctgcggggcggagacccagacacccccgcttcgggtctgggatgtcacccctgtgcctgcaccagccctttctgcacgcggaaggtggaaccgctggctcctggtgtctgtggccgcgggtcccggcccctccctgcccctctctccctctcttcgcccctccagccccttccctttagcttacccgccctccccaccttcagctcgagcgcccgagctgtttcccgaaggcgcccagaagatgcagctactggcgccccaagtgggcctgagccccagccagggcgtcctgctgccgaagtcgggtgagcggtgccggcagccctgctgggagggccaggccccgggtcacacccctgctggaagggccaggccctggtcactccactgatctcagattcgggacagaagtgcccggggcagacccagcctgtctgggtcgggggagggcgagacgttgcccaggccggtgttcccaggaggagatcgccttggggcaggtcgggggcctccgtcccagggaagggggcgcggggtggcgcctcaggctcgatctctctgcagaccagtgtgcgggcgcgctctcccgggtgagtagaccatggccatgcggagccgcggaccatgggccctcccagctcggtgggctgcaccgcggggccctctaccttcggggcagctagggacgacagcgggggtgatggggcacccgggcggatccgagccgcagcagcctggggaaccgcggggctgcgcgtcgggagggggcggaggcaggggacgccgcccacctgctccttgttttgcagtgaggggtccagcccctgagtgcccgcaggggtcagctgctccgtgcgcccagccctgcccaaagagccccctccctccacaccctggccccaagcgcaataaacaccctgaatgcctgt

SEQ ID NO: 4730 - DNA, 1018 bp, Homo sapiens
cggggccccgcggacgcaacggtgggcacgatgcggcaacccgccgttcggttggtgcgcctgggtcgggtgccgtacgccgagctactggggctgcaggaccgctggctgcggcggctgcaggccgagccaggcattgaggccccgtcggggactgaggcgggcgcgctcctgctctgcgagcccgcggggcccgtgtatacggccgggctgcgcggcggcctgacgcccgaggaaactgcgcggctacgggccttgggcgccgaggtgcgcgtcacaggccgcggtggcctggccaccttccacggcccgggccagctgctttgccacccggtactcgacctgcggcgtctcggcctgcgcttgcgcatgcacgtagcgtcgctggaggcgtgcgccgtgcgcctgtgcgagctccagggcctgcaggacgcccgcgcgcggcccccgccctacactggcgtctggctagacgatcgcaagatctgcgcgatcggagtccgctgtggaaggcacatcacatcccacggcctggctctcaactgctctaccgacctcacgtggtttgagcacatcgtgccctgtggactggttgggacaggcgtcacttccttgagtaaggagctccagaggcacgtcaccgtggaagaagtaatgccacctttccttgtggcctttaaggagatctacaagtgcacactgatctcagaggacagccccaactgaagagtactcataacagccaggatgctcctgccttgggaagcatgaagtctgacttgagtcacctactgaaacccagattttagacctggcctgtcattcactgatcatgaaactaaggacataccatgagctctgagccactattttcatatgtatcctgttttatttatatcttccccacctacctcagagatactagatgtgacaatactgtgaaaagcaacacatgctatataaaacattagcactgctattgacagcagtgtctcagagaaattcagatgtcatagat

SEQ ID NO: 4731 - DNA, 4023 bp, Homo sapiens
agcgagcttccccagctagcctgtaggtgggtgtgtttaacagaagaaagcaatgggaacccgcctgtcagccagcctttcgagctaattagctcagcatacaacaaagataagtgagcctgggaagagggccccctgaggggtctttagattctgggaaatgtctgattggcagatgttaaaagggattccttggtaatccagtgcatcaatgagctgcagaaattcagcccaggactgcaagaattcaggcatgaggacactctgtacaggaggctcacacaggcagacccaagatggacagaaccttggaatctctgagacacatcattgcccaagtcttgcctcacagagatccggctctagtcttcaaagacttgaacgttgtgtcaatgttacaggaattttgggaaagcaagcagcagcagaaggctgcattcccaagtgaaggtgtggtggtctatgagtcactgccagctcctgggcctccctttgtgagttacgtgaccctcccagggggaagctgttttggcaactttcagtgctgcttaagtagagccgaggccaggcgggatgcagctaaagtggccctgatcaactccctcttcaatgagctgccctctcgcaggatcaccaaggaattcattatggaaagtgttcaggaagcagtagcctccaccagcggcaccttagatgatgcagatgaccccagcaccagtgttggggcctatcactacatgctggagtcaaacatggggaagactatgctggagtttcaggagctgatgaccattttccaactattgcactggaatggaagcctaaaagcccttcgtgaaacaaagtgttcccgacaggaagtcatctcctactattctcagtattctctagatgaaaagatgcgcagccacatggccctggactggatcatgaaggagcgggactcaccaggaattgtctctcaagagctacgaatggccctgaggcagttggaggaagccaggaaagcaggacaagaactacggttttacaaagaaaagaaagaaatattgagcttagccctgactcagatctgcagtgaccctgacacttcctcacccagtgatgatcagctgagccttacggccctgtgtggctatcactagcaaggccaagccccgggtaccctcagtgatggcagaggccagattaacattaggaatctcagtgcagaggtcctcagaggctccagcatctctagtactacctgaaggctctcctaaccctctccacacattccatttacagagtatgagagtcgtaggacccttacaagacccaacaagccactcgatgcatttttctatcacattctcaatagttccagctcaggatgaaaggatagacacaaaattgtttgaaaaacattttccaggcctggctccaacctaaagcctgactgtcacgtgccttgcttgattttatatatattgtttcaagaatagtccaatatagcattccccaaatgaacagcagccagaattaggtgaagtagcatgatagcagtgtttaaaaatacttaggattaaataaataatatggattgttttaaaaaatatccaaggatcagagtctctttctaagctttgtaagctaagcaatagtttatgtcctactagatacactgcaaactacagtggggattttatctggacatcccaccatcaaagatcttgaaatagtaatagtatgaaaatactagataaaattaatgtttaaaatgtttttgtaacaataatttttaaaacccacactcttccatatatggggataaatatcacctagaaaagtagcctcactcttattcctcaagaattaatatccaatgtttatgagtcttgcaatcaattttgttcatttttaatttgcaaatcgataacctgaactaatttgttcttattttttgccactgcaaacatatatctacagagagaaaaattaatggcattttaaaggttaaaacattttgaaaaattattagcatgtaacaaagaatgcttgcatttgattagtttcaccagcatttgagagaaggaccctttagctctgtttgttgttcaagaacataagcaaccagtagctcaaatgtagtatcattattaagtttaagtcactggaatcttctttaaaggaaggataagacattgccatctctatttaactcatccatatgggtcaatcaactgattagaaaatcaaaaaacaataaaaactttttttttttttttttttttagtagagacgggatttcatcatgttgcccaggctggtcttgaactcctgggctcaagccatctgcctgcctccacctcccaaaatgctgagattacaggtgtgagccaccatgcctggcctaaactaatttttagatagttcctggtcactcaaatttaagaatgtcagcaatgtcaattttaaatgctcataggtctttccatatctgtaacatgaaaatgattattctgcattttattcagtagtccaaattaaagaaaatgtttttctcaatttaaaataatttctttttcttttgtttatgcaagtgcatacatgcttcactgaaagcaaaaccattataattacattaaagtttataaaatatgatattttaacctcatatctaataagtatgtacaaaggtaaccatcactccttaaatccacatgaaaactactgtaactgatcatgtattttggaattagacttgataataaaagattatcatgtatcacatatctcacaccaggggaacaattagctacataattgtcataccttaatatcttttaaaggtaacagtaattttcaacacattttattttaaaatattattttaacaaaagttacattcctctccacaatgaggctaaatgtcacccacgaaagaactttattcccttatattcctgaaaagaaatcagaattaacatttttatgttgaataaattttaaaatttaggaaatgttctatttaaagttaatttctttcataaagccattactctttacattgtcatttccaaaaagccacaatttcccatgctggatgtgatgaaagttaggcacacctttactgcattagcagcctttgacaatgacttcctcaaactgacaccatcttaattagatgcagggacagggatcagatgggacaatatcaaatttactttgtgccctacaagttaaaaactgcacccattctgtaaattgaatatagaggttctcccttggccactgtcagcttttcttgactggccaaaactgcccattcttcctggaatggtatgaaagcttcagcaaaataaataaaagtcagaatctttgctggtccctttaatgctgatttgatagtaaatcaatttcagctgagacataagggctgtcagtctatcatataaacatctttaactatagcctagagaaaagagggttgaagagcaaagcagattttttttttccttttctatatcttgttctgaacaacacactgtgataaaggggactagagtggaagattccctatttaaacacatgaagctctgggtcctagccttttttggttataagccctttgagaatctgataaaagctgtggatcatctcctaggaaaatagaacaaaacatacatattcacattacacagttccagagtatgtggaccccccaaagtccagagattgccctaggggatctttagattcttgtttagaactgttgattttgaacacaacatacactgtcaaactttacatcagggatccaacataactcagacatagcccaggtagcctgtttctaacacaactgtcataatcctgaaatccaaaattgcactgtgtttgacatgagatagtttaagttccacaaaatccaaatttaccatattattgtttttaaaaaagcagtttagagcaaactgtcactaaacttggataaatgggtcagaaagtacagatttaataaagtcgtacctctaatgttca

SEQ ID NO: 4732 - DNA, 3979 bp, Homo sapiens
gctgactggggtggttgggaccgttagctcggcaggctggcaggctccggggcgctactccattggcggccgggatggagactatgcgagcgcagcggctgcagcctggtgtgggcaccagcgggaggggcactctccgagcgctgcggcccggagtgactggggccgcggctgccaccgccacaccccctgcgggccccccgcctgccccgccgcctcccgcaccgcccccgccgccgctgctcctgtctggggccccaggactacccctgccccccggcgccgccggcagcccggcagtgctgcgagaggccgtggaggccgtggtgaggagcttcgccaagcacacgcagggctatggccgagtgaatgtggtggaggcacttcaggaattctggcagatgaagcagtcccgtggtgctgacttaaagaatggggctctagtggtttatgagatggttccctccaacagccctccttatgtctgctatgtcaccctgcctgggggaagctgctttgggagtttccagttttgccccacaaaagctgaggcccggaggagtgctgcaaagattgcgctaatgaattctgtgtttaatgaacatccttcccgaagaatcactgatgagttcatcgagaagagtgtctctgaggccctggcatcttttaatggcaacagggaggaagctgacaacccaaatacagggattggtgccttccgattcatgctggaatccaacaagggcaaatcaatgttggagttccaggagctaatgacagtttttcaactgctacactggaatggcagccttaaggccatgagggaacgacaatgctctcggcaggaggtgttggctcattattcgcaccgggccctggatgatgatattcgccaccaaatggccttggactgggtgagccgggagcagagtgtgccgggggcactgtctagagagctggcctctactgagcgggagctggatgaagcccgactggcaggcaaggagctgcgcttccacaaggagaagaaagatattcttgtgctggctgctgggcagttgggcaatatgcattcttccaactgctaggcatccacccacataactccccaggctttccacagcctttttttatgtctcctttctaagatttaggatgattttttgtacatactttctcatttttatactttaaaaaatatatatgtgtataaattctacacctagattcctatttgctaagagatcccttttcttactaccagtttttggatgtagttttatttgaaacatcttcagtccactttacaacaaagagcagcttgtctttgcagctttgttagctcttaaacttccagattaactgtgtagccatttcagtagcactaaaagattaactctagtgttcatgtgtccttcttttcaaatatcaggtaacttgaataaggattatgtgccccacccttactctcattcctgcttcctcttggactcaaacagggtatgagtatgaagattttgcctttagttcctgaactgaacctgcttgctatccctttcctccccaccactaccttattccttctctgcctccaaattgccactttgttttgaggcttccttccctaccttattattctgaaggaagtagagatcttgcttctgaaacccctcctaagaaactgcccagggacaagataaattacaaacaattcatgggagtttactacctaagttgcttctagggcatatgtataccatactagtagtctagatttctggatatactctacagtagatgggggttatggttgaaactgattctctttcagtattccctctaaacatctcccctactcccccagcttagttaaaccctgcgtttggaccttcctgcctgcagctattagtagaaagtaaaacatatttccatatttcccttcacctaacattttattttttggaagcgttatcagtcctatttggttagtgagaaccatgttccccttattcccgctaagttgctgctgtttactaccttagattctcatttgttttctctttctttcctctccttccacattaattattagaacataagttgatcaggaaaattaaatgagactttagtattttggcacttcctaattgacaccttgggagactgcaggaagggaaagagaatcaatgatcagttatttgtgtgtgtgtgtggtttttttttttttttggaagacagagtctcacacttttgcccaggctggagtgcagtggcgtgatctcggctcactgcaacctctgcctccagggttcaagcgattctcttgcctcagcttcccgagtagctgggattacaggcacacgccacaacgcctggctaatttttatatttttagtagagacagggtttcaccatgttggccaggctgttcttgaactcctgacataaggtaatccacccgcctcagcctcccaaagtgctgggattacaggcgtgaggcactgagcctggcctatttgtggtttttttttggttttgtttttgtttttgtttttgagacggagtcttgctctgtcgcccaggctagagtgcagtggcgcgatctcggctcactgcaacctccgcctcccagattcacaccattctcctgcctcagcctcccgagtagctgggattacaggtgcccaccaccacgcccagctaattttttgtatttttagtagagacggggtttcaccatgttagccaggacggtctccatctcctgacctcgtgatccacctgcctcggcctcccaaactatttgtgtgtttttctttttttttttttttgagacggagtctcgctctgtcgcccaggctggagtgcagtggcgctatctcggctcactgcaagctccgcctcccgggttcacgccactctcctgcctcagcctccttagtagctgggactacaggcgcccgccaccatgcctggctaatttttttgtatttttagtagagacggggtttcaccgtgtttgacaggatggtctcgatttcctgacttcgtgatccgcccgcctcggcctcccaaagtgctgggattacaggcgtgagccaccgcgcccggcactatttgtgtttttaacaccattctcccccacttctctcctgggtgacataagagagaaataacctgtagtacagcagctaaagtattctcctttcagagaatttttttggaggtctcatatatatttcccccttgtctctgtgatctcttatttatactatattattgtcccatgtactttctaaactgagcttggaacatttagtattcctgcaattggacttcccacttaacaattatacagactttgcttttagaaatagattaggttccaaacagaaagttcaagtgtaacaacaacaataaaaatagattatgaaacaggctataattggctcttttggatttgataggggcaagatgaaaggcaactttcttgcttttgaaatcatgttgggtaagaggtaaggaatccagctacaattttattagtgcttgaaacgggcttccttgaattctccaggccctatcattttttttttcttactaatcagaagagagctggggtagaagccccatgtttgtattccatgaaacacgtcgggttggagtaaaggcaaaaacagctagacacaccaggtgtgtctgtttgacatttataagctggcactcatcaacactcctgtttctcctttctctgggacgtgtggattaaggggtgtgagttgtgggaagaattgccctcgtacctcctggatttattatttttctcaaataccaaccagtaagatcccaaataacttgagaaaaattgtttcctgatctgtccacttctggtgtcaaagattttactcatcttcttagtacattctatgtattttatatgtataattttatacaattaaaaatagatttttgtctagtg

SEQ ID NO: 4733 - DNA, 3746 bp, Homo sapiens
atggagactatgcgagcgcagcggctgcagcctggtgtgggcaccagcgggaggggcactctccgagcgctgcggcccggagtgactggggccgcggctgccaccgccacacacacgcagggctatggccgagtgaatgtggtggaggcacttcaggaattctggcagatgaagcagtcccgtggtgctgacttaaagaatggggctctagtggtttatgagatggttccctccaacagccctccttatgtctgctatgtcaccctgcctgggggaagctgctttgggagtttccagttttgccccacaaaagctgaggcccggaggagtgctgcaaagattgcgctaatgaattctgtgtttaatgaacatccttcccgaagaatcactgatgagttcatcgagaagagtgtctctgaggccctggcatcttttaatggcaacagggaggaagctgacaacccaaatacagggattggtgccttccgattcatgctggaatccaacaagggcaaatcaatgttggagttccaggagctaatgacagtttttcaactgctacactggaatggcagccttaaggccatgagggaacgacaatgctctcggcaggaggtgttggctcattattcgcaccgggccctggatgatgatattcgccaccaaatggccttggactgggtgagccgggagcagagtgtgccgggggcactgtctagagagctggcctctactgagcgggagctggatgaagcccgactggcaggcaaggagctgcgcttccacaaggagaagaaagatattcttgtgctggctgctgggcagttgggcaatatgcattcttccaactgctaggcatccacccacataactccccaggctttccacagcctttttttatgtctcctttctaagatttaggatgattttttgtacatactttctcatttttatactttaaaaaatatatatgtgtataaattctacacctagattcctatttgctaagagatcccttttcttactaccagtttttggatgtagttttatttgaaacatcttcagtccactttacaacaaagagcagcttgtctttgcagctttgttagctcttaaacttccagattaactgtgtagccatttcagtagcactaaaagattaactctagtgttcatgtgtccttcttttcaaatatcaggtaacttgaataaggattatgtgccccacccttactctcattcctgcttcctcttggactcaaacagggtatgagtatgaagattttgcctttagttcctgaactgaacctgcttgctatccctttcctccccaccactaccttattccttctctgcctccaaattgccactttgttttgaggcttccttccctaccttattattctgaaggaagtagagatcttgcttctgaaacccctcctaagaaactgcccagggacaagataaattacaaacaattcatgggagtttactacctaagttgcttctagggcatatgtataccatactagtagtctagatttctggatatactctacagtagatgggggttatggttgaaactgattctctttcagtattccctctaaacatctcccctactcccccagcttagttaaaccctgcgtttggaccttcctgcctgcagctattagtagaaagtaaaacatatttccatatttcccttcacctaacattttattttttggaagcgttatcagtcctatttggttagtgagaaccatgttccccttattcccgctaagttgctgctgtttactaccttagattctcatttgttttctctttctttcctctccttccacattaattattagaacataagttgatcaggaaaattaaatgagactttagtattttggcacttcctaattgacaccttgggagactgcaggaagggaaagagaatcaatgatcagttatttgtgtgtgtgtgtggtttttttttttttttggaagacagagtctcacacttttgcccaggctggagtgcagtggcgtgatctcggctcactgcaacctctgcctccagggttcaagcgattctcttgcctcagcttcccgagtagctgggattacaggcacacgccacaacgcctggctaatttttatatttttagtagagacagggtttcaccatgttggccaggctgttcttgaactcctgacataaggtaatccacccgcctcagcctcccaaagtgctgggattacaggcgtgaggcactgagcctggcctatttgtggtttttttttggttttgtttttgtttttgtttttgagacggagtcttgctctgtcgcccaggctagagtgcagtggcgcgatctcggctcactgcaacctccgcctcccagattcacaccattctcctgcctcagcctcccgagtagctgggattacaggtgcccaccaccacgcccagctaattttttgtatttttagtagagacggggtttcaccatgttagccaggacggtctccatctcctgacctcgtgatccacctgcctcggcctcccaaactatttgtgtgtttttctttttttttttttttgagacggagtctcgctctgtcgcccaggctggagtgcagtggcgctatctcggctcactgcaagctccgcctcccgggttcacgccactctcctgcctcagcctccttagtagctgggactacaggcgcccgccaccatgcctggctaatttttttgtatttttagtagagacggggtttcaccgtgtttgacaggatggtctcgatttcctgacttcgtgatccgcccgcctcggcctcccaaagtgctgggattacaggcgtgagccaccgcgcccggcactatttgtgtttttaacaccattctcccccacttctctcctgggtgacataagagagaaataacctgtagtacagcagctaaagtattctcctttcagagaatttttttggaggtctcatatatatttcccccttgtctctgtgatctcttatttatactatattattgtcccatgtactttctaaactgagcttggaacatttagtattcctgcaattggacttcccacttaacaattatacagactttgcttttagaaatagattaggttccaaacagaaagttcaagtgtaacaacaacaataaaaatagattatgaaacaggctataattggctcttttggatttgataggggcaagatgaaaggcaactttcttgcttttgaaatcatgttgggtaagaggtaaggaatccagctacaattttattagtgcttgaaacgggcttccttgaattctccaggccctatcattttttttttcttactaatcagaagagagctggggtagaagccccatgtttgtattccatgaaacacgtcgggttggagtaaaggcaaaaacagctagacacaccaggtgtgtctgtttgacatttataagctggcactcatcaacactcctgtttctcctttctctgggacgtgtggattaaggggtgtgagttgtgggaagaattgccctcgtacctcctggatttattatttttctcaaataccaaccagtaagatcccaaataacttgagaaaaattgtttcctgatctgtccacttctggtgtcaaagattttactcatcttcttagtacattctatgtattttatatgtataattttatacaattaaaaatagatttttgtctagtg

SEQ ID NO: 4734 - DNA, 1239 bp, Homo sapiens
ggaagacggaagtgcaaagacttccggtcggcgtgagcgtgaggtgtgggtgttcgtttctcaggtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggacagtacccaatatggatgaaccaaaggcaaagaaaaaggctgaaggcaaagcgagagaaaagaaaggggaaaagcaaagcaaaagcagtgaaagtggcaaagggtttggcctggtagactcttaaaaccttggaaaatgccacatgggatagatgacggattagaatgtatacacatgtatactttgatttcaactgccaccaaatgaaaaccatttgttttcctattttaacttggccttttttcttcaattcaaacccagcataactcctcaagtttgttttgggaacttgaataaaatattttctttgatacatccaagctctactgatactttaactggatgctacccaatatccagttataatcaggcctcaacgttctgtcaggtattaatatggttagaattgttcttacaactggtaattatagtcaatagagataaaacagatgatgtactgacaaatttttgtgaacttagattttaaagaaagttgttgtataatcatatcatttaaaaatactacattagggctgggcatggtggctcacacctgtaatcccagcactttgggaggccgaggcaggtggatcacgaggtcagttcgagactagcctggctaatacagtgaaaccccatctctactaaaaatacaaaattagccgggcatgggggcgcgcacctgtagttccagctactcgggaggctgaggcaggataattgcttgaacccaggagatggaggttgcagtgagccaagattgccccactgcactccaccctgggcaatggagtaggactctgtctcaaaaaaaaaaaaaataatggatcttataaagtacttgtgtggagctttgattccacagaataaaagatattttgtgtgtagatcttc

SEQ ID NO: 4735 - DNA, 1177 bp, Homo sapiens
gagttcggttcctcaccggtccagtgacacatgggacttggggcttgattccgccacccttggagaatttcgtttcttgacactcgctgggctatacttgagctccagtccggagatgcaggccttgttgagggcgagggttccccttgctctttttggtgggggccctccggcttccgagtgcactggataaagtggagcccacccctgtcgttcactcccgctgaagttaacttcggccctcaaggtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggacagtacccaatatggatgaaccaaaggcaaagaaaaaggctgaaggcaaagcgagagaaaagaaaggggaaaagcaaagcaaaagcagtgaaagtggcaaagggtttggcctggtagactcttaaaaccttggaaaatgccacatgggatagatgacggattagaatgtatacacatgtatactttgatttcaactgccaccaaatgaaaaccatttgttttcctattttaacttggccttttttcttcaattcaaacccagcataactcctcaagtttgttttgggaacttgaataaaatattttctttgatacatccaagctctactgatactttaactggatgctacccaatatccagttataatcaggcctcaacgttctgtcaggtattaatatggttagaattgttcttacaactggtaattatagtcaatagagataaaacagatgatgtactgacaaatttttgtgaacttagattttaaagaaagttgttgtataatcatatcatttaaaaatactacattagggctgggcatggtggctcacacctgtaatcccagcactttgggaggccgaggcaggtggatcacgaggtcagttcgagactagcctggctaatacagtgaaaccccatctctactaaa

SEQ ID NO: 4736 - DNA, 414 bp, Homo sapiens
atgtcacagttccagggcaaaggaccaagatggacagttttgattatgagcaaggtgggtctcagaggtggtctcagcgatcagatggcaatgaaagttctagatccattgagacaagctctagacagtagcatgcagtccaacaacttgtgccagcatccccagcctctggcacttcatgtttctgctgctgtggcctccgcgggtgcacaagctagcagtttacttggccctctgcctcacctttcttcttttgcgtttcagcctgcgcattcacttctttctctgcttggctctcatggtgcagaagtttccaagaagatggcgctgctggcccgggagcgttcgccggcccacctggtggctttccctggacgtttaacggcgactccgcccggcctcccgactttttga

SEQ ID NO: 4737 - DNA, 1125 bp, Homo sapiens
cggaagcccagagtgaacagaaagagaagtcgcttgagctcacaaaagaagttccaggatacggctatactgacaaactcatcttggcattaattgtgactgaaatactaatgattttgattatacttttctgcctcattgtgatgtgttgtcaccgaaggtcattacaagaagatgaagaaggattctcaaggggcattttcaggtttctgccacggaggagatgctcttcacgaagggagagtcagacggccgctctggcttaaagatatgtacaaacctctcagtgccacaagagtaaataatcacgcatggaagctgcacaagaagtcatctaatgaggacgagatcctcaacagggaccctgggtaaatgacggagccctcacaggtcccatctaaaatgaggagggggcctcactttgttgcccaggctgcttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggcccggcgcctggggatgggaggcaggactgcaccttcacagggacgcttccaccctaccccggaggttagggcctctcgcccagctctggctctgaggtcctggagggagggagatgctgttgcgactcagaagattgggggagggccacccccattcgagaagagtgaaaatcctgagcctgaagaagtggaaccggttggagccgaggctttaagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactgacttaggacatgagagctcaataagctccttatttaacgcactgttgtatcaggtccctgtgggagccactggttctttagcctaataaaggagcgggtgcacgc

SEQ ID NO: 4738 - DNA, 2051 bp, Homo sapiens
gacagcccccagtgcgaaaggctgccagcatgtcatcagtgagccccatccagatccccagtcgcctcccgctgctgctcacccacgagggcgtcctgctgcccggctccaccatgcgcaccagcgtggactcggcccgcaacctgcagctggtgcggagccgccttctgaagggcacgtcgctgcaaagcaccatcctgggcgtcatccccaacacgcctgaccccgccagcgacgcgcaggacctgccgccgctgcacaggattggcacagctgcactggccgttcaggttgtgggcagtaactggcccaagccccactacactctgttgattacaggcctatgccgtttccagattgtacaggtcttaaaagagaagccatatcccattgctgaagtggagcagttggaccgacttgaggagtttcccaacacctgtaaaatgagggaggagctaggagaactatcagagcagttttacaaatatgcagtacaaattttagatgctgtgagcctagaggagcggttcaagatgactataccactgcttgtcagacaaattgaaggcctgaaattgcttcaaaaaaccagaaaacccaagcaagatgatgataagagggttatagcaatacgccctattaggagaattacacatatctcaggtactttagaagatgaagatgaagatgaagataatgatgacattgtcatgctagagaaaaaaatacgaacatctagtatgccagagcaggcccataaagtctgtgtcaaagagataaagagactcaaaaaaatgcctcagtcaatgccagaatatgctctgactagaaattatttggaacttatggtagaacttccttggaacaaaagtacaactgaccgcctggacattagggcagcccggattcttctggataatgaccattacgccatggaaaaattgaagaaaagagtactggaatacttggctgtcagacagctcaaaaataacctgaagggcccaatcctatgctttgttggccctcctggagttggtaaaacaagtgtgggaagatcagtggccaagactctaggtcgagagttccacaggattgcacttggaggagtatgtgatcagtctgacattcgaggacacaggcgcacctatgttggcagcatgcctggtcgcatcatcaacggcttgaagactgtgggagtgaacaacccagtgttcctattagatgaggttgacaaactgggaaaaagtctacagggtgatccagcagcagctctgcttgaggtgttggatcctgaacaaaaccataacttcacagatcattatctaaatgtggcctttgacctttctcaagttctttttatagctactgccaacaccactgctaccattccagctgccttgttggacagaatggagatcattcaggttccaggttatacacaggaggagaagatagagattgcccataggcacttgatccccaagcagctggaacaacatgggctgactccacagcagattcagataccccaggtcaccactcttgacatcatcaccaggtataccagagaggcaggggttcgttctctggatagaaaacttggggccatttgccgagctgtggccgtgaaggtggcagaaggacagcataaggaagccaagttggaccgttctgatgtgactgagagagaaggttgcagagaacacatcttagaagatgaaaaacctgaatctatcagtgacactactgacttggctctaccacctgaaatgccgattttgattgatttccatgctctgaaagacatccttgggcccccgatgtatgaaatggagatagcatcttagaatggaagatgtggtgtgtcacatgcgtgcgtgcggagagaccaccaaacaggctttgtgtgagcaacaaggctgttatttcacctgggtacaggtatctcagcgtttgagtcagccaggagtagcaataggtttggcttggactcccttaggtggagaaatcatgttcgtggaggcgagtcgaatggatggcgagggccagtt

SEQ ID NO: 4739 - DNA, 2580 bp, Homo sapiens
ggggcagctgtctgtctggctctttttgacagcccccagtgcgaaaggctgccagcatgtcatcagtgagccccatccagatccccagtcgcctcccgctgctgctcacccacgagggcgtcctgctgcccggctccaccatgcgcaccagcgtggactcggcccgcaacctgcagctggtgcggagccgccttctgaagggcacgtcgctgcaaagcaccatcctgggcgtcatccccaacacgcctgaccccgccagcgacgcgcaggacctgccgccgctgcacaggattggcacagctgcactggccgttcaggttgtgggcagtaactggcccaagccccactacactctgttgattacaggcctatgccgtttccagattgtacaggtcttaaaagagaagccatatcccattgctgaagtggagcagttggaccgacttgaggagtttcccaacacctgtaaaatgagggaggagctaggagaactatcagagcagttttacaaatatgcagtacaaattttagatgctgtgagcctagaggagcggttcaagatgactataccactgcttgtcagacaaattgaaggcctgaaattgcttcaaaaaaccagaaaacccaagcaagatgatgataagagggttatagcaatacgccctattaggagaattacacatatctcaggtactttagaagatgaagatgaagatgaagataatgatgacattgtcatgctagagaaaaaaatacgaacatctagtatgccagagcaggcccataaagtctgtgtcaaagagataaagagactcaaaaaaatgcctcagtcaatgccagaatatgctctgactagaaattatttggaacttatggtagaacttccttggaacaaaagtacaactgaccgcctggacattagggcagcccggattcttctggataatgaccattacgccatggaaaaattgaagaaaagagtactggaatacttggctgtcagacagctcaaaaataacctgaagggcccaatcctatgctttgttggccctcctggagttggtaaaacaagtgtgggaagatcagtggccaagactctaggtcgagagttccacaggattgcacttggaggagtatgtgatcagtctgacattcgaggacacaggcgcacctatgttggcagcatgcctggtcgcatcatcaacggcttgaagactgtgggagtgaacaacccagtgttcctattagatgaggttgacaaactgggaaaaagtctacagggtgatccagcagcagctctgcttgaggtgttggatcctgaacaaaaccataacttcacagatcattatctaaatgtggcctttgacctttctcaagttctttttatagctactgccaacaccactgctaccattccagctgccttgttggacagaatggagatcattcaggttccaggttatacacaggaggagaagatagagattgcccataggcacttgatccccaagcagctggaacaacatgggctgactccacagcagattcagataccccaggtcaccactcttgacatcatcaccaggtataccagagaggcaggggttcgttctctggatagaaaacttggggccatttgccgagctgtggccgtgaaggtggcagaaggacagcataaggaagccaagttggaccgttctgatgtgactgagagagaaggttgcagagaacacatcttagaagatgaaaaacctgaatctatcagtgacactactgacttggctctaccacctgaaatgccgattttgattgatttccatgctctgaaagacatccttgggcccccgatgtatgaaatggaggtatctcagcgtttgagtcagccaggagtagcaataggtttggcttggactcccttaggtggagaaatcatgttcgtggaggcgagtcgaatggatggcgagggccagttaactctgaccggccagctcggggacgtgatgaaggagtccgcccacctcgctatcagctggctccgcagcaacgcaaagaagtaccagctgaccaatgcttttggaagttttgatcttcttgacaacacagacatccatctgcacttcccagctggagctgtcacaaaagatggaccatctgctggagttaccatagtaacctgtctcgcctcactttttagtgggcggctggtacgttcagatgtagccatgactggagaaattacactgagaggtcttgttcttccagtgggtggaattaaagacaaagtgctggcggcacacagagcgggactgaagcaagtcattattcctcggagaaatgaaaaagaccttgagggaatcccaggcaacgtacgacaggatttaagttttgtcacagcaagctgcctggatgaggttcttaatgcagcttttgatggtggctttactgtcaagaccagacctggtctgttaaatagcaaactgtaggtccaaatctcaattttttagaattttaagttatgaagtgctcaaaggtactgacacagttgattttattcacaccattaggggtatgcaagatgtc

SEQ ID NO: 4740 - DNA, 3718 bp, Homo sapiens
gtctgaggtttggtgactgcggggcaggccgggggcagctgtctgtctggctctttttgacagcccccagtgcgaaaggctgccagcatgtcatcagtgagccccatccagatccccagtcgcctcccgctgctgctcacccacgagggcgtcctgctgcccggctccaccatgcgcaccagcgtggactcggcccgcaacctgcagccgctgcacaggattggcacagctgcactggccgttcaggttgtgggcagtaactggcccaagccccactacactctgttgattacaggcctatgccgtttccagattgtacaggtcttaaaagagaagccatatcccattgctgaagtggagcagttggaccgacttgaggagtttcccaacacctgtaaaatgagggaggagctaggagaactatcagagcagttttacaaatatgcagtacaaattttagatgctgtgagcctagaggagcggttcaagatgactataccactgcttgtcagacaaattgaaggcctgaaattgcttcaaaaaaccagaaaacccaagcaagatgatgataagagggttatagcaatacgccctattaggagaattacacatatctcaggtactttagaagatgaagatgaagatgaagataatgatgacattgtcatgctagagaaaaaaatacgaacatctagtatgccagagcaggcccataaagtctgtgtcaaagagataaagagactcaaaaaaatgcctcagtcaatgccagaatatgctctgactagaaattatttggaacttatggtagaacttccttggaacaaaagtacaactgaccgcctggacattagggcagcccggattcttctggataatgaccattacgccatggaaaaattgaagaaaagagtactggaatacttggctgtcagacagctcaaaaataacctgaagggcccaatcctatgctttgttggccctcctggagttggtaaaacaagtgtgggaagatcagtggccaagactctaggtcgagagttccacaggattgcacttggaggagtatgtgatcagtctgacattcgaggacacaggcgcacctatgttggcagcatgcctggtcgcatcatcaacggcttgaagactgtgggagtgaacaacccagtgttcctattagatgaggttgacaaactgggaaaaagtctacagggtgatccagcagcagctctgcttgaggtgttggatcctgaacaaaaccataacttcacagatcattatctaaatgtggcctttgacctttctcaagttctttttatagctactgccaacaccactgctaccattccagctgccttgttggacagaatggagatcattcaggttccaggttatacacaggaggagaagatagagattgcccataggcacttgatccccaagcagctggaacaacatgggctgactccacagcagattcagataccccaggtcaccactcttgacatcatcaccaggtataccagagaggcaggggttcgttctctggatagaaaacttggggccatttgccgagctgtggccgtgaaggtggcagaaggacagcataaggaagccaagttggaccgttctgatgtgactgagagagaaggttgcagagaacacatcttagaagatgaaaaacctgaatctatcagtgacactactgacttggctctaccacctgaaatgccgattttgattgatttccatgctctgaaagacatccttgggcccccgatgtatgaaatggaggtatctcagcgtttgagtcagccaggagtagcaataggtttggcttggactcccttaggtggagaaatcatgttcgtggaggcgagtcgaatggatggcgagggccagttaactctgaccggccagctcggggacgtgatgaaggagtccgcccacctcgctatcagctggctccgcagcaacgcaaagaagtaccagctgaccaatgcttttggaagttttgatcttcttgacaacacagacatccatctgcacttcccagctggagctgtcacaaaagatggaccatctgctggagttaccatagtaacctgtctcgcctcactttttagtgggcggctggtacgttcagatgtagccatgactggagaaattacactgagaggtcttgttcttccagtgggtggaattaaagacaaagtgctggcggcacacagagcgggactgaagcaagtcattattcctcggagaaatgaaaaagaccttgagggaatcccaggcaacgtacgacaggatttaagttttgtcacagcaagctgcctggatgaggttcttaatgcagcttttgatggtggctttactgtcaagaccagacctggtctgttaaatagcaaactgtaggtccaaatctcaattttttagaattttaagttatgaagtgctcaaaggtactgacacagttgattttattcacaccattaggggtatgcaagatgtccctgttttataaacataatcacaacagtaataaacctcaagtagtggctagtgtttagtatagaaatataagatgttgatttagtaaactgataaaaatcgaattcttgtctttttagtgggatccttactgtccctggaaagatatagcatagtggttctcagcacagtctccagaacagaagcatctgtagtacctggtaacttgttagaaatgtacattctcaggctccacagcaggccgcctgaatcaaatcctgggaggtggggacagaaatctgtgttttaagaagccttccaggtaattctgctgcacactcaagttcaggaaccaccggtatagaccattaccttagtggatttacctgtagagtttattggatcctgaaaccaatcaattacttagaactaggcaaagatgaaagtatagccaactattcttggctatatatatatattcaagtgggccgggcgtgatggctcacacctgtaattccagcactttgggaggtcgaggtaggcagatcaccgagcccaagagttcaagacaatcctggccaacggcgaaactctgtctctacaaaaaatatacaggcgtgttagcatgtgcctgtaatcccagcttcttgggaagctgaggcacaagaattgcctgaacccaggaggtggaggttgcagtgagctgggatcgcgccattgcactccagcctggctgacagagcgagactgtctctaaaaaaaaaagactcaagtggaccctacaatgaagcctacacatcccaatagaagccccttcttatgctgagggaagcagccctcagaacatgatagcttgtatccagcagagtggcacgtgctggcacacctcacagaagcaccctggccctggatgcctgcaacctcagaagagtgcagctcccagagggaggcagccatccatctgggatggtcctaagcatggaatcctaactcctgattccgtctcctatttcttgcttggctacgccagttcccaaatctggtagatgtccatgcccatgtgctcctgctgggactcaattcaggctatgtatgactatgaagtcaggctcatctgcttactggctgtgtgaactttttgtatcttggttttcttcatccatgaaatccaagtaatactacctaattgttactgtggagattaagttcaaatgcaatgtatagtaatatt

SEQ ID NO: 4741 - DNA, 3594 bp, Homo sapiens
gcggagccgcgcgcccgggaggctccgggaccgtggcggcgggcggcggcggcgcagccctccgcgggccatgtcctctccggcggtggcgaggacctccccaggagggagtcgggagatggccccagcgccgcagggccgaggccggttctgggaagtgggcggcggcagcggccatcggctggagcgcgcggccgcggagtcggagcgctgggagctgctgctccgccgcggggagctgctggcgctgggcggccacctgaagggcgcgctggaggcgttcgcggcggcgctgcgccgcggggccccggccaggcccgagtgcctgggcgccctggtggactgcctggtgttcaactaccggctccgccacgggctgggctggagcgcggccccggttgcaggcgctgacggcggcgccggcgggctcctcagatgcctgggctgccggggcttcctgagcgagccggtgaccgtgccctgtggccacagctactgccgccgctgcctgcggagggaactccgcgcccgctgccgcctctgccgggaccggctgccgcccgccaccgccagtgccactgatgctgaagggaccgccccgcggccgccgcctctggccgccgccatcgccgcttcagacttcagaaccagcgtcgtcctcaaccacctggccgagaagtggtttccgggccagcgcgagcgggcccgggcggccggcaggctcggggagctactgcaccaggggcgctaccgggaggccctggccgccgcctgcgaggcgctgcgagcagaacccagtgacttgattgtaaaaatttacagagcggaatcatatgctggtctccaagagtttaaagcagccatagaagatttaaatgcagttctttttcaacttccagattggcctgaggtctacttcaggaaaggaaaagtactctgcgatgctggttttttaggtgatgccttacaactctttcttcagtgcttagcccttgatgaagattttgcacctgcaaagctgcaagtacaaaagattttatgtgatttattattacctgaaaacttaaaagaaggcctgaaggaatcttcctggagttcattaccatgtactaaaaacagaccttttgattttcattcagtgatggaagagtctcagtctctcaatgaacctagcccaaagcagagtgaagaaataccagaggtcacttcagagcctgtcaaaggaagcttaaaccgtgctcagtcagcacagtctataaattcaacagaaatgcctgccagagaggactgtttaaaaagagtgtcctcagaacctgttctgtcagttcaagaaaaaggtgttctgctgaaaagaaagttgtctcttttagaacaggatgtgattgtaaatgaagatggaagaaataagctgaaaaaacaaggagaaactcccaatgaagtctgtatgttttccttagcttatggtgatattccagaagaattaatcgatgtctcagatttcgagtgttctctctgcatgaggttgttttttgagccagtaacaaccccttgcggacattcgttctgtaagaattgtcttgagcgttgtttagatcatgcaccatattgtcctctttgcaaagaaagcttaaaagagtatctagcagataggaggtactgtgtcacacagctgttggaagaattaatagtgaagtatctgcctgatgaactgtctgagagaaaaaaaatatatgatgaagaaactgctgaactctcacacttgaccaagaatgttccaatatttgtttgcactatggcctaccccactgtgccttgccctctccatgtatttgagccaagatacagattgatgattcgaagaagtatacagactggaaccaaacagtttggcatgtgtgtcagtgatacacaaaatagttttgcagattatggttgtatgttacaaattagaaacgtgcatttcttaccggacggaaggtctgtggttgatacagttggaggaaagcggtttagggttttaaaaagaggaatgaaagatggatattgcactgccgacattgaatatctggaagatgttaaggttgagaatgaagatgagattaagaatctcagagagcttcatgatttggtttactctcaagcctgcagctggtttcagaatttaagagacagatttcgaagccaaattcttcagcatttcggatcaatgcccgagagggaggaaaaccttcaggcagcccctaatggacctgcatggtgttggtggcttcttgcagttctccctgtagacccacgataccagctgtcggttttgtcaatgaagtctttgaaagaacggttgaccaagatacagcatatactgacctatttttctagagaccaatctaagtaactaactctttggatctccctttaaagtgaccctaatctggctgcattgatggccagattgtctgctgcctttgcacatctagtgctggtttcagaaatttaatgaaacttttctttttccttcgacctcctgaatcatgtggttctgcaaatgaataccttcaactaggatttagaccactaagaacttgcacagaaaaacacgcattgaatgtgtgtcgaacctctacattgtgaagttgcactatgtaccatactctaaaatgaaataagaactctttatgtctgtgagagagtgtgtgtgtgtgtgtgcgtgcgtgtgtgcttgtgggggttgggtagtgtgtgtgtattttctctggctttaaaattttaaaacaaacaaacaaaaaagccatagagagcagaacttgccgagggtcatttattgcccaagtttacaagagtagcgatacaagtttttgcaaattgaatttgcctcagatatatctgtcctaatgcttatatttgcacaagtatgtaaaatatcgtgttgaggatcattctttgttggaaacactgctcttgctgaactgtcttgaccattgactatgacacagtttcttatttatgtaaatacttgcatcacagtggccgacaggcattggatgcagaacctagagccagttttcaggaacaattgtaaacctgacatggtactgtgcatctattcataaaacactcaaaactgtgaaaatatggtttacatttaattgtacataaaggtaaagggagaactcaattcagtaccagttagtttgtacattttagggggcttttcacattaactgcccatttgtgtaatttatagtttgacatgatgtgtttgttttaaaaaaaaatgcatagtataaacccattaaggatctgggaaaagagaagaagtttaatatagaactaagcttttaaagtttgtttttgtttttaattctggtctcggtgcaaatgttagttatgccttattcatatcacagttagatcaccatgctgcaacatggtttatattcatgctgccctagaaacttttgtaattatttgttgcaaatttgtgactgtccttattaactttcttttatgtaagtaatttgtaaaagtttcttaaaatttttgcttttgcttatttaattttgaataaaagctaaattcctaatactttttcttaaa

SEQ ID NO: 4742 - DNA, 13912 bp, Homo sapiens
cctccccagtcatttaggacaatttcctaagtcgaagctagagatgcgtgatgcgtttggtgacttttcctgggttcttgcttaagcggagccacaggttgtgggggcggccaggcctctggggaagagcaggtgccgcggtgccggcgcgccagcagcccgcggccaaggccacctgctcccagggccccggcacctctgcggggaggcggcaggcagaggacgcgcgcgcagtcgcgcaggagccctcaggcgagtgggggaagcatcgcaagagacgcggacctggagcgcggtcactgcgttaccgcagcgacctgggttacctaagccggcgggactgagaggccgctgcgcgtgggcaggggctcagattgcgcccgcggtgcctgtcccggcccccaccccggaacgattgcagccctgcggggctcgccgcccacaccgcgctgaggacgctgcccaagccaggcgcccgcccccgcccgcggtctcagccgctcgcagcgcgccgcccccagacgcgcgtggctgctggcgagggctgagaccgcgctcccgccggccagttcccagcagcagcgcatcctccctgctccgcgccttcgctccggacccgcgtcgtcgcagccccgcggtgatgagccccgagccggtcccgccgccgccgccgccccagtgtcctggctgcgaccgcgcggagccgatcgcccagcgcttagaggagggcgacgaggccttccgcgcgggcgactacgagatggcagccgagctctttcgctccatgctagccgggctggcgcagccggaccgcggcctgtgcctgaggctgggggacgcgctggcccgcgccggccgcctccccgaagccctgggcgcgttccgcggcgccgcgcggctcggggcgctgcggccggaggagctggaagagctggcgggcggcctggtgcgcgccgtgggcctgcgcgaccggccgctgtccgcggagaacccgggcggcgagcccgaggcgcccggcgagggagggccggccccggagccccgcgcgccccgcgacctgctcggctgcccgcgctgccggcggctgctgcataagccggtgacgctgccctgcgggctcacagtctgcaagcgctgcgtggagccagggcccgcgcggccgcaggtgcggcgcgtgaacgtggtgctgagcggcctgctggagaagtgcttcccggccgagtgccggctgcgcaggctggcaggccaggcgcggagcctgcagcgccagcagcagccggaggccgcgctgctcaggtgcgaccaggccctggagctggctcctgatgataattcattattgctgctgcgggcggagttatatttgaccatgaagaactatgagcaagctctccaagatgccagtgcagcttgtcagaatgaacctctcttgattaagggacatcaagtaaaagctcaggctctttctggattgggaagaagtaaggaagtgttaaaggaatttctctactgccttgctctgaatcctgaatgtaactctgtgaagaaagaagcacagaaggtaatgtgtgaagtgctgttttcagctacagcaaatgtgcatgaaaatttaacatcttccatccaaagcagattaaaggctcagggtcacagccacatgaatgcccaggctctgctggaagaaggtgatgcagggagctcggagaattcatctgagaaatctgatatgcttggaaataccaattcttcagttttgtattttatactgggtctacactttgaagaggataaaaaggcgttagaaagcatccttccaacagcacccagcgctggcttaaagagacagtttccggatgacgtggaggatgcacctgacctgaacgcccctggaaaaattcccaagaaagatctctcacttcaaaggagcccaaactctgagacagaagaaagtcaggggctctcgcttgatgtaactgactttgagtgtgccctctgcatgagattgctctttgaacctgtcactacgccctgtggacacacattttgcctaaaatgccttgagcgctgccttgaccacgccccacactgtcctttgtgcaaagacaaactttcggaattattggcaagcagaaactttaacataactgttctggccgaagaattaatatttcgatatttgccggatgaattgtctgataggaagagaatttatgatgaagaaatgtcagaactgtcaaatctgaccagagacgtccccatctttgtgtgtgccatggccttccccacggtcccatgtccactccacgtttttgagccccgctatcggcttatgataagaagatgcatggaaactggcaccaagcggtttggcatgtgtttatctgctgagcacgcggggctttcagagtatggatgcatgctggagattaaggacgtgagaacgtttcctgatggaagttctgttgtagacgcgattggcatcagtcggttccgagtgctaagccaccgccacagagatggctataacacagcggacattgaatatcttgaagatgaaaaggtggagggtccagagtatgaagaacttgccgctctccacgattctgtgcatcaacagtctgtttcctggttcgcgtctctccaggatcgcatgaaagaacaaattttaagtcattttggggtaatgccagacagagaacctgagcctcagagtaatcccagcggccctgcctggtcctggtggatcctggccgtgctgcccctggagcgcaaggctcagctggccatcctcggcatgacctcgctcaaagagcggctccttgccatccgacggatattagtcatcatcacgcgtaagatgaatagtcggcaagagctggctaatgccagggagagaaataattgatttttctctctgtcaaggtttctggcagcccttgtgcttttataaatgtcaggcatggacgaatagccgtccattcattgtgcttcatcaagtgcttgtggatgaggttccaaaatgggacgcttgccaaacattgagtcctcctcaaaaatgacaattctgtgtctggtgggatctgaccttgtgtgaggttagcctgaagtctgaatggagcccatagttggaaaacaacctaagaaaatctcttagaagcaggtgcttggggaatgcagttcactgacagcacaggaccctgcagatggtttacatgtggtttgggtttcacgagaaagaaggattcacttcccagtcagcatctggctctgccagatggtaaaggcgtgctttagtgtgtagacaatatgggggaaccacgtttttatctggaagtggatttcttagaacacaggctaaccaaaactacgcttaggctttgcgtgttgctgtgaagttgtctgtgaaatcgaataatcacaccattgttcagtgcaggagcccaaactagtccttacccaagaagtagtagcctctggatagaactgtgtttaatgtcctgttgtagtcccaggtgttgtaaattgcatgttgtaatcaaacgaatgtcaaaacataagaaagtataccttggatatagaaaaacctgagaacagtatcattcacttgaggatatatatatatatatttacacacaataaagtgagttaaaattgtatatgcattgggatgtcaaacataaaaccaccaagtgcaaagaatgctttgaaagtagaaccttgtctcattgatcagtggttactaagcatttaggaaacagtcatctttttctattgggatttgcattagaaattagccccatcagtaaatttcagtttactatccatttattaatatacaaaaacattaaaaaatctgccatgccatggtaatctatctattccaggaaaatagatcagaatatatgaagggaggatggccggtatgggatgtaaatattcagtaagtttttctccaacaccaacctaaaattatctttatttttttgaaagaaagttttacggtgatcagaccaggtgttatctgttaaaggacagtagtatgacttccatcctgtaatgcacgttggtgatattgattggaataactgaatctgagatactcatatgttctctctggcccaaccagctggtgcatttggttggcttcctcgtctgtaaggtggacattcttaaccagagggtcacgaccacatcacagctgcaagttttgctttgttcattgaaggtgattttttagttttaaaatatatatatctcataatatacaatgttgatggtatatcaatccatcaagcattttattagaaagactttataatattattaatttttctttagttttcagtagataaagtagtttcagtagataaagactttataatattattaatttttcttttagttttcagtctcatcatgggagttagaaaataccagcatcacttaattgtaaagagaaaatgtgaaagtattttccaatccaatgtttcaagtgcctcacttattgtgaatctcaaatatcatcttgagatggtttaatggcagtttggccaagtgatttctaagagattttattaatttatgcattaacaatagtattcaactttcttaggcattataacctaacccgatcatttgattggaataactgaatcattcattgattggaataaaataaagaaaacaaaatgcatctcacatgccagaagacctttaccagaagtggttcatgaaaatcagtatgcattgaccattctctgcctttcccttttggaaaatttttttgtaccttcatatcacagctgaatagttatcaatgccatttccatttggaagtatctaaataaccacaatgtgatcacagcttctccacgagccttcctgaagtaaagctggtatgcttgctataatacttggaacctgttgctttctcttcctcactctttaaatgtcataaggtcacacagttcttggaatcagaactattcagttatttcttcatgattctgcctggctttctgagtcttctccttcggcatgttatgtaaaagtctgaacaacaatgatgacgcagacgagagcaacatacgtttttattttttgataggtttttatttttttgataccagagggaattaactatgatcacatcgtgctctctctgttcagcatcacacgcccacatactgcagtgtgggagtagattggtacttactgagcacttagaaacatcacgcatcaggaaccgggtcagggtgacagcatcctacggtcatatcatgaaggaagcctcccttacaaacctaaaaaaaaaaaaccccagcttcagtttgctaccaattaagctaaagcagaacggtctgcttcctcctccgcctgcccccttctgcctcttttctgttggggagatgccaattctaaggatttctcagaaaataatgtaatctctcattcaatgtcaggacattccagcttaattgtactgaaagtgctccaataggcatgctctcgttacattggaatcaaagcagaaaagagtaatagcagcgtgggggagtcatttttcttcttgaggaacaatacatgctgttctgtatttttccattcatcgcccaaacctgcctgtgtctttgaaatgcaagtaagatcccaaaggcagctttctgaaagcccgtggcatttttagcttatcccatcccccgtgtgtgtcctcatcttcagaattgaaagttaggatactttttaaagtttcaaaagaaaataatttaaaatgttaaggtttatccatagaaacacaataattcttaaccaattcatgtaccaaattcaacagtattatctcatttttagggtcacaaatgtgtcctttttgcacttaaacctcctccctctctcaaaaacaaaaacaaacaaacaaacaaaaaacacaccaagactgtttaacaaattgtatctcaactcttaatatatgttaagtcttaccacaggacatttgaatcatcaaggaacagttgaagtttatggatggtagaataacaatgaactatgatattatcactttattataaactttttggaaaattggcagttgctaccatcgaaatactccattgcctgtgttacatagaatttgttataatttttaagggctttaaaaaaatacccatctgtttcttctccttcttgttttcttttgtgccccaccacttaaattacttgggtaaataccactcttcaaaatttgaatactgtctatcaaataagaagaagtgtgaaagatatgaagaagaaaggtgatagcaaattagaagaaaataaatgtgggtgatttcttttagttgaaagcacagagttttatttttccccagtataactattgagtagggtagggaggtccctgtatccccatttttattttttttgagatggggtctcactctgtcacccaggctggagtgcaatggcgcaatctcgtctcaccacaacctccgcctcctgggttcaagtgattctcttgccttggccccctgagtagctgggattacaggcacgcgccaccacacccagctaatttttgtattttttttttttagtagagatggggtttcaccatgttggtcaggctggtctcgaactcctgaccccatgatctgcccgcctcggcctcccacagtgctgggattacaggcgtgagccaccgtgcccggcccatctccccatgttttagcatagacagcagcggcattcagtggaaggagttcttccccttcaacatcgtccttcccaaaggccacattctgattctattgttcaccaaaaactaattcccagggaagcccgctctggatgggaaggatgagctgcgtgagccatcgcccacacagggagataaccgaacccctttgccagcatcaccccctctctactggggtgagacacttcattcagagcactggctctgactcccaggggaaagtctttttccctttacaactcctcacctcagcctcaccttgactttcacttctcaactgctgaattctataaaatagccttttagcagtgactcagcttttaggtgagcacagataatgaagaaattgaagtgccaccattgcactcccccaagttggggacataaactcgaatttgcacccaggtctgataaaagtaactgattgaggacgcagaaaggtggatgccattgacagcgttgactgttctcacaattcctacagaaatgaaagaaggagaggcccagcagaccacaccgggccatgaggggaagcatgggagacaggcagaagcaggagtgaggaggaacgtggctcagaccctctactgtatgttctgcaggaaagggcagggaaatagctaagactggctggtctgaataacagctcagactctaggctatacaggtggtctctagccatctggcacctagccccgggtcgttagggtgggggatattgcttcctaggttgtaagagccagatagaggaggatgggctctggattggtcactttgctcccagggtagccctttgctgtatctaagaattggctcaccctgggatgggcagtttctcctgggtcagcgaggcccctgagatgtcaaaatatcataaaatatagaaatcatgattaatacaattggtcctctgctgttttgacatactaaggtcacttttgatagcagaaacttttaaagagtagggcatacgttgccctgaagagcatagaaaacattttattctgagagtagaaaggaggaagacacgtggagatacaggagtcccttaggctggcccatagctgagtctctcatgtgtgtggcattagtcaagaatgtagttctgcagtttgcggggggggggtctctaacatttcttggtgcagttgttaacatgtgttaaacatatgagtctgatgatgatatcgcggtgtttctcggctcggggtggcaggtctggcggttgtgtggctgggggtgtgcactgatagttcagtaaaggataagtagagactcgtggtgttcatgtgtcaccacagggagggagtggctgtggagacccaggacaggaagtcgcggtggaaagcaggctggggtggtaggagaaggcaccgggggtgggtgctcctcccccaggggttgaggagttgactgatagggggcagttacctcctgggaaagcaagacgctcccttaagttttagaatggtacagagagtagtcccttctaccagagtttccatttagacatgggagtgtagggggccatgtttcggcagaagcagggcatgtatcagcattagtggactcctcagtattaaaaggaagaacagcaaacatgtcatgtgcccactttgtgcctcaggagaggtagcccgtggacatcgctagggcagaggttttaatatctgggacaaagttatctcccacggcgaggtcgtggctgggaccatgtcatcttcagccgtgagctgctgggctgggcaatgtcttctgggatgtgagacgtggggtctcctttctaagcggacccccactcgtgctgatgtgggtcccagcatttgccgcgtttggttgaaacagtggcttacctggagggtctgggtctctggatcataaaccagcgaaagcccccacatcagtggtgacaagatcaatagaccccagaatgtgtgcagctgtgcttgatagggttttggttcttgctttttggtggaagtttaggctcaagtgggtcccgtatcggatgagcagctgcacggcctgtgggagccctggggttagtgggtccaggagagaatgtgttctctctctgggctccagccctgatggggtggggataagatgcaagatttataggaatagggggaaacattatggaaggccccaatatgtaatgagcttttatatacaagaatgcaagacatagccctctttttatgtttaaaggggactatggtaatgttttttaaagtttgtgtgaggtgtgagtcaaccgaaaggccctaaattaagagagattcaggtttgtggtgcaagatagaggcccatttcggggtctgtttgcagaccagaatttgaaatggagttgtttgaggagaccattgtgtgtcttcgtgaaaccgattgtgtggaacctatcagggctgtggaagttgtagcgaatgccttttcccagagcccagcattgtggattccgagaagtggcatgtgtgtctcagtgacttccagtgatgcctgccactctgaagagatgaaggagtgtcctggcaagacctggaatcccagctgtagcacctgtggagagatgtgatttagatttggatttggggtatctgtgaggaagagtcccagagtttttcatcctgaagggggcaactcttgggcagtggtccaacagttggccataaatgtgaagctggggcgctgtgctgaccagggcatccagcgttaagacgactgcctaactttggccacatgcgttgttttttgggttccgtttcgtatcagggcatgctggctaaaagatgggaagcagcaacattctcttgggctccatcatttatatgagggttggcaatgccatctgtaccctctgtgaactcccactgctgttcactcagttaatctaagggacaccaaggggtctgcgggaggatgacctcacaagggactgaggacatgggagaccaccctcctgtgggtagaatacaccagagggcccaggcttgactctgtcctgtgttaaggaggcatcggtagttttgctgagcttgtcaggtgtttataatggacagttggagattggggtcctaggcttaggtctttgagagcctctgtgtccaggagagcccagtaggcatccagccatttactgctttaatagggtagcatgaggctgagagggatagtttcttgcatccaaagcccttaggcaccttatgtccatcctaagtgggccagagactccagggctgcatagagcttgccagagcttctataatgaaggggtctctgagggcaccaacaggagtgcccatggattttaaggtttgattatagaggttgtttatggagggtgccccatttaaagcaagctgatttgtaagcagcagcaagaagattaagtaaaatttgtaaatgaggactacattgccatcagaacctcgaaagtatctaaagatgttggacttgtatgtccttaatgagtgtgacaatgagtttcctcatttgtgctcctggagaaggcggatgtggtgaagaccctgtctgcagacattgtgtgccatggcaaagccgtggagctccctgtgggtggcctgcaaaggtgtatgtgcccctcagggcagaaggcaaacggcagccaagaagctgtgcaagtagacacttaatgggacatgttagccaaatctgtaagagcaaaatattggccagttatttattgtgtagaattaataattttaataataatggaaattgggtaatggatgggactgcagcaataaggttgtagtaatccaccatgaggcacacttgtttttttccaggtttaaggataggaaagattgggctgttcaatggagaaacaagggtataatcacccctttattaattagtaagttttaatccttgaatacctcatattaactgttttaactggaggtccatggggcatcattttatcaagctagtttataactgccaaagactgactttaattttaatttattatttgttttattagagtgtctgtgttcaatatgggatattagggcgttgggtactatgaccacaggaaatttagacaggctacagttaaagtgaagcataccttacccatccaccccccattttatatttagttgcctttttaaaaagattataggggtacaatgtttagatttagtgggatctccaggtataactgtaatttgagccccagtgttaagactatgaagctttgtcaatgggtacattttagcaaatgttacaattaatttagaacctaagttatggagacacaaaagccaataggcacccttttatgttttggttaaatgtttcagtatatacatcttatttatttgtaatattagtatataatttgttgtatacatttttagtgtataagcgttggatttctaattggatcagattagggaccttccgtttagctgcatatgtacatatacatgtacaatttattatatatttgcgttaaaatagcctatctgcatgtgtatatatgtgtgtatgtgtatgtatatgcactcacacgcataaatacacagtctatttagttacctttaatgttttttcccttgtacctaggctttttctcgctttttcctttttttctgattttgtggcaatttagttggaaggaggcggtcccagcatgttgacaggcagggtgttcagagtgcccaggcacactggtggggggtggttacaggctcacgtagctcaggggcttctgcaggtctcaggggagtgggaacaaagtgtcccaccccttccccttttcctcaaacctcaagccactggtctctatggatagatcctttgcatcccaccggattgaggaatgagtcacaacagctgcaaggctcttaaagcaacatttaaaccttttggcggctgtcatttctgtgaggagggtgcctctcaccggccgcatggccggaggatccctgcagcgctttggagaccaacacccagatcctttgcccaggagtgcgattaattcctcactggatgctgggggagggcccctcaggtgagcagcccaccactgacttcagcgttgctggctcggttatcagactctcatccaacacaagctcacagggaaagccgttccttgctccttgtggagggagctaccgtcattgccctgagaccaccagccaagaaagtaggtatgtccaggtagggaattcagagggacccagtgcatccaattatacaattatacccagaaggtcctgtgtaggggactgcgattgacatcaccctagtctgcagcaccaaggactgaatgagctcagtcctcttataatttaggctggactgtcacagacactggcagacacagcatacgtggtgcagccaaagtgcaaacatgccagcagcggccatgctccccagggtgggggtccagttagtaagccacgcgcagccaagaggcgaggcatgccctgtgccacacacggactcaccctgctcactgtgcccgtggtatcgaaatgtacccacgtttaattcataaaggagaggctgctgtcattgaaagaaaagtttgttacttgcatttctggagaaaaggagcgcaccaggccacgcagggccacaggaggaggacgcaccagagtggtcaggaggcagaactaggcgagcagctttccactgtgtctccatggcaaaggcgaagatgggcgggggcagagtgtaggattggcaggtttgaatgtcttgggcagtagctacaggggtggtctccagctgcctggtgcctggccctgggtgatcagggtgaggggatactgccttctgcagtggaagagtcaaatcgaggagatggactctgagttggttagtgtgcaaaggtgcactcccaagggacccctttgctatctctaagaattggcctgccctgggaagggcagtctctccccagtcagtgaggtccccaagatgtgaaaacattatacattataaaaaagcatgattaatataagctcattctagcatttcaggttacagcttctagaagaggtttgtagtctcaaatgagtaggtttttcctctagagaggggcgggcctggaccttcaagcaccccttggtgtgtttaggagctcaggagcagaagcacctgcctgcagccctgcagctaaggaagttctctcagtcactcagagcagggaggggctgagagagtcatgtgaggctcccggggtactacgacagccctcgaggtgaaggattggccctgatcataatagagaaccctgaggaagtttactgtcatgagtctcggctggttggcgcatgtgacctttgaaggatgaagatggagtttgcaacatgagtatctctaaccttttgcttttcagggatcattttcaaaaattgcattggggccttcgttatttaccatagtattttcactttcatagttttgtcacctttttgtactgtgaacagttcaaccagtgaccgacttctctctcatgctgtttaccccacacacaatttcccactcaattctgaaaataagaacctgttaataggttggaaagctgtgtactctattcatatattgttctttcatgctagtggagagtggtgtcattagcatcttaattttagagttgtgaaatgattttaccaattaggaattgaatgtgtattttttttctgtttaataagaagagcaaatttgaataaataagctggtgtagataaacttaataatcatgctttttcttgtttggagataggtgatgtgttgtcatatcctgtgatacaggtcactcatctggccttctgtttctgaagtttaagtctggtttgaatatgtaataatactactcagcatttcttgttgcctaagtgagacgaaacttaaatgttatgatatttacttcatgtattcttgtactgttcatttcaattaattggtattgtatatctaatatgtgatatttgaactgaataaaacttacagtgttgtaaatgttctttaataaataatcacacctaagtaataggctagactgatgagaaattagatcaaatcagtgcctaggcctttgtgtttgtgtcgtagggatgtactaacacatcaccacagactgacggcttttcacaataaatcagttttcttcgctca

SEQ ID NO: 4743 - DNA, 2363 bp, Homo sapiens
agtggcagtctgtttttcttgctcctgatgataattcattattgctgctgcgggcggagttatatttgaccatgaagaactatgagcaagctctccaagatgccagtgcagcttgtcagaatgaacctctcttgattaagggacatcaagtaaaagctcaggctctttctggattgggaagaagtaaggaagtgttaaaggaatttctctactgccttgctctgaatcctgaatgtaactctgtgaagaaagaagcacagaaggtaatgtgtgaagtgctgttttcagctacagcaaatgtgcatgaaaatttaacatcttccatccaaagcagattaaaggctcagggtcacagccacatgaatgcccaggctctgctggaagaaggtgatgcagggagctcggagaattcatctgagaaatctgatatgcttggaaataccaattcttcagttttgtattttatactgggtctacactttgaagaggataaaaaggcgttagaaagcatccttccaacagcacccagcgctggcttaaagagacagtttccggatgacgtggaggatgcacctgacctgaacgcccctggaaaaattcccaagaaagatctctcacttcaaaggagcccaaactctgagacagaagaaagtcaggggctctcgcttgatgtaactgactttgagtgtgccctctgcatgagattgctctttgaacctgtcactacgccctgtggacacacattttgcctaaaatgccttgagcgctgccttgaccacgccccacactgtcctttgtgcaaagacaaactttcggaattattggcaagcagaaactttaacataactgttctggccgaagaattaatatttcgatatttgccggatgaattgtctgataggaagagaatttatgatgaagaaatgtcagaactgtcaaatctgaccagagacgtccccatctttgtgtgtgccatggccttccccacggtcccatgtccactccacgtttttgagccccgctatcggcttatgataagaagatgcatggaaactggcaccaagcggtttggcatgtgtttatctgctgagcacgcggggctttcagagtatggatgcatgctggagattaaggacgtgagaacgtttcctgatggaagttctgttgtagacgcgattggcatcagtcggttccgagtgctaagccaccgccacagagatggctataacacagcggacattgaatatcttgaagatgaaaaggtggagggtccagagtatgaagaacttgccgctctccacgattctgtgcatcaacagtctgtttcctggttcgcgtctctccaggatcgcatgaaagaacaaattttaagtcattttggggtaatgccagacagagaacctgagcctcagagtaatcccagcggccctgcctggtcctggtggatcctggccgtgctgcccctggagcgcaaggctcagctggccatcctcggcatgacctcgctcaaagagcggctccttgccatccgacggatattagtcatcatcacgcgtaagatgaatagtcggcaagagctggctaatgccagggagagaaataattgatttttctctctgtcaaggtttctggcagcccttgtgcttttataaatgtcaggcatggacgaatagccgtccattcattgtgcttcatcaagtgcttgtggatgaggttccaaaatgggacgcttgccaaacattgagtcctcctcaaaaatgacaattctgtgtctggtgggatctgaccttgtgtgaggttagcctgaagtctgaatggagcccatagttggaaaacaacctaagaaaatctcttagaagcaggtgcttggggaatgcagttcactgacagcacaggaccctgcagatggtttacatgtggtttgggtttcacgagaaagaaggattcacttcccagtcagcatctggctctgccagatggtaaaggcgtgctttagtgtgtagacaatatgggggaaccacgtttttatctggaagtggatttcttagaacacaggctaaccaaaactacgcttaggctttgcgtgttgctgtgaagttgtctgtgaaatcgaataatcacaccattgttcagtgcaggagcccaaactagtccttacccaagaagtagtagcctctggatagaactgtgtttaatgtcctgttgtagtcccaggtgttgtaaattgcatgttgtaatcaaacgaatgtcaaaacataagaaagtataccttggatatagaaaaacctgagaacagtatcattcacttgaggatatatatatatatatttacacacaataaagtgagttaaaattgtatatgc

SEQ ID NO: 4744 - DNA, 2985 bp, Homo sapiens
attaggcggcgcggggcggccggcatggagctcccggaggcgcggcagggtcaggagctcggtggcatggcggcggtggctgccccgatttcctccagctgccactccttgcttcgtgtccccggtccctagacgcctcgtctcctcccgtgtccctcttcccatggagtcagtacggatcgaacagatgctgagcttgcccgctgaggtcagcagcgacaacttggagtcggcggagcgaggggcatcagcggcccaagtagacatgggcccccacccaaaggtggctgcagagggccccgcacctctaccgacgcgggagccagagcaagagcagtctccggggacctcaacgccggagagcaaagtcctgctcacgcaggcagacgccttggcgtcccgggggcgaatccgtgaagccctcgaggtgtatagacagctctccgagcggcagcagctggtggctgagcagctggagcagctggtgcgctgcctggcggagaaagtcccgcaaggcgaggcgctggcgccggcgcccccggacgagggtagcactgcaagcggcaccgtggcggcggaagagacgggggccgccgcggctgcggcggccaccgaggtgtgggacggctttaagtgccggaaatgtcatgggtttctatcagaccccgtgtccttgtcgtgtggccacaccttttgtaaactgtgcctggaacgtgggcgggccgccgaccggcgctgtgcgctgtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttggctccaaatgaccacttgctttatagcaatcggtctcagatttatttcaccttggagtctcatgagaatgcactgcatgatgcagaaatagcatgtaagctccgcccgatgggttttaaggacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaagatcctcccactgatcagggggacaaacctgctctcagtttaccacttgcatctttcgacgcatctgaccttgaatgcgctctatgtatgagattattctatgagccagtcacaacaccttgcgggcatactttttgcttaaaatgcctagaaagatgcctagatcacaacgcaaagtgtccattgtgcaaagacggtctttcacagtgcttggcatcaagaaaatacagcaaaaatgtaataatggaggagctcatagctaaattccttccagaagaactgaaggaacgaaggaagctttatgaagaggaaatggaagaactttctaaccttaataagaatgtgcctattttcgtgtgtactatggcctatcccaccgttccttgtcccctgcacatctttgagccttgttaccgcctgatgattcgtagatgcattgagacaggcacgagacagtttggcatgtgccttggagatcctgtcaaagggtttgcagaatatggctgcatcctagagatcagaaatgttcaattctttgctgatggccgctcagtggttgacagcataggcaagaggcgcttcagggtgctccatcagagccagcgggatggctacaacacagccgacattgaatacattgaagaccaaaaggttcagggagaggattgtgctgagctcatgggattacataactgtgtctatcagcaagcatcattgtggtttcattcgctcaaattatccctaaagaatcggatactcaatcactttggtcccatgccggagaaagacgccgatcctcagatgaacccgaatggcccagcctggtgctggtggatgttagcagttcttcccttggaaagccgagctcagctccccttcctagcaatgaggtccttaaaggacagactgaatggtattcgacgagtcctggccttcatatcccgaaaccaaaactagtgagtggattgccgaagaggagctcccaccttccccactgccgtcggggggagtcttcttgtaaatatatctaattgcaataatatcttaacagaagggggtgtcaaacagaggcatcagcctgctgttgatcacagagagaaattgagtagaaagaccaaaagaatgtgacctatttgaaactttctgtcttaagatgcttcttgacatgctgcataactacataaacagcagaggtgtttaagagcccagaaaaacataatttgattttaacattaaaatttccaaaagtttaaagtggttttgctttaatattctttctttcatagatcaatgactgtgtggttgaaatgtgaaaacaaagatactaataatgttgctgtataatttcactgacttgaggtctcattccaaatggttcaggttttatagagcattgtgtaaaataatgttcatacttctttctgttttaataatttattttttgcactactgtatccttttttctacatgtatgtttgtaactatttaagcgtacattgctgaaaagtccattgctttatttattgatgtggtttaccatgtacctagggggaaataacaatactagaagtgtgcagtttttgcttttatcttttttttactacaatgacactagttcttag

SEQ ID NO: 4745 - DNA, 3973 bp, Homo sapiens
attaggcggcgcggggcggccggcatggagctcccggaggcgcggcagggtcaggagctcggtggcatggcggcggtggctgccccgatttcctccagctgccactccttgcttcgtgtccccggtccctagacgcctcgtctcctcccgtgtccctcttcccatggagtcagtacggatcgaacagatgctgagcttgcccgctgaggtcagcagcgacaacttggagtcggcggagcgaggggcatcagcggcccaagtagacatgggcccccacccaaaggtggctgcagagggccccgcacctctaccgacgcgggagccagagcaagagcagtctccggggacctcaacgccggagagcaaagtcctgctcacgcaggcagacgccttggcgtcccgggggcgaatccgtgaagccctcgaggtgtatagacagctctccgagcggcagcagctggtggctgagcagctggagcagctggtgcgctgcctggcggagaaagtcccgcaaggcgaggcgctggcgccggcgcccccggacgagggtagcactgcaagcggcaccgtggcggcggaagagacgggggccgccgcggctgcggcggccaccgaggtgtgggacggctttaagtgccggaaatgtcatgggtttctatcagaccccgtgtccttgtcgtgtggccacaccttttgtaaactgtgcctggaacgtgggcgggccgccgaccggcgctgtgcgctgtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttggctccaaatgaccacttgctttatagcaatcggtctcagatttatttcaccttggagtctcatgagaatgcactgcatgatgcagaaatagcatgtaagctccgcccgatgggttttaaggacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaagatcctcccactgatcagggggacaaacctgctctcagtttaccacttgcatctttcgacgcatctgaccttgaatgcgctctatgtatgagattattctatgagccagtcacaacaccttgcgggcatactttttgcttaaaatgcctagaaagatgcctagatcacaacgcaaagtgtccattgtgcaaagacggtctttcacagtgcttggcatcaagaaaatacagcaaaaatgtaataatggaggagctcatagctaaattccttccagaagaactgaaggaacgaaggaagctttatgaagaggaaatggaagaactttctaaccttaataagaatgtgcctattttcgtgtgtactatggcctatcccaccgttccttgtcccctgcacatctttgagccttgttaccgcctgatgattcgtagatgcattgagacaggcacgagacagtttggcatgtgccttggagatcctgtcaaagggtttgcagaatatggctgcatcctagagatcagaaatgttcaattctttgctgatggccgctcagtggttgacagcataggcaagaggcgcttcagggtgctccatcagagccagcgggatggctacaacacagccgacattgaatacattgaagaccaaaaggttcagggagaggattgtgctgagctcatgggattacataactgtgtctatcagcaagcatcattgtggtttcattcgctcaaattatccctaaagaatcggatactcaatcactttggtcccatgccggagaaagacgccgatcctcagatgaacccgaatggcccagcctggtgctggtggatgttagcagttcttcccttggaaagccgagctcagctccccttcctagcaatgaggtccttaaaggacagactgaatggtattcgacgagtcctggccttcatatcccgaaaccaaaactagtgagtggattgccgaagaggagctcccaccttccccactgtagatagtgccacttatttagttagtttttctgtctatcatgactgacccagtctttgcctagtaggttatattttgtatgtatgtatgtatgtatgtatgtctttgtgtgtgtatgtgtgtgtgtgtatgtgtgtgtgtatatatatatatatatatatatatatatatatatatatatacactaggtagcaagcagacatcatatctttctgctttgtactgtactactgctgctagcaaataaccagcaaaatgtagaaaatgaaaaaccaattttctgtagacaacctggagaaaagagtgcctgcccctgacttagcggggcagagaatgacaatttttaaagtttgccttttctgaaggttgcttttagcccagtgctgcctcagcagcaaggggcaagcagagtcattgcgcatgtggcgcttccagctctacctgtggagctggcctgggctcagataatcccctgtgactggccattggagcggcggagctcctgaggctagttcacagcacccagaggtctcttacagtcaacagattgcatactgttgacagactgcaatccgtctgtgttccccacaccaactccatttccaagatgggaattttattcaggaactcatttttgagttcccaacatgttgacttcgcatccatttctgctcaccaaggcagaaccatagcagtggtgtgtgacaaagatgcaaatggagggcagcccaaacaatggaaaagagaagattttcagcccattcttggggctaagtgaggttttgatttatggtagaagacagttctaaaaagcagctggcagcatgggcttcaatttgtggcccttctgagttcaaacagaaggaaggaaaaggagccacataaagtgtacacattcaattcatcttagaatgatagctcccaccttattacactgtacaactatttaataatctgggttacacacatccagaggtgaaataaagaaattttcacttacaaatgtgtatttccaaacatgctaagttaacctccagagagaagtgcctgtaatctctgttcctggtgtcactttaaagcttttgcttcatgactgtagctgttgtttaaaatgtttttgcagcaaacgcgatttaacagaagtttacaaagcaacactgtagctaatgcataattttaaaagttgactaacatttatctattgttaaagcaacactaataatggaataaaaggaaagcaaataggccaatgtggcaccataggcttattttaggtaaattagttccatcatcttatgcagttgtaagtaatgccaggattaaaatatcaagcaagccacgtaaacagtggcaaatgtgtgtgtgttttccatttgtttggtaagcagccattttactcttgcactgtaatgaactgaagggaaatataagataatgcttttttccccccatattgctattcaactacctctatatgcttgatttctttttaggattcccatcctccaaatctgtacaaaaacgtttcagctcatctgtgttgtaataacaatgtgatacagacagtttgtgtgaaagttgtttgttcattaaaaaatgtttcctattgcctca

SEQ ID NO: 4746 - DNA, 2550 bp, Homo sapiens
acgcctcgtctcctcccgtgtccctcttcccatggagtcagtacggatcgaacagatgctgagcttgcccgctgaggtcagcagcgacaacttggagtcggcggagcgaggggcatcagcggcccaagtagacatgggcccccacccaaaggtggctgcagagggccccgcacctctaccgacgcgggagccagagcaagagcagtctccggggacctcaacgccggagagcaaagtcctgctcacgcaggcagacgccttggcgtcccgggggcgaatccgtgaagccctcgaggtgtatagacagctctccgagcggcagcagctggtggctgagcagctggagcagctggtgcgctgcctggcggagaaagtcccgcaaggcgaggcgctggcgccggcgcccccggacgagggtagcactgcaagcggcaccgtggcggcggaagagacgggggccgccgcggctgcggcggccaccgaggtgtgggacggctttaagtgccggaaatgtcatgggtttctatcagaccccgtgtccttgtcgtgtggccacaccttttgtaaactgtgcctggaacgtgggcgggccgccgaccggcgctgtgcgctgtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttggctccaaatgaccacttgctttatagcaatcggtctcagatttatttcaccttggagtctcatgagaatgcactgcatgatgcagaaatagcatgtaagctccgcccgatgggttttaaggcacatttcagaaaagcccaagccttagccaccctaggcaaggtggaggaggcactaagggagtttctctactgtgtatcccttgatggaaagaacaagagagcaagatgtgaagcccaaagagacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaagatcctcccactgatcagggggacaaacctgctctcagtttaccacttgcatctttcgacgcatctgaccttgaatgcgctctatgtatgagattattctatgagccagtcacaacaccttgcgggcatactttttgcttaaaatgcctagaaagatgcctagatcacaacgcaaagtgtccattgtgcaaagacggtctttcacagtgcttggcatcaagaaaatacagcaaaaatgtaataatggaggagctcatagctaaattccttccagaagaactgaaggaacgaaggaagctttatgaagaggaaatggaagaactttctaaccttaataagaatgtgcctattttcgtgtgtactatggcctatcccaccgttccttgtcccctgcacatctttgagccttgttaccgcctgatgattcgtagatgcattgagacaggcacgagacagtttggcatgtgccttggagatcctgtcaaagggtttgcagaatatggctgcatcctagagatcagaaatgttcaattctttgctgatggccgctcagtggttgacagcataggcaagaggcgcttcagggtgctccatcagagccagcgggatggctacaacacagccgacattgaatacattgaagaccaaaaggttcagggagaggattgtgctgagctcatgggattacataactgtgtctatcagcaagcatcattgtggtttcattcgctcaaattatccctaaagaatcggatactcaatcactttggtcccatgccggagaaagacgccgatcctcagatgaacccgaatggcccagcctggtgctggtggatgttagcagttcttcccttggaaagccgagctcagctccccttcctagcaatgaggtccttaaaggacagactgaatggtattcgacgagtcctggccttcatatcccgaaaccaaaactagtgagtggattgccgaagaggagctcccaccttccccactgccgtcggggggagtcttcttgtaaatatatctaattgcaataatatcttaacagaagggggtgtcaaacagaggcatcagcctgctgttgatcacagagagaaattgagtagaaagaccaaaagaatgtgacctatttgaaactttctgtcttaagatgcttcttgacatgctgcataactacataaacagcagaggtg

SEQ ID NO: 4747 - DNA, 2527 bp, Homo sapiens
atcccacgagcatgtgcggggggagggggagcgcttgcgccccgctgccctgtgactcattgtcaccgcttcctatcacacgatcctcggctgaaatagatgcccccccttgcccgccccgccaacccgtagcctgtgccctcgcctccaacccctttaacctggccagcccggcgggaggccggcgcggcaactgcttggggatccctggggaccgtgggctggctacgaatgggtcacgcctctgtcccgcttttcagtgccgcctgggagggttgggtgggctttgcagcttcaagggtaacgtgggcagtcccccatctccagctagactagggcacccgaatttccccagggagccgctctctgacccaccacgcctggacccaggaagtggctgctgagccgccagccggtgttgcccagctctggcagtttgccaggagctcggccgtggggcgcggtgtctggcgaagcatgccggggaggaggcagcagggctgggcaggcagggccctgggatccgagggtgtcctggacctgactctgtggagtggaggaggggtgtgggccggagtctccacgtgtttaatctccactcaagcttgcaacagctccaaatgaccacttgctttatagcaatcggtctcagatttatttcaccttggagtctcatgagaatgcactgcatgatgcagaaatagcatgtaagctccgcccgatgggttttaaggcacatttcagaaaagcccaagccttagccaccctaggcaaggtggaggaggcactaagggagtttctctactgtgtatcccttgatggaaagaacaagagagcaagatgtgaagcccaaagacttctccttagtttcttttcaccatcagtcccgggggattctcaggaacattctcccgatatcctgaagctgttggcacctcaccctagattaaaggaaaacgtagagtcaatgactactgaagttaccagccataatctaccaaggttgttacaggacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaagatcctcccactgatcagggggacaaacctgctctcagtttaccacttgcatctttcgacgcatctgaccttgaatgcgctctatgtatgagattattctatgagccagtcacaacaccttgcgggcatactttttgcttaaaatgcctagaaagatgcctagatcacaacgcaaagtgtccattgtgcaaagacggtctttcacagtgcttggcatcaagaaaatacagcaaaaatgtaataatggaggagctcatagctaaattccttccagaagaactgaaggaacgaaggaagctttatgaagaggaaatggaagaactttctaaccttaataagaatgtgcctattttcgtgtgtactatggcctatcccaccgttccttgtcccctgcacatctttgagccttgttaccgcctgatgattcgtagatgcattgagacaggcacgagacagtttggcatgtgccttggagatcctgtcaaagggtttgcagaatatggctgcatcctagagatcagaaatgttcaattctttgctgatggccgctcagtggttgacagcataggcaagaggcgcttcagggtgctccatcagagccagcgggatggctacaacacagccgacattgaatacattgaagaccaaaaggttcagggagaggattgtgctgagctcatgggattacataactgtgtctatcagcaagcatcattgtggtttcattcgctcaaattatccctaaagaatcggatactcaatcactttggtcccatgccggagaaagacgccgatcctcagatgaacccgaatggcccagcctggtgctggtggatgttagcagttcttcccttggaaagccgagctcagctccccttcctagcaatgaggtccttaaaggacagactgaatggtattcgacgagtcctggccttcatatcccgaaaccaaaactagtgagtggattgccgaagaggagctcccaccttccccactgccgtcggggggagtcttcttgtaaatatatctaattgcaataatatcttaacagaagggggtgtcaaacagaggcatcagcctgctgttgatcacagagagaaattgagtagaaagaccaaaagaatgtgacctatttgaaactttctgtcttaagatgcttcttgacatgctgcataactacataaacagcagaggtgtttaagagcccagaaaaacataatttgattttaacattaaaatttccaaaagttt

SEQ ID NO: 4748 - DNA, 1873 bp, Homo sapiens
gtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttggctccaaatgaccacttgctttatagcaatcggtctcagatttatttcaccttggagtctcatgagaatgcactgcatgatgcagaaatagcatgtaagctccgcccgatgggttttaaggacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaagatcctcccactgatcagggggacaaacctgctctcagtttaccacttgcatctttcgacgcatctgaccttgaatgcgctctatgtatgagattattctatgagccagtcacaacaccttgcgggcatactttttgcttaaaatgcctagaaagatgcctagatcacaacgcaaagtgtccattgtgcaaagacggtctttcacagtgcttggcatcaagaaaatacagcaaaaatgtaataatggaggagctcatagctaaattccttccagaagaactgaaggaacgaaggaagctttatgaagaggaaatggaagaactttctaaccttaataagaatgtgcctattttcgtgtgtactatggcctatcccaccgttccttgtcccctgcacatctttgagccttgttaccgcctgatgattcgtagatgcattgagacaggcacgagacagtttggcatgtgccttggagatcctgtcaaagggtttgcagaatatggctgcatcctagagatcagaaatgttcaattctttgctgatggccgctcagtggttgacagcataggcaagaggcgcttcagggtgctccatcagagccagcgggatggctacaacacagccgacattgaatacattgaagaccaaaaggttcagggagaggattgtgctgagctcatgggattacataactgtgtctatcagcaagcatcattgtggtttcattcgctcaaattatccctaaagaatcggatactcaatcactttggtcccatgccggagaaagacgccgatcctcagatgaacccgaatggcccagcctggtgctggtggatgttagcagttcttcccttggaaagccgagctcagctccccttcctagcaatgaggtccttaaaggacagactgaatggtattcgacgagtcctggccttcatatcccgaaaccaaaactagtgagtggattgccgaagaggagctcccaccttccccactgccgtcggggggagtcttcttgtaaatatatctaattgcaataatatcttaacagaagggggtgtcaaacagaggcatcagcctgctgttgatcacagagagaaattgagtagaaagaccaaaagaatgtgacctatttgaaactttctgtcttaagatgcttcttgacatgctgcataactacataaacagcagaggtgtttaagagcccagaaaaacataatttgattttaacattaaaatttccaaaagtttaaa

SEQ ID NO: 4749 - DNA, 1452 bp, Homo sapiens
ccaagtaggtagaaagcggcctccaggcctcgcgaggatgagcccggcgtcccagtcgcgaggatgggcgcggcagggcgggcgacccggcttgtgggagggagggagcagcgcggggcggtgggaggggggtggtggggcggcgaaccggacatcccatacacccacactacagaacaccccccgatgggctcaccactcccgaaccttcgcgcccacgtgcgaacaggcagaccgcccgacccgtgcacggcagctgcgagggaccggcggccactcgggcgtggcgggcgcggggcagcccagacgtttgggcagcgaaccagaggcggaccgcggtgcccgggatctcaccgccagcggcctccaagcatgaaggcggccccgcggctcccccaccgcctccgccatcgcggccagcccccggaaccctcttccctgcgcgcgctgcacgccgaccccataccctccgggctctcaccaggcccatgcggagcgccgccgacctggtccggaaggcgcgcgcccggggacagggacaaccggccaaccagtggcccgtggcagcgccacacaaggcggagccgggtttggtcccagagggggccaccacagcctaagctggtgagccgctcggggagagaggatacgcgggcggggaggggggcacagacaggcaaggccagggaccgcaagggcaagggcacccgggagcccgcagaggggcggctcgggaagaaacctcaggcaaagccgggccaccaggaaaacacggccacgggatcccaccgccacagatacgagggaggtcccgcggcgccccgcctaggaagccggacggcccctggcacccaccgagacccgcctcacgagcctgggtcccgccatcgggaccccgaagcgacctcagccacaaacccaacgccagggccacgttgctggtttcttgtccatcctccgacactgtcaagctccgggagaccggcgcgccccccacttgggatgcttcccatggccaggcatcccaaccccgtgccacgcaaacgcggttgtcggcaccggtcgctgctcctcaggggagcgggtggagagccggctcgcagcggagcgggtcacgcgccggacggaacgcctggcacagccaccgctcgcgcagcctcccaaccgctaggacgccggcccggcccggcgggatcctcccccgactcggaagggggaggcgcgggccacacagtaggtgacgagccgccctcggtccccaccgcggaggactctctcaagagagagtcggtaagagactcatcattctctcccgaaagcagtgaggtggatggtggcttgtgttccgagctcctgtggtttcagttggccgcgcgtagaagagagatttccaatgtttccagagaggcgcgagccacagtcattgaacccaggaagtggaggttgcagtga

SEQ ID NO: 4750 - DNA, 585 bp, Homo sapiens
tggggcgagtgcccctatttttcccatgaggcctcagccaagaggaggttcgggaagaaaggaaaacacaggtgaggagagagaagggcgggcagagaggtaccacgccattagtgctgatggggagaggcggctccagcccggcactgctgtccttacgaggcatgtttcctttttattcggaggaagagaagcagaggaacacgtcatggagacggaccgagttgaaggagccagggatggtgacaagcggaaggaagtgtgttttgtccccatccagggaagcttttgtttcatgagacttacttgcgcacgtctggtagctgccctggacattcatggactttcgttttcactcagattttgtggttcacgtgacacaaagcatgaggacatcactgggcgagagggccaggtcaccccactgccgaggggcacgccccagctgtgcaccgctagagtgggcttgtccagtcctcggacacggggacagggtgtgcccatctcatgtaagacatgaataatagtagaaatttctgttgcatgagaactctctgcattatcctcaccattttcctgtaagcg

SEQ ID NO: 4751 - DNA, 343 bp, Homo sapiens
aatgtatgcaatgtctttatttcatcctcattcttaaaggatattttcatcagcaacaccacaccctcctgatcaccatagctttatggtaagacacccctactctgtccagacccaactgtcaacagaagccaaagccatctggaggagcatgcaacaacaagaaacaaatttattagctaacctaaccactaatgacgcaagagacaattctaaggactttcaaaacagcaaagtaggagcagctgctacctctagggatgagggatgcaattgtccaattattggtgaaattgtcatttcatgctattggctatttgaaattcctcctctaatatctagg

SEQ ID NO: 4752 - DNA, 548 bp, Homo sapiens
aatgccttaaagaaaggactgatctcccctgaagaagagagaattctgcctctagattgcttacaatttgaactggaacatcagctgttctctaggtcttaagtctgctgctctaacctacaaattttggacatgccaatctccacagtcacatgggccaattccttagtttctctggagaatcctgactaatgtatgcaatgtctttatttcatcctcattcttaaaggatattttcatcagcaacaccacaccctcctgatcaccatagctttatgatctgagctttcatctggtatcatttcctttccgtctgaagaacttgctttccttgcaacaacaagaaacaaatttattagctaacctaaccactaatgacgcaagagacaattctaaggactttcaaaacagcaaagtaggagcagctgctacctctagggatgagggatgcaattgtccaattattggtgaaattgtcatttcatgctattggctatttgaaattcctcctctaatttcagaataaatcactgaaattgacatcggcc

SEQ ID NO: 4753 - DNA, 2185 bp, Homo sapiens
aatgccttaaagaaaggactgatctcccctgaagaagagagaattctgcctctagattgcttacaatttgaactggaacatcagctgttctctaggtcttaagtctgctgctctaacctacaaattttggacatgccaatctccacagtcacatgggccaattccttagtttctctggagaatcctgactaatgtatgcaatgtctttatttcatcctcattcttaaaggatattttcatcagcaacaccacaccctcctgatcaccatagctttatgtttcttacagcaacaacaagaaacaaatttattagctaacctaaccactaatgacgcaagagacaattctaaggactttcaaaacagcaaagtaggagcagctgctacctctagggatgagggagaaactcaaaaatgcatacaaaaaccattgcatgaaaagtgactggatttgtacatagcgtcaggagatgtgcgtagtgtcaaagtatctcatcacacattacttgataattacaaatgagaaaaatgaaccttcacagtggcaagacttgacttctacctctttcaaaaagatgcaattgtccaattattggtgaaattgtcatttcatgctattggctatttgaaattcctcctctaatttcagaataaatcactgaaattgacatcggccagtctgaatttcaagaaattacctgctgaagacaagagggatctcttcttcagatttgcagtctggggaagacacagcctctactgtactttagaacctgagatatggtggtggagggagccctgggtcgagtggtaagattcacccttaggttagtattgacgtaaggtgacgaggagctgtagacaaaagattgtaaccataagaacttcatagtttttgtattttcaccgagcttatatttggtgtgttttttgtcttttctttatgattatcaataaaatgcttgaaaggagatgaggttggggaataatttttgggaataccacaaaagacacttttgtgatggaaatccttaaaaagacacaatccattacctcattgggttcaaaaggcaattgtgaactactgtggagtttggaaagaagcaatgaggtaatcaaggatactgttgacaatctagcttatcctatggatggaaggaaattgaaactaatggaggcgaggctggtaaaacaatagggtttgagacaattctgtggcattagaaatgaaagaggaaggtgaatccgggagacggagcttgcagtgagctgagatcgcgccactgcactccagcctgggcgacagagcgagactccatctcaaaaaaaaaaaaaaagaaagaaagaaaagaaagaggaagtaataatctgtgaaatttttccttaggaacttattggcaatttaaaaatgaatttgttaagccatgctggttctgacccaaaagccattccccagccttcctcactcccctctttcactactggcagagattgtctctcattttacaagctgaaaatgccagatgcttgcttttacagtcttccttacacccagagcatgtgcatatgtttaaacggtcaagaagaagtcataacatgggtgtctgggagagcttttatcccacaaaaacaacacttcactcaaaaaacaaaccaaacaaagaaaaattctccttcctgccattggatgtgaggctcagacctctagtaaccattttgtgaccacaaagcaacaagcctgaggaaaagtcctacacgctgagcaacaggcagaaatattgccatcgctgagttgcagaaacaaatctagagatgttttgcttctgtaattattttttatgggagattacaagtgggtttactgttcacttttcaaatcttatttctctatgatgtttagcttgggtaaattttaccttaaatccacttttttatgtaaggtaacatatttgtcggtttcaaggattaagatgtgggcatacttggaggccattattttgcccaccacaggtgaaaaaggaagtgttattcttaaatcatttggaaggatctctgtgtaaatgcaagagcgagacaagaaaatgctgtcattcttttgatatggactcgaatttccacttcatggttgtctgcttcctttttagagtattatttatcctcctaataaaaagaaagtgaaatttccc

SEQ ID NO: 4754 - DNA, 2970 bp, Homo sapiens
acgtctgcggtgttacccacgactgcctgggacctggccaagggctccacacaccaagaccaaggcagcaggaaggagaaaggagggaaggtaaaagactactgaaaagctttcagctggggctgggcatggaggctcacacctgtaatcccaacactttgggaagccgaggctggtggatcacttgagcccaggagtctgagaccagcctggccaacatggcaaaaccctgtcgctacaaaaaatacaagaattagccatgtgcacctgtggtcccagctcccagggccgggagcctgaaaccaaggtgtccacagggccctgctgcccccagaggctctgggcagagcccttccgcctttccagctccccctggttcccgtgctcctcggcctgtggccccatcactctggcctctgccttcatctcatgccgagatccctgaagcgggcccagctccgttcactgctcccccggcctcctgctgtttcccacacgcagccatggtacagggcagctcatcccaccacctccccaaccgcagcctccagggatgtacaccctgcctcaggggctgtgcctgggccctggctggtggagggcacagccgtcagggaaggccctcagctgcaggatgccgtgcctcagagaccaaccaggccctcgaaggcactgtggccggcccagatgtcagcagctccagcaattaggctgggacagatggtgcctggtgacacaaggggactgtgggggccacaggggaccctgctcacctggacctaccgtggaggccagggagggagatggactcgaagggcggaagggcccagagaaggcacatttgcagagcagcggccgcatttccagagctcgggagcccaacaggaatcccgtctggccatgggaccaccgcccttggggctgggggatgccgcaggggacggcagagggcagacaggccaggaaaaggggagggcagagggcagacaggccaggaagagcgcctgcaagtgcccaaggaagggaccaaacccaggcccctggaccagagcggccgcctggtggggcaggctggaaggggccaaggccagcgccaagggggagcaggtgagggaccctggtgggcatctgtgggaacaaggccacgtttctccctgcgcacgctttaatcaaggacattcctgtggttctccaaaagtgtcgcacactacatgggtgtcgtgagctgggctccgtgagagtgtgcgggtggctgggggcagcaagggagcagcaaggcctcaaacccgggcggcggcctggcctgcgcgccaggatgtgcggtgtgagtttcccgagctgcaggaacaaggtccacagactggggagcttcacacaacagaaactgcctcgcagttcccgaggccagagcccatcggggtggctccctgaggccgtgagcccggactgtcctgggccgccccctcttccacaggctgagatcatccttggcgtctgttggcctgcggccgcctcgcccaacctctgccctcatgtccacacgggtcctccctgtgtgcatgttggtgtctggatctgccctttctactgtggggcaactgtcgtcgaggatagggcccaccacacaacacggcctcatcgtaactaagtatagtcagcagtgatcctatttcccaataaggtcccattctgaggtcctggacttcaacatgtgaattttgggggccacaactctaccctggcatgcagagagagaaggggggcgtggagtccccctggggggaagtcccttgggaagtcacaggcccccttggtggggcaattgggacgtgggtgtgagggtcctgggtacagggagcctgcctaccaaggctctgccgacagctatttctaaattcctcgtggaaaataccctgtggccctcctcatctggagcgagcgacgggctggagggtgtctgagccaggctggtgccggggagcagatgtgggtggcccaacccagccccttgttcttgttccccacctcccaggaaagggggagggtgggcggagccggccctcctgggctctctccttgggtcccggagccacctggggaggggaggctcaaccccctaccttggccagctggctgcaggtctctcagggctggcacagaacagctgggctttgccaggtgtcccccatcctgatgcacggcccggtggtgcggtctccaggcctcccaggattctcagctgcgccgtctccccagtccccaaaccccagtggtggccgccaggggactggaccgtcagtctgtggagctggggctgcagctggtggtgtttccaacaagggtcttttggctgcctggctccagggagaggcctctggaggcaaggggtaacctaccgggaaagcctcaaaggcacccccatccccgccccgcacagactccaccggccccccatggttcctccaggccctcttcagtcatgacaggcagtgcctgggtgcccggcctgctcagcacaccctgggcctcagccccacccaagccttggcctagcatgggagccaccacgggaacacacacacgggctggagggtgtctgagccaggctggtgccggggagcagatgcgtcagatggaggagaaaagccctggggcagcggcttctggagctctggccaaggatgggctctgagcacacccctgcccggcccagagcaccaggccggggcagggtcaggaacagcttgaagccccctgcaaagtctgtccctcctcctggagcctcagctgcccctccaacacagccctctgtgggagcctagatggcccccgtgtggccatgagacatgggcgggcgctggtggattcctctgtgtcaggtgacatggtggcaccccggccgcaggctgtgccccggctgtggcgttaagaagggctatggatctaaataaaatccagtctctttgctgg

SEQ ID NO: 4755 - DNA, 549 bp, Homo sapiens
ccgccgttcttctgctgccaccgctgtcggcaccatgggcagtgagcagagctccgaggccgagagccgacccaacgatctgaactcctcagggctattgagtggccagacttccccaacaaatgccaaattggagaaactggactctcagcaggtgttgcagctctgcctccgatatcaagatcacctgcatcagtgtgcagaggccgttgcttttgaccagaatgctttggttaaacgaatcaaagagatggatctgtctgtagaaactctgttcagcttcatgcaggagcgccagaaaagatacgccaagtatgccgagcagatccagaaagtgaacgagatgtccgccatcctccgccgcatacagatgggcatcgaccagactgtgcccctgctggacaggctcaacagcatgctgcccgagggcgagcggctggagcccttcagcatgaagcccgaccgcgagctcaggctgtagctgctgcccggcctgcctggggctgggagccccagacaccgacaccctgaggacgtgtggagctaagg

SEQ ID NO: 4756 - DNA, 2052 bp, Homo sapiens
gagtgaaagcggcgccgcccgccggccgcaggtgcggcaaagccagtgtcatctgccggttctcttagggctcccggaaagaaggagggctagccgcgtgcgttcgcgccgcgcctccttgcgtttctgttccccaaatagggcctctccttctcccgccgcccaggcccctgcgtgggctggacgcgtcagccccacacattagcctcgctgcggcgcccagactctgctttgcctccccgtcccggtccctggcccctgccctgtcgcccgccgccggagcggtgaccgcccggcccgccgttcttctgctgccaccgctgtcggcaccatgggcagtgagcagagctccgaggccgagagccgacccaacgatctgaactcctcagtgactccttcaccagccaagcatagagccaagatggatgatattgtggttgtagctcagggctcccaggcctcacggaacgtcagcaacgatcccgatgtcatcaagttgcaagagattccaaccttccagccccttttgaaagggctattgagtggccagacttccccaacaaatgccaaattggagaaactggactctcagcaggtgttgcagctctgcctccgatatcaagatcacctgcatcagtgtgcagaggccgttgcttttgaccagaatgctttggttaaacgaatcaaagagatggatctgtctgtagaaactctgttcagcttcatgcaggagcgccagaaaagatacgccaagtatgccgagcagatccagaaagtgaacgagatgtccgccatcctccgccgcatacagatgggcatcgaccagactgtgcccctgctggacaggctcaacagcatgctgcccgagggcgagcggctggagcccttcagcatgaagcccgaccgcgagctcaggctgtagctgctgcccggcctgcctggggctgggagccccagacaccgacaccctgaggacgtgtggagctaaggtcatatcatctgaccaggtctggaggctggcgggaggctccctgaaagtgggtgcgaaggagtccggctggcatgaaaatctgactttgcccagctcttttccttgatgcagtttcccggtgtggaaggaacctaaccagttctcggtgataactgaagctggaacgtgtgaattattaggaattctttgaagaactctgcattgagaattatttttatttagtttttttttttttttaattgagagtatatagtccagtccaggtaccggaataaaaatatggagacaaggggaaaatattttacgaagctctgtgttctcaacgccctcatgaacttttcagtaggctgtctggtttatgtgtggtcaacttgaaaaactaattgaatctaggtctctgtattgttcctgtttctaccctgactgtttccgtcacaccaagcccttatctggggcgcgtcttcctgcccaggtggaacactggcattttgttgactgtcaggttaggtgtcccttagtcgtcatcagaagctgaagccttcctttccacaccctcatcagattcatctccactgataaccggtttccttgatgcagacatagtttagctttctttgactgcagagatgtctcattccacagacatttcttgaacccatttgatgtgtccaatattgtgccagggatacaaatatggccgtatagcctcaggccttcatttctgaaaagaaaaaagctcaaaaagctgctgaatttctctgggagtttaggaaaggaagttatttgagtaacaacaaaagtgcttagtgtcgtactttacacatcataggtgttctaatggaagcaaggactggagaagcaaagagtggaatgtgaggagcagacctaggcagacaccttgagactaaaagtcagagctgaagggagtcgctggggccaggacggcatgcaggcctgtaccctgttccctaagttcctgcaagcgtcgggaggtgtgttttcagataccagaaagagccttcagtagattcacaagattaaaattgatgcgcttaatttaa

SEQ ID NO: 4757 - DNA, 546 bp, Homo sapiens
ggtgacaatgcagggaacccgtgctgagctctctgcacacagccccagtcgggcagcaggaaaccgaagacatgaacaaggtcttcccccaggagcccaagcttgtataacactgacaaacaggacaggcttcttgtgccatgaccagaggagctgcattccagccagtggggtctgtgatggcgttcgcacctgtacccacggcgaggacgaggatgagagcttgtgccgagatgtgccccagagcctcccccacttccttgtggcccactgtggagacccggcctcctggatctactcagaccaaaaatgtgatggcactaacaactgcggggactgttcagatgaactgagcccagtaactgtgtgcccaccctgcggccctgggtggtggcgctgtccttcaaccttcttcaagtactgcgactgtataccgaggcatctctgccgcgaccatgtacagcactgctccgactggtccgatgagtatgcctgtcccggaccctgagtgggccactcaggccagcatggaaggctggctggaat

SEQ ID NO: 4758 - DNA, 593 bp, Homo sapiens
cagcaggaaaccgaagacatgaacaaggtcttcccccagggagagaatggctacactgctgctgaatccaaagcccaccctggaggggaaggagcccaagcttgtataacactgacaaacaggacaggcttcttgtgccatgaccagaggagctgcattccagccagtggggtctgtgatggcgttcgcacctgtacccacggcgaggacgaggatgagagcttgtgccgagatgtgccccagagcctcccccacttccttgtggcccactgtggagacccggcctcctggatctactcagaccaaaaatgtgatggcactaacaactgcggggactgttcagatgaactgagcccagtaactgtgtgcccaccctgcggccctgggtggtggcgctgtccttcaaccttcttcaagtactgcgactgtataccgaggcatctctgccgcgaccatgtacagcactgctccgactggtccgatgagtatgcctgtcccggaccctgagtgggccactcaggccagcatggaaggctggctggaatggcactgataacccttcacatgaaaatcaaatcctagcgcacaagggc

SEQ ID NO: 4759 - DNA, 1193 bp, Homo sapiens
ggaccaatggagggtctcgctggacacaccggacttcaccgacatcgtgctgcagctggacgacatccagcatgccatcgccatcaactatgacccaatggagggccacgtctactggacggatgacgaggtgtgggccatccgcagggcatacctggatgggtctggggcgcagacgctgatcaacaccaagatcaacgaccccgatgacatcgcagtcaactgggtggcccgaagcctctattggacccacacaggcactgaacacatcgaggtgacgtgcctcaacagcacctcccacaagatcctggtgtcagaggacatggacgagccccgtgccattgcactgcatcccgagatgggcctcacgtactggatagactggggagagaaccctgaaatcaagcgtgccaacctggacaggcaggagctgcgcgtgctggtcaatgcttccctcgggtggcccaacggcctggccctggacctgcaggaagggaagctctactggggagatgccaagacagacaagatcgaggcgatcagtgtcgatgagacgaagaggcagaccctcctgaaggacaagctcccacacattttcaggttcaccctgctgggggacttcatctactggaccgcctggcagcaccacagcatcaagcgggtacacaaggtcaaggccaaccgggacgtcatcattgaccagctgcccgacctgatggggctcaaagctgtgaacgtggacaaggtcgtcggaaccaaccctcatgcggacaggaatgggggtgcagccacctgtgcttcttcacgccccacacaacccggtttggctgccccatctagggcctggaactgctgagtgacatgaagacctgcatcatgcccaaggccttcttggtcttcaccagtagagccgccatccacaggatctccctcgagaccaacaacaacgatgtggccatcctgctctcggcgtcaaggaggcctcggccctggactttgatgtgtccagcaaccacatctactggacagacatcagcctgaaggtagcgtgggcccgaacatgcacacgtgcagcctatatgggaaaaccttccctctgtacctgcctcaaaggtttcagacatttttcttaaagcactataatatttattgtaacacaattcaagctaattaaatatgagcaagcctatttc

SEQ ID NO: 4760 - DNA, 1661 bp, Homo sapiens
tacatgtactgggcagattggggtgagacgccctggatcgagcaggtggggatggacgacagcacccagaagatcattgtggacttggacatttactggcccaatagactgaccatcgacctgggggagaagaagctctactgggctgacactaagctcggcttcatccaccgtgccaacctggacggctcgttccggcagaaggtggtgaagggcagcctgacgcaccccttcaccctgacactctccggggacactctgcactggatggactggctgacgtgctccatccatgcctgcaacaggaacactgcggggaagaggaacgagatcttgagcgccctctactcagcatggatatccaggtgctgagccaggagcagcagcctttctgagccaaggaggtcctgctgctggcccggtagacggaccaatggagggtctcgctggacacaccggacttcaccgacatcgtgctgcagctggacgacatccagcatgccatcgccatcaactatgacccaatggagggccacgtctactggacggatgacgaggtgtgggccatccgcagggcatacctggatgggtctggggcgcagacgctgatcaacaccaagatcaacgaccccgatgacatcgcagtcaactgggtggcccgaagcctctattggacccacacaggcactgaacacatcgaggtgacgtgcctcaacagcacctcccacaagatcctggtgtcagaggacatggacgagccccgtgccattgcactgcatcccgagatgggcctcacgtactggatagactggggagagaaccctgaaatcaagcgtgccaacctggacaggcaggagctgcgcgtgctggtcaatgcttccctcgggtggcccaacggcctggccctggacctgcaggaagggaagctctactggggagatgccaagacagacaagatcgaggcgatcagtgtcgatgagacgaagaggcagaccctcctgaaggacaagctcccacacattttcaggttcaccctgctgggggacttcatctactggaccgcctggcagcaccacagcatcaagcgggtacacaaggtcaaggccaaccgggacgtcatcattgaccagctgcccgacctgatggggctcaaagctgtgaacgtggacaaggtcgtcggaaccaaccctcatgcggacaggaatgggggtgcagccacctgtgcttcttcacgccccacacaacccggtttggctgccccatctagggcctggaactgctgagtgacatgaagacctgcatcatgcccaaggccttcttggtcttcaccagtagagccgccatccacaggatctccctcgagaccaacaacaacgatgtggccatcctgctctcggcgtcaaggaggcctcggccctggactttgatgtgtccagcaaccacatctactggacagacatcagcctgaaggtagcgtgggcccgaacatgcacacgtgcagcctatatgggaaaaccttccctctgtacctgcctcaaaggtttcagacatttttcttaaagcactataatatttattgtaacacaattcaagctaattaaatatgagcaagcctatttcaaaaaaaatagacgattataatgagcaaatccggtagacac

SEQ ID NO: 4761 - DNA, 1714 bp, Homo sapiens
agacgaagatgcagggacacgcgcgaggagccgccgcagccgccgccgccgcgctgtggagcccgagtgagcgcggcgccagcccgtccggccgctggacaacatggaggctgcactgcccgggccgccgtggccgctgctgctggcgctgtgcggctgcccggcccccgccgcaggtacatgtactgggcagattggggtgagacgccctggatcgagcaggtggggatggacgacagcacccagaagatcattgtggacttggacatttactggcccaatagactgaccatcgacctgggggagaagaagctctactgggctgacactaagctcggcttcatccaccgtgccaacctggacggctcgttccggcagaaggtggtgaagggcagcctgacgcaccccttcaccctgacactctccggggacactctgcactggatggactggctgacgtgctccatccatgcctgcaacaggaacactgcggggaagaggaacgagatcttgagcgccctctactcagcatggatatccaggtgctgagccaggagcagcagcctttctgagccaaggaggtcctgctgctggcccggtagacggaccaatggagggtctcgctggacacaccggacttcaccgacatcgtgctgcagctggacgacatccagcatgccatcgccatcaactatgacccaatggagggccacgtctactggacggatgacgaggtgtgggccatccgcagggcatacctggatgggtctggggcgcagacgctgatcaacaccaagatcaacgaccccgatgacatcgcagtcaactgggtggcccgaagcctctattggacccacacaggcactgaacacatcgaggtgacgtgcctcaacagcacctcccacaagatcctggtgtcagaggacatggacgagccccgtgccattgcactgcatcccgagatgggcctcacgtactggatagactggggagagaaccctgaaatcaagcgtgccaacctggacaggcaggagctgcgcgtgctggtcaatgcttccctcgggtggcccaacggcctggccctggacctgcaggaagggaagctctactggggagatgccaagacagacaagatcgaggcgatcagtgtcgatgagacgaagaggcagaccctcctgaaggacaagctcccacacattttcaggttcaccctgctgggggacttcatctactggaccgcctggcagcaccacagcatcaagcgggtacacaaggtcaaggccaaccgggacgtcatcattgaccagctgcccgacctgatggggctcaaagctgtgaacgtggacaaggtcgtcgggcctggaactgctgagtgacatgaagacctgcatcatgcccaaggccttcttggtcttcaccagtagagccgccatccacaggatctccctcgagaccaacaacaacgatgtggccatcctgctctcggcgtcaaggaggcctcggccctggactttgatgtgtccagcaaccacatctactggacagacatcagcctgaaggtagcgtgggcccgaacatgcacacgtgcagcctatatgggaaaaccttccctctgtacctgcctcaaaggtttcagacatttttcttaaagcactataatatttattgtaacacaattcaagctaattaaatatgagcaagcctatttcaaaaa

SEQ ID NO: 4762 - DNA, 600 bp, Homo sapiens
tggggatggacgacagcacccagaagatcattgtggacttggacatttactggcccaatagactgaccatcgacctgggggagaagaagctctactgggctgacactaagctcggcttcatccaccgtgccaacctggacggctcgttccggcagaaggtggtgaagggcagcctgacgcaccccttcaccctgacactctccggggacactctgcactggatggactggctgacgtgctccatccatgcctgcaacaggaacactgcggggaagaggaacgagatcttgagcgccctctactcagcatggatatccaggtgctgagccaggagcagcagcctttctagagggggtttttgagactagaatcacctcagcatcctcctgtccccagctgtgtccagcctgtctgcagggacatcctgagaggactaggctctcccctcatccacctgcgagccaaggaggtcctgctgctggcccggtagacggaccaatggagggtctcgctggacacaccggacttcaccgacatcgtgctgcagctggacgacatccagcatgccatcgccatcaactatgacccaatggagggcca

SEQ ID NO: 4763 - DNA, 2594 bp, Homo sapiens
cctctcagagccccagtcgcgcgccccttcttggttcgctcggtgcccgcgcaggcccctcgggcggtggcgaggaggcgcccaggcggaggcggcggcgggcggaggagcgcaggagcgggcggccaggccaccgcgcggcggcggagcgggccgcggcccggcgctccttccccaccgcggcccgacgcaccccggccgccgccatgagcggctcctcaggcaccccgtatctgggcagcaagatcagcctcatctccaaggcgcagatccgctacgagggcattctctacaccatcgacaccgacaactccaccgtggcgctcgccaaagtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagtcttccctgggttctgcctccgcctcgcccttccagccgcacgtgccttacagccctttccgagggatggcgccctacggcccgctggcggccagctccctgctcagccagcagtatgccgcctccctgggtctagagaagttggtaagccctccagcctcagccgctgcttccagccctagctcttctccatctccacagcccgtttcagagcttgacttgtcctcagagccacagcagctcactgccaagggtaacagcagtttgggagaactgcatgctgtcttgcaaaccattctgagagcgaggggtaaagcagcagacagaatgacagtagctgtagcagatcatttgccaagcccatgcagcaggaggcgatcaggaaacaggcgaacaaggaatcgctccagagggcaaaaccgtccaactaacgttaaggaaaacacaatcaaatttgagggtgactttgatttcgagagtgcaaatgcccagttcaaccgagaggagcttgacaaagaatttaagaagaaactgaattttaaagatgacaaggctgagaagggggaagagaaggacctggctgtggtgacccagagtgccgaagcgcccgctgaggaagaccttctggggcccaactgctactatgacaaatccaagtcgttcttcgacaacatctcttctgaactcaagaccagctccaggcggacgacgtgggccgaagagaggaagctcaacacagagacctttggggtgtcagggaggtttcttcgtggccgcagttctcggggcggattccgaggaggcaggggcaatgggaccacccgtcgcaaccccacttcccacagggccgggactggcagggtgtgagggtgcagccaaaggctcctactgaagtggcgcataactgacgctgtgtgtgtcaggacgcgaggaaaacgctgcacttacagggagaggtggtcactttgtttacggagtttggaagagacccatactgctacttgtgttttggacttaactgaacttggacatggtctgagttagaaccacttgttttggggaagtattcatgggtaacctctttgaggtctctttatctgtgtttcctttttagttgcgcatagcctaattctaaggttttggtattttgcaaaaaggtttctatagtgaaagctgaatccttactttgtgacttttttttttttttttaatgacaagctttgacttttaaaagtggaaccaaatctgttggcagaggtggcagccaagtacatctctgtaacccagctggcccctggtgctgttggcctggcaccccactgccaagggtggggtctcaggagtcaggcagggccagcacagggtggcgtggggggcaggggtgggtgggtggagggcacggaaggggttttcccatggatcatgttgtataagtgaaccagaccaccctgatggcatccacagtgatgtcaaggttggggctggccaggggtgggtggactagaagcatttgggagtagtggccaggggccctggacgctagccacggagctgctgcacagagcctggtgtccacaagcttccaggttggggttggagcctgggatgagccccggcagcgccttggcccttctgtggtccctgccagcctctgacctgggccggtcagtcattgctggactctggccacacactggcgttctcatccacttggaaacaagccagtcttttctgcaaggtcagttgaccaagagcatatttcccctctgttgtacatcgttgttttgtgtttgtgttgtaacagtgggtggagggagggtggggtctacatttgttgcatgagtcgatgggtcagaactttagtatacgcatgcgtcctctgagtgacagggcattttgtcgaaaataagcaccttggtaactaaacccctctaatagctataaaggctttagttctgtattgattaagttactgtaaaagcttgggtttatttttgtaggacttaatggctaagaattagaacatagcaagggggctcctctgttggagtaatgtaaattgtaattataaataaacatgcaaacctttaaaatttt

SEQ ID NO: 4764 - DNA, 2594 bp, Homo sapiens
cctctcagagccccagtcgcgcgccccttcttggttcgctcggtgcccgcgcaggcccctcgggcggtggcgaggaggcgcccaggcggaggcggcggcgggcggaggagcgcaggagcgggcggccaggccaccgcgcggcggcggagcgggccgcggcccggcgctccttccccaccgcggcccgacgcaccccggccgccgccatgagcggctcctcaggcaccccgtatctgggcagcaagatcagcctcatctccaaggcgcagatccgctacgagggcattctctacaccatcgacaccgacaactccaccgtggcgctcgccaaagtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagtcttccctgggttctgcctccgcctcgcccttccagccgcacgtgccttacagccctttccgagggatggcgccctacggcccgctggcggccagctccctgctcagccagcagtatgccgcctccctgggtctaggagctggttttccatccatcccagtcggcaagagccccatggtggagcaggctgtgcagactggttctgctgacaacctgaatgctaaaaagctgttacctggcaagggcaccacagggacgcagctcaacggtcgtcaggcccagccgagcagcaagacggccagcgatgtagtccagccggcagctgtgcaagctcaagggcaggtgaatgacgagaacagaagacctcagaggaggcgatcaggaaacaggcgaacaaggaatcgctccagagggcaaaaccgtccaactaacgttaaggaaaacacaatcaaatttgagggtgactttgatttcgagagtgcaaatgcccagttcaaccgagaggagcttgacaaagaatttaagaagaaactgaattttaaagatgacaaggctgagaagggggaagagaaggacctggctgtggtgacccagagtgccgaagcgcccgctgaggaagaccttctggggcccaactgctactatgacaaatccaagtcgttcttcgacaacatctcttctgaactcaagaccagctccaggcggacgacgtgggccgaagagaggaagctcaacacagagacctttggggtgtcagggaggtttcttcgtggccgcagttctcggggcggattccgaggaggcaggggcaatgggaccacccgtcgcaaccccacttcccacagggccgggactggcagggtgtgagggtgcagccaaaggctcctactgaagtggcgcataactgacgctgtgtgtgtcaggacgcgaggaaaacgctgcacttacagggagaggtggtcactttgtttacggagtttggaagagacccatactgctacttgtgttttggacttaactgaacttggacatggtctgagttagaaccacttgttttggggaagtattcatgggtaacctctttgaggtctctttatctgtgtttcctttttagttgcgcatagcctaattctaaggttttggtattttgcaaaaaggtttctatagtgaaagctgaatccttactttgtgacttttttttttttttttaatgacaagctttgacttttaaaagtggaaccaaatctgttggcagaggtggcagccaagtacatctctgtaacccagctggcccctggtgctgttggcctggcaccccactgccaagggtggggtctcaggagtcaggcagggccagcacagggtggcgtggggggcaggggtgggtgggtggagggcacggaaggggttttcccatggatcatgttgtataagtgaaccagaccaccctgatggcatccacagtgatgtcaaggttggggctggccaggggtgggtggactagaagcatttgggagtagtggccaggggccctggacgctagccacggagctgctgcacagagcctggtgtccacaagcttccaggttggggttggagcctgggatgagccccggcagcgccttggcccttctgtggtccctgccagcctctgacctgggccggtcagtcattgctggactctggccacacactggcgttctcatccacttggaaacaagccagtcttttctgcaaggtcagttgaccaagagcatatttcccctctgttgtacatcgttgttttgtgtttgtgttgtaacagtgggtggagggagggtggggtctacatttgttgcatgagtcgatgggtcagaactttagtatacgcatgcgtcctctgagtgacagggcattttgtcgaaaataagcaccttggtaactaaacccctctaatagctataaaggctttagttctgtattgattaagttactgtaaaagcttgggtttatttttgtaggacttaatggctaagaattagaacatagcaagggggctcctctgttggagtaatgtaaattgtaattataaataaacatgcaaacctttaaaatttt

SEQ ID NO: 4765 - DNA, 811 bp, Homo sapiens
gtggcgaggaggcgcccaggcggaggcggcggcgggcggaggagcgcaggagcgggcggccaggccaccgcgcggcggcggagcgggccgcggcccggcgctccttccccaccgcggcccgacgcaccccggccgccgccatgagcggctcctcaggcaccccgtatctgggcagcaagatcagcctcatctccaaggcgcagatccgctacgagggcattctctacaccatcgacaccgacaactccaccgtggcgctcgccaaagtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagtcttccctgggttctgcctccgcctcgcccttccagccgcacgtgccttacagccctttccgagggatggcgccctacggcccgctggcggccagctccctgctcagccagcagtatgccgcctccctgggtctaggagctggttttccatccatcccagtcggcaagagccccatggtggagcaggctgtgcagactggttctgctgacaacctgaatgctaaaaagctgttacctggcaagggcaccacagggacgcagctcaacggtcgtcaggcccagccgagcagcaagacggccagcggaaacaggcgaacaaggaatcgctccagagggcaaaaccgtccaactaacgttaaggaaaacacaatcaaatttga

SEQ ID NO: 4766 - DNA, 1239 bp, Homo sapiens
ggagcagggcggctcccgtcagcgggcctcctccccgccagcctggggggatccctgcgggggagcctcgaggtcgggtggcggggccagtgtcccggcgtctcccgaaggctgggggtggggtcacaacacgcgaatcctgcaagcctttctggaacttattagacagctggggccttgatcctgaacaaataccgcgtcctaatgcggcctcctgccaaggcagaagcatccgttggcagccagatgccccggtttaaacgtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagtcttccctgggttctgcctccgcctcgcccttccagccgcacgtgccttacagccctttccgagggatggcgccctacggcccgctggcggccagctccctgctcagccagcagtatgccgcctccctgggtctagagaagttggtaagccctccagcctcagccgctgcttccagccctagctcttctccatctccacagcccgtttcagagcttgacttgtcctcagagccacagcagctcactgccaagggagctggttttccatccatcccagtcggcaagagccccatggtggagcaggctgtgcagactggttctgctgacaacctgaatgctaaaaagctgttacctggcaagggcaccacagggacgcagctcaacggtcgtcaggcccagccgagcagcaagacggccagcgatgtagtccagccggcagctgtgcaagctcaagggcaggtgaatgacgagaacagaagacctcagaggaggcgatcaggaaacaggcgaacaaggaatcgctccagagggcaaaaccgtccaactaacgttaaggaaaacacaatcaaatttgagggtgactttgatttcgagagtgcaaatgcccagttcaaccgagaggagcttgacaaagaatttaagaagaaactgaattttaaagatgacaaggctgagaagggggaagagaaggacctggctgtggtgacccagagtgccgaagcgcccgctgaggaagaccttctggggcccaactgctactatgacaaatccaagtcgttcttcgacaacatctcttctgaactcaagaccag

SEQ ID NO: 4767 - DNA, 1195 bp, Homo sapiens
aggtgccagctccgaggagcagggcggctcccgtcagcgggcctcctccccgccagcctggggggatccctgcgggggagcctcgagtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagtcttccctgggttctgcctccgcctcgcccttccagccgcacgtgccttacagccctttccgagggatggcgccctacggcccgctggcggccagctccctgctcagccagcagtatgccgcctccctgggtctagagaagttggtaagccctccagcctcagccgctgcttccagccctagctcttctccatctccacagcccgtttcagagcttgacttgtcctcagagccacagcagctcactgccaaggggtgccttttctgtttcagatctctgttcacttacacccagtcccacattgtcctgtttagagtccctacaggtcctggaaccttggaaagggaggagatggagagaggagctggttttccatccatcccagtcggcaagagccccatggtggagcaggctgtgcagactggttctgctgacaacctgaatgctaaaaagctgttacctggcaagggcaccacagggacgcagctcaacggtcgtcaggcccagccgagcagcaagacggccagcgatgtagtccagccggcagctgtgcaagctcaagggcaggtgaatgacgagaacagaagacctcagaggaggcgatcaggaaacaggcgaacaaggaatcgctccagagggcaaaaccgtccaactaacgttaaggaaaacacaatcaaatttgagggtgactttgatttcgagagtgcaaatgcccagttcaaccgagaggagcttgacaaagaatttaagaagagacccatactgctacttgtgttttggacttaactgaacttggacatggtctgagttagaaccacttgttttggggaagtattcatgggtaacctctttgaggtctctttatctgtgtttcctttttagttgcgcatagcctaattctaaggttttggtattttgcaaaaaggtttctatagtgaaagctg

SEQ ID NO: 4768 - DNA, 1079 bp, Homo sapiens
cctctcagagccccagtcgcgcgccccttcttggttcgctcggtgcccgcgcaggcccctcgggcggtggcgaggaggcgcccaggcggaggcggcggcgggcggaggagcgcaggagcgggcggccaggccaccgcgcggcggcggagcgggccgcggcccggcgctccttccccaccgcggcccgacgcaccccggccgccgccatgagcggctcctcaggcaccccgtatctgggcagcaagatcagcctcatctccaaggcgcagatccgctacgagggcattctctacaccatcgacaccgacaactccaccgtggcgctcgccaaagtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagtcttccctgggttctgcctccgcctcgcccttccagccgcacgtgccttacagccctttccgagggatggcgccctacggcccgctggcggccagctccctgctcagccagcagtatgccgcctccctgggtctagagaagttggtaagccctccagcctcagccgctgcttccagccctagctcttctccatctccacagcccgtttcagagcttgacttgtcctcagagccacagcagctcactgccaagggtaacagcagtttgggagaactgcatgctgtcttgcaaaccattctgagagcgaggggtaaagcagcagacagaatgacagtagctgtagcagatcatttgccaagcccatgcagccgctgagctgcttgttttgcttcagcatgtagtcctgattgatgaactctcagtgttaaagaagggattacgaagaatcagcggagtagtttgttctctctccctgggtccaggttctctgttgacctgtaccatgactaccacatacgggaaacttcactgttcacagaaagtcatttccctggggtttttgctgggtcctaaatgtgttcc

SEQ ID NO: 4769 - DNA, 1073 bp, Homo sapiens
cgccccttcttggttcgctcggtgcccgcgcaggcccctcgggcggtggcgaggaggcgcccaggcggaggcggcggcgggcggaggagcgcaggagcgggcggccaggccaccgcgcggcggcggagcgggccgcggcccggcgctccttccccaccgcggcccgacgcaccccggccgccgccatgagcggctcctcaggcaccccgtatctgggcagcaagatcagcctcatctccaaggcgcagatccgctacgagggcattctctacaccatcgacaccgacaactccaccgtggcgctcgccaaagtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagctgaacaagcgccctgatgaaggcgtgcggggtgatgggatggccttcgccgttctcacccgatgtctcgttgttcagtcttccctgggttctgcctccgcctcgcccttccagccgcacgtgccttacagccctttccgagggatggcgccctacggcccgctggcggccagctccctgctcagccagcagtatgccgcctccctgggtctaggagctggttttccatccatcccagtcggcaagagccccatggtggagcaggctgtgcagactggttctgctgacaacctgaatgctaaaaagctgttacctggcaagggcaccacagggacgcagctcaacggtcgtcaggcccagccgagcagcaagacggccagcgatgtagtccagccggcagctgtgcaagctcaagggcaggtgaatgacgagaacagaagacctcagaggaggcgatcaggaaacaggcgaacaaggaatcgctccagagggcaaaaccgtccaactaacgttaaggaaaacacaatcaaatttgagggtgactttgatttcgagagtgcaaatgcccagttcaaccgagaggagcttgacaaagaa

SEQ ID NO: 4770 - DNA, 2819 bp, Homo sapiens
cctctcagagccccagtcgcgcgccccttcttggttcgctcggtgcccgcgcaggcccctcgggcggtggcgaggaggcgcccaggcggaggcggcggcgggcggaggagcgcaggagcgggcggccaggccaccgcgcggcggcggagcgggccgcggcccggcgctccttccccaccgcggcccgacgcaccccggccgccgccatgagcggctcctcaggcaccccgtatctgggcagcaagatcagcctcatctccaaggcgcagatccgctacgagggcattctctacaccatcgacaccgacaactccaccgtggcgctcgccaaagtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagtcttccctgggttctgcctccgcctcgcccttccagccgcacgtgccttacagccctttccgagggatggcgccctacggcccgctggcggccagctccctgctcagccagcagtatgccgcctccctgggtctagagaagttggtaagccctccagcctcagccgctgcttccagccctagctcttctccatctccacagcccgtttcagagcttgacttgtcctcagagccacagcagctcactgccaaggggtgccttttctgtttcagatctctgttcacttacacccagtcccacattgtcctgtttagagtccctacaggtcctggaaccttggaaagggaggagatggagagaggagctggttttccatccatcccagtcggcaagagccccatggtggagcaggctgtgcagactggttctgctgacaacctgaatgctaaaaagctgttacctggcaagggcaccacagggacgcagctcaacggtcgtcaggcccagccgagcagcaagacggccagcgatgtagtccagccggcagctgtgcaagctcaagggcaggtgaatgacgagaacagaagacctcagaggaggcgatcaggaaacaggcgaacaaggaatcgctccagagggcaaaaccgtccaactaacgttaaggaaaacacaatcaaatttgagggtgactttgatttcgagagtgcaaatgcccagttcaaccgagaggagcttgacaaagaatttaagaagaaactgaattttaaagatgacaaggctgagaagggggaagagaaggacctggctgtggtgacccagagtgccgaagcgcccgctgaggaagaccttctggggcccaactgctactatgacaaatccaagtcgttcttcgacaacatctcttctgaactcaagaccagctccaggcggacgacgtgggccgaagagaggaagctcaacacagagacctttggggtgtcagggaggtttcttcgtggccgcagttctcggggcggattccgaggaggcaggggcaatgggaccacccgtcgcaaccccacttcccacagggccgggactggcagggtgtgagggtgcagccaaaggctcctactgaagtggcgcataactgacgctgtgtgtgtcaggacgcgaggaaaacgctgcacttacagggagaggtggtcactttgtttacggagtttggaagagacccatactgctacttgtgttttggacttaactgaacttggacatggtctgagttagaaccacttgttttggggaagtattcatgggtaacctctttgaggtctctttatctgtgtttcctttttagttgcgcatagcctaattctaaggttttggtattttgcaaaaaggtttctatagtgaaagctgaatccttactttgtgacttttttttttttttttaatgacaagctttgacttttaaaagtggaaccaaatctgttggcagaggtggcagccaagtacatctctgtaacccagctggcccctggtgctgttggcctggcaccccactgccaagggtggggtctcaggagtcaggcagggccagcacagggtggcgtggggggcaggggtgggtgggtggagggcacggaaggggttttcccatggatcatgttgtataagtgaaccagaccaccctgatggcatccacagtgatgtcaaggttggggctggccaggggtgggtggactagaagcatttgggagtagtggccaggggccctggacgctagccacggagctgctgcacagagcctggtgtccacaagcttccaggttggggttggagcctgggatgagccccggcagcgccttggcccttctgtggtccctgccagcctctgacctgggccggtcagtcattgctggactctggccacacactggcgttctcatccacttggaaacaagccagtcttttctgcaaggtcagttgaccaagagcatatttcccctctgttgtacatcgttgttttgtgtttgtgttgtaacagtgggtggagggagggtggggtctacatttgttgcatgagtcgatgggtcagaactttagtatacgcatgcgtcctctgagtgacagggcattttgtcgaaaataagcaccttggtaactaaacccctctaatagctataaaggctttagttctgtattgattaagttactgtaaaagcttgggtttatttttgtaggacttaatggctaagaattagaacatagcaagggggctcctctgttggagtaatgtaaattgtaattataaataaacatgcaaacctttaaaatttt

SEQ ID NO: 4771 - DNA, 2541 bp, Homo sapiens
ccgcgcaggcccctcgggcggtggcgaggaggcgcccaggcggaggcggcggcgggcggaggagcgcaggagcgggcggccaggccaccgcgcggcggcggagcgggccgcggcccggcgctccttccccaccgcggcccgacgcaccccggccgccgccatgagcggctcctcaggcaccccgtatctgggcagcaagatcagcctcatctccaaggcgcagatccgctacgagggcattctctacaccatcgacaccgacaactccaccgtggcgctcgccaaagtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagtcttccctgggttctgcctccgcctcgcccttccagccgcacgtgccttacagccctttccgagggatggcgccctacggcccgctggcggccagctccctgctcagccagcagtatgccgcctccctgggtctaggagctggttttccatccatcccagtcggcaagagccccatggtggagcaggctgtgcagactggttctgctgacaacctgaatgctaaaaagctgttacctggcaagggcaccacagggacgcagctcaacggtcgtcaggcccagccgagcagcaagacggccagcgatgtagtccagccggcagctgtgcaagctcaagggcaggtgaatgacgagaacagaagacctcagaggaggcgatcaggaaacaggcgaacaaggaatcgctccagagggcaaaaccgtccaactaacgttaaggaaaacacaatcaaatttgagggtgactttgatttcgagagtgcaaatgcccagttcaaccgagaggagcttgacaaagaatttaagaagaaactgaattttaaagatgacaaggctgagaagggggaagagaaggacctggctgtggtgacccagagtgccgaagcgcccgctgaggaagaccttctggggcccaactgctactatgacaaatccaagtcgttcttcgacaacatctcttctgaactcaagaccagctccaggcggacgacgtgggccgaagagaggaagctcaacacagagacctttggggtgtcagggaggtttcttcgtggccgcagttctcggggcggattccgaggaggcaggggcaatgggaccacccgtcgcaaccccacttcccacagggccgggactggcagggtgtgagggtgcagccaaaggctcctactgaagtggcgcataactgacgctgtgtgtgtcaggacgcgaggaaaacgctgcacttacagggagaggtggtcactttgtttacggagtttggaagagacccatactgctacttgtgttttggacttaactgaacttggacatggtctgagttagaaccacttgttttggggaagtattcatgggtaacctctttgaggtctctttatctgtgtttcctttttagttgcgcatagcctaattctaaggttttggtattttgcaaaaaggtttctatagtgaaagctgaatccttactttgtgacttttttttttttttttaatgacaagctttgacttttaaaagtggaaccaaatctgttggcagaggtggcagccaagtacatctctgtaacccagctggcccctggtgctgttggcctggcaccccactgccaagggtggggtctcaggagtcaggcagggccagcacagggtggcgtggggggcaggggtgggtgggtggagggcacggaaggggttttcccatggatcatgttgtataagtgaaccagaccaccctgatggcatccacagtgatgtcaaggttggggctggccaggggtgggtggactagaagcattagtggccaggggccctggacgctagccacggagctgctgcacagagcctggtgtccacaagcttccaggttggggttggagcctgggatgagccccggcagcgccttggcccttctgtggtccctgccagcctctgacctgggccggtcagtcattgctggactctggccacacactggcgttctcatccacttggaaacaagccagtcttttctgcaaggtcagttgaccaagagcatatttcccctctgttgtacatcgttgttttgtgtttgtgttgtaacagtgggtggagggagggtggggtctacatttgttgcatgagtcgatgggtcagaactttagtatacgcatgcgtcctctgagtgacagggcattttgtcgaaaataagcaccttggtaactaaacccctctaatagctataaaggctttagttctgtattgattaagttactgtaaaagcttgggtttatttttgtaggacttaatggctaagaattagaacatagcaagggggctcctctgttggagtaatgtaaattgtaattataaataaacatgcaaacctttaaaatttt

SEQ ID NO: 4772 - DNA, 1847 bp, Homo sapiens
ttatcgccgggtcctggggctgcacgtgtggtgaggcctacagaagcggccttcagctggaccttggtctccccgccggacttcgagggtgtcatcgccgcccctgttgggggtgagcgccgcgcggctgcagcatgcctcacaggaagaaaaagccctttatagagaagaagaaagctgtgtcttttcacttggtccaccggagccaacgagatcctttagcagcagatgagagtgcaccccagagggttctattgcccacacaaaaaatagacaatgaagaaaggcgagcagaacagaggaagtatggagtgttctttgatgacgactatgactacctgcagcacctgaaggaaccatctgggccttcagagcttattccctcaagtaccttcagtgcacacaacaggagagaggagaaagaagaaacgctagtaattccaagcactggaattaagttgccttcatcagtgtttgcttcagagtttgaggaagatgttggattgttaaataaagcagctccagtttcaggacctcgactggattttgatcctgacattgttgcagctcttgatgatgattttgactttgatgatccagataatctgcttgaggatgactttattcttcaggccaataaggcaacaggagaggaagagggaatggatatacagaaatctgagaatgaagatgacagcgagtgggaagatgtggatgatgagaagggagatagcaatgatgactatgactctgcaggcctattgtcagatgaagactgtatgtctgtgcccggaaaaactcacagagctatagcagatcacttgttctggagtgaggaaacaaagagtcgcttcacggagtattcgatgacttcctcagtcatgaggagaaatgaacagctgaccctacatgatgagaggtttgagaagttttatgagcaatatgatgatgatgaaattggagctctggataatgcagaattggaaggttctattcaagtggacagcaatcgcttacaggaagttttgaatgactactataaagagaaggcagagaattgtgtaaaattgaatacccttgaacccttggaggatcaagacctgccaatgaatgagcttgatgagtctgaggaggaagaaatgattactgtagtccttgaagaagccaaagagaagtgggattgtgaatctatttgtagtacatactcaaatttatataaccatccacagcttatcaagtatcaaccaaagcccaaacaaattcgaatatcttctaaaacaggaatacctctcaatgtcttaccaaagaaaggactcacagcaaagcaaactgaaagaatacagatgattaatggcagtgatcttcctaaagtatcaactcagccacgttctaaaaatgaaagcaaagaagataaaagagcaagaaagcaagctataaaagaagagcgcaaggaacgaagagtggagaagaaagctaacaaattagcatttaaactggagaaaagaaggcaagaaaaagagctgctgaacttgaagaagaatgttgagggtctaaagctatagacagtggagcatacagggcaaggcactttattaggggctcctcatctttggttattgactagaaacttcagaaagacaaaactgtttgccatttttactggcagataagaggaaaatacaatatttgtattatttttatactagtaagtgtcccctgccaaccatcttgtaaatattgtaatactttaatttttaatattataagcttacatttgctctgaagtaaatgacttcatgaatgtgaaatgtttgataaattaaaggaaaatatcttcataacgtgaa

SEQ ID NO: 4773 - DNA, 955 bp, Homo sapiens
gcttgaggccctgtggtccccatccttgggagaagtcagctccagcaccatgaagggcatcctcgttgctggtatcactgcagtgcttgttgcagctgtagaatctctgagctgcgtgcagtgtaattcatgggaaaaatcctgtgtcaacagcattgcctctgaatgtccctcacatgccaacaccagctgtatcagctcctcagccagctcctctctagagacaccagtcagattataccagaatatgttctgctcagcggagaactgcagtgaggagacacacattacagccttcactgtccacgtgtctgctgaagaacactttcattttgtaagccagtgctgccaaggaaaggaatgcagcaacaccagcgatgccctggaccctcccctgaagaacgtgtccagcaacgcagagtgccctgcttgttatgaatctaatggaacttcctgtcatgggaagccctggaaatgctatgaagaagaacagtgtgtctttctagttgcagaacttaagaatgacattgagtctaagagtctcgtgctgaaaggctgttccaacgtcagtaacgccacctgtcagttcctgtctggtgaaaacaagactcttggaggagtcatctttcgaaagtttgagtgtgcaaatgtaaacagcttaacccccacgtctgcaccaaccacttcccacaacgtgggctccaaagcttccctctacctcttggcccttgccagcctccttcttcggggactgctgccctgaggtcctggggctgcactttgcccagcaccccatttctgcttctctgaggtccagagcaccccctgcggtgctgacaccctctttccctgctctgccccgtttaactgcccagtaagtgggagtcacaggtctccaggcaatgccgacagctgccttgttcttcattattaaagcactggttcattcactgcc

SEQ ID NO: 4774 - DNA, 5650 bp, Homo sapiens
ccggccggaaggcttgcgccagctcaggatgaggacaggctgggcgacccctcgccgcccggcggggctcctcatgctgctcttctggttcttcgatctcgcggagccctctggccgcgcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatgagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctgaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaagaaaaagaaggcattgctaagattttctggattggtttaaatcagctatactctgctagaggctgggaatggtcagaccacaaaccattaaactttctcaactgggatccagacaggcccagtgcacctactataggtggctccagctgtgcaagaatggatgctgagtctggtctgtggcagagcttttcctgtgaagctcaactgccctatgtctgcaggaaaccattaaataatacagtggagttaacagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgaggatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagagctaggtcagtggaaagtccaatcatgtgaggagaaactaaaatatgtatgcaagagaaagggagaaaaactgaatgacgcaagttctgataagatgtgtcctccagatgagggctggaagagacatggagaaacctgttacaagatttatgaggatgaggtcccttttggaacaaactgcaatctgactatcactagcagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtattccatgcagaaagaattgtaagaaagaggaactgggaagaagctgaacgattctgccaagcccttggagcacacctttctagcttcagccatgtggatgaaataaaggaatttcttcactttttaacggaccagttcagtggccagcattggctgtggattggtttgaataaaaggagcccagatttacaaggatcctggcaatggagtgatcgtacaccagtgtctactattatcatgccaaatgagtttcagcaggattatgacatcagagactgtgctgctgtcaaggtatttcataggccatggcgaagaggctggcatttctatgatgatagagaatttatttatttgaggccttttgcttgtgatacaaaacttgaatgggtgtgccaaattccaaaaggccgtactccaaaaacaccagactggtacaatccagaccgtgctggaattcatggacctccacttataattgaaggaagtgaatattggtttgttgctgatcttcacctaaactatgaagaagccgtcctgtactgtgccagcaatcacagctttcttgcaactataacatcttttgtgggactaaaagccatcaaaaacaaaatagcaaatatatctggtgatggacagaagtggtggataagaattagcgagtggccaatagatgatcattttacatactcacgatatccatggcaccgctttcctgtgacatttggagaggaatgcttgtacatgtctgccaagacttggcttatcgacttaggtaaaccaacagactgtagtaccaagttgcccttcatctgtgaaaaatataatgtttcttcgttagagaaatacagcccagattctgcagctaaagtgcaatgttctgagcaatggattccttttcagaataagtgttttctaaagatcaaacccgtgtctctcacattttctcaagcaagcgatacctgtcactcctatggtggcacccttccttcagtgttgagccagattgaacaagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatttttttgaggaagagtctcgctaccactgtgccctaatactcaacctccaaaaatcaccgtttactgggacgtggaattttacatcctgcagtgaacgccactttgtgtctctctgtcagaaatattcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaaatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgaatccaaaatcacatattctgagtattcgagatgaaaaggagaataactttgttcttgagcaactgctgtacttcaattatatggcttcatgggtcatgttaggaataacttatagaaataagtctcttatgtggtttgataagaccccactgtcatatacacattggagagcaggaagaccaactataaaaaatgagaagtttttggctggtttaagtactgacggcttctgggatattcaaacctttaaagttattgaagaagcagtttattttcaccagcacagcattcttgcttgtaaaattgaaatggttgactacaaagaagaatataatactacactgccacagtttatgccatatgaagatggtatttacagtgttattcaaaaaaaggtaacatggtatgaagcattaaacatgtgttctcaaagtggaggtcacttggcaagcgttcacaaccaaaatggccagctctttctggaagatattgtaaaacgtgatggatttccactatgggttgggctctcaagtcatgatggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatgatcactctgcaactatcgtttccataaaagatgaagatgagaataaatttgtgagcagactgatgagggaaaataataacattaccatgagagtttggcttggattatctcaacattctgttgaccagtcttggagttggttagatggatcagaagtgacatttgtcaaatgggaaaataaaagtaagagtggtgttggaagatgtagcatgttgatagcttcaaatgaaacttggaaaaaagttgaatgtgaacatggttttggaagagttgtctgcaaagtgcctctggactgtccttcatctacttggattcagttccaagacagttgttacatttttctccaagaagccatcaaagtagaaagcatagaggatgtcagaaatcagtgtactgaccatggagcggacatgataagcatacataatgaagaagaaaatgcttttatactggatactttgaaaaagcaatggaaaggcccagatgatatcctactaggcatgttttatgacacagatgatgcgagtttcaagtggtttgataattcaaatatgacatttgataagtggacagaccaagatgatgatgaggatttagttgacacctgtgcttttctgcacatcaagacaggtgaatggaaaaaaggaaattgtgaagtttcttctgtggaaggaacactatgcaaaacagctatcccatacaaaaggaaatatttatcagataaccacattttaatatcagcattggtgattgctagcacggtaattttgacagttttgggagcaatcatttggttcctgtacaaaaaacattctgattctcgtttcaccacagttttttcaaccgcaccccaatcaccttataatgaagactgtgttttggtagttggagaagaaaatgaatatcctgttcaatttgactaa

SEQ ID NO: 4775 - DNA, 5482 bp, Homo sapiens
ccggccggaaggcttgcgccagctcaggatgaggacaggctgggcgacccctcgccgcccggcggggctcctcatgctgctcttctggttcttcgatctcgcggagccctctggccgcgcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatgagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctgaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaagaaaaagaaggcattgctaagattttctggattggtttaaatcagctatactctgctagaggctgggaatggtcagaccacaaaccattaaactttctcaactgggatccagacaggcccagtgcacctactataggtggctccagctgtgcaagaatggatgctgagtctggtctgtggcagagcttttcctgtgaagctcaactgccctatgtctgcaggaaaccattaaataatacagtggagttaacagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgaggatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagagctaggtcagtggaaagtccaatcatgtgaggagaaactaaaatatgtatgcaagagaaagggagaaaaactgaatgacgcaagttctgataagatgtgtcctccagatgagggctggaagagacatggagaaacctgttacaagatttatgaggatgaggtcccttttggaacaaactgcaatctgactatcactagcagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtattccatgcagaaagaattgtaagaaagaggaactgggaagaagctgaacgattctgccaagcccttggagcacacctttctagcttcagccatgtggatgaaataaaggaatttcttcactttttaacggaccagttcagtggccagcattggctgtggattggtttgaataaaaggagcccagatttacaaggatcctggcaatggagtgatcgtacaccagtgtctactattatcatgccaaatgagtttcagcaggattatgacatcagagactgtgctgctgtcaaggtatttcataggccatggcgaagaggctggcatttctatgatgatagagaatttatttatttgaggccttttgcttgtgatacaaaacttgaatgggtgtgccaaattccaaaaggccgtactccaaaaacaccagactggtacaatccagaccgtgctggaattcatggacctccacttataattgaaggaagtgaatattggtttgttgctgatcttcacctaaactatgaagaagccgtcctgtactgtgccagcaatcacagctttcttgcaactataacatcttttgtgggactaaaagccatcaaaaacaaaatagcaaatatatctggtgatggacagaagtggtggataagaattagcgagtggccaatagatgatcattttacatactcacgatatccatggcaccgctttcctgtgacatttggagaggaatgcttgtacatgtctgccaagacttggcttatcgacttaggtaaaccaacagactgtagtaccaagttgcccttcatctgtgaaaaatataatgtttcttcgttagagaaatacagcccagattctgcagctaaagtgcaatgttctgagcaatggattccttttcagaataagtgttttctaaagatcaaacccgtgtctctcacattttctcaagcaagcgatacctgtcactcctatggtggcacccttccttcagtgttgagccagattgaacaagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatttttttgaggaagagtctcgctaccactgtgccctaatactcaacctccaaaaatcaccgtttactgggacgtggaattttacatcctgcagtgaacgccactttgtgtctctctgtcagaaatattcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaaatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgaatccaaaatcacatattctgagtattcgagatgaaaaggagaataactttgttcttgagcaactgctgtacttcaattatatggcttcatgggtcatgttaggaataacttatagaaataagtctcttatgtggtttgataagaccccactgtcatatacacattggagagcaggaagaccaactataaaaaatgagaagtttttggctggtttaagtactgacggcttctgggatattcaaacctttaaagttattgaagaagcagtttattttcaccagcacagcattcttgcttgtaaaattgaaatggttgactacaaagaagaatataatactacactgccacagtttatgccatatgaagatggtatttacagtgttattcaaaaaaaggtaacatggtatgaagcattaaacatgtgttctcaaagtggaggtcacttggcaagcgttcacaaccaaaatggccagctctttctggaagatattgtaaaacgtgatggatttccactatgggttgggctctcaagtcatgatggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatgatcactctgcaactatcgtttccataaaagatgaagatgagaataaatttgtgagcagactgatgagggaaaataataacattaccatgagagtttggcttggattatctcaacattctgttgactgtccttcatctacttggattcagttccaagacagttgttacatttttctccaagaagccatcaaagtagaaagcatagaggatgtcagaaatcagtgtactgaccatggagcggacatgataagcatacataatgaagaagaaaatgcttttatactggatactttgaaaaagcaatggaaaggcccagatgatatcctactaggcatgttttatgacacagatgatgcgagtttcaagtggtttgataattcaaatatgacatttgataagtggacagaccaagatgatgatgaggatttagttgacacctgtgcttttctgcacatcaagacaggtgaatggaaaaaaggaaattgtgaagtttcttctgtggaaggaacactatgcaaaacagctatcccatacaaaaggaaatatttatcagataaccacattttaatatcagcattggtgattgctagcacggtaattttgacagttttgggagcaatcatttggttcctgtacaaaaaacattctgattctcgtttcaccacagttttttcaaccgcaccccaatcaccttataatgaagactgtgttttggtagttggagaagaaaatgaatatcctgttcaatttgactaa

SEQ ID NO: 4776 - DNA, 2671 bp, Homo sapiens
gagttatcagaggtgagcccgtgctcttcagcggagaagatcccctacctggccgccggccactttctgtgggccgtggggtcctcaaggagacggcccttgggctcaggggctgcgtttccacacgcgcctttcccagggctcccgcgcccgttcctgcctggccgccggccgctccaacagcagcacaaggcgggactcagaaccggcgttcagggccgccagcggccgcgaggccctgagatgaggctccaaagaccccgacaggccccggcgggtgggaggcgcgcgccccggggcgggcggggctccccctaccggccagacccggggagaggcgcgcggaggctgcgaaggttccagaagggcggggagggggcgccgcgcgctgaccctccctgggcaccgctggggacgatggcgctgctcgccttgctgctggtcgtggccctaccgcgggtgtggacagacgccaacctgactgcgagacaacgagatccagaggactcccagcgaacggacgagggtgacaatagagtgtggtgtcatgtttgtgagagagaaaacactttcgagtgccagaacccaaggaggtgcaaatggacagagccatactgcgttatagcggccgtgaaaatatttccacgttttttcatggttgcgaagcagtgctccgctggttgtgcagcgatggagagacccaagccagaggagaagcggtttctcctggaagagcccatgcccttcttttacctcaagtgttgtaaaattcgctactgcaatttagaggggccacctatcaactcatcagtgttcaaagaatatgctgggagcatgggtgagagctgtggtgggctgtggctggccatcctcctgctgctggcctccattgcagccggcctcagcctgtcttgagccacgggactgccacagactgagccttccggagcatggactcgctccagaccgttgtcacctgttgcattaaacttgttttctgttgattacctcttggtttgacttcccagggtcttgggatgggagagtggggatcaggtgcagttggctcttaaccctcaagggttctttaactcacattcagaggaagtccagatctcctgagtagtgattttggtgacaagtttttctctttgaaatcaaaccttgtaactcatttattgctgatggccactcttttccttgactcccctctgcctctgagggcttcagtattgatggggagggaggcctaagtaccactcatggagagtatgtgctgagatgcttccgacctttcaggtgacgcaggaacactgggggagtctgaatgattggggtgaagacatccctggagtgaaggactcctcagcatggggggcagtggggcacacgttagggctgcccccattccagtggtggaggcgctgtggatggctgcttttcctcaacctttcctaccagattccaggaggcagaagataactaattgtgttgaagaaacttagacttcacccaccagctggcacaggtgcacagattcataaattcccacacgtgtgtgttcaacatctgaaacttaggccaagtagagagcatcagggtaaatggcgttcatttctctgttaagatgcagccatccatggggagctgagaaatcagactcaaagttccaccaaaaacaaatacaaggggacttcaaaagttcacgaaaaaattgaattaaaagataaaaattaaaaaatgttttatttctcagcatgagctccatcaaggtcgagacgcttctgcaagtaatggtaccagccattcagttcatccctaaagaattgggcaccctgggaatttaaccatgccacttcagtctttgtgacgttattaactgaagaaaagtgggtgccctttaaagattttttaaaattataaaacagaagtaaccaaatcaggcctggaaggtgtatgcctagtgatttcccattgaaactctcacaaaactggccttgtttgatgagaggaatgagcaggagcattgtcatggtggagaagggctctctggtgaagctttccggggtgacgatttcctgggtgttttcctgctaaatcgttggctgactttctctatacactctcataataagatgttactgttctttggccctccagaaagtcaataagcaagatgccttgagcattcacaaaacggttgccacgacctttgcccttgacatgtctgcttttactctgatgggaccacgcccacctctaggtagtcattgctttgcttgtgctttgccttcaggagtgtactggttaagccacatttcatctccggctataattatatgaagaaatgcttcaggatcttgattccacttgtttaaaatggccatagaacgcttttctcttatctgcagctgagctgggagaaagttttggcacccaccgagtggacagtttactcaactttaatttcagtcagaattgtgtaagctgaacaccttgggatacctacagcgttggctattgtttctgctgctattaatcagtcctcttaaattagggcacaaacaagatgaattgtttcctcacagactgatgtggctggcctgctgctgtggacttcctctccaacatcatctcttctcttcttccaatgagttatccacttacttaa

SEQ ID NO: 4777 - DNA, 1903 bp, Homo sapiens
gactttggttactgtcctcgtgtgtactgtgagaaccagccaatgcttcccattggtgtgctggtcatggtgggcttcacagtaggaaaggttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgtgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctggctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 4778 - DNA, 807 bp, Homo sapiens
gactttggttactgtcctcgtgtgtactgtgagaaccagccaatgcttcccattggtgtgctggtcatggtgggcttcacagtaggaaaggttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgttt

SEQ ID NO: 4779 - DNA, 1264 bp, Homo sapiens
cttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccagttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatc

SEQ ID NO: 4780 - DNA, 807 bp, Homo sapiens; identical to SEQ ID NO: 4778

SEQ ID NO: 4781 - DNA, 1903 bp, Homo sapiens; identical to SEQ ID NO: 4777

SEQ ID NO: 4782 - DNA, 1270 bp, Homo sapiens
cttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccagttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcac

SEQ ID NO: 4783 - DNA, 1870 bp, Homo sapiens
atgaaggtccatatgcttgtaggtgtgctggtcatggtgggcttcacagtaggaaaggttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgtgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctggctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 4784 - DNA, 1870 bp, Homo sapiens; identical to SEQ ID NO: 4783

SEQ ID NO: 4785 - DNA, 501 bp, Homo sapiens
atgggcacctccagcatcttcctctgcgtgctgttcctctgtggggcactgggtctcaccatgtcccctgcccggggaaggctccgctgctacatctgtggcttcaccaaaccctgccaccctgttcccaccgagtgtcgggacgatgaagcttgtggcatcagtattggcacttcaggtaggactctggtccaatggcccttctccaggaggctccctacctccatccatccggcctttcctgtggcccccgcctcagcatgcctctttcatcccacagaccagagtgagatcactgagtgaaaaagctgcctctcaagggcccagtgccctctgccaggctatgccacctactggctgcactcctacactctgtggcaccactgctgcgagcaggacctgtgcaacatagccgcttccccacagcagctcaccagcctcctcgcctccctgcccctctttgtggccagcttcgctgggagaggacacctcctccactag

SEQ ID NO: 4786 - DNA, 383 bp, Homo sapiens
atgggcacctccagcatcttcctctgcgtgctgttcctctgtggggcactgggtctcaccatgtcccctgcccggggaaggctccgctgctacatctgtggcttcaccaaaccctgccaccctgttcccaccgagtgtcgggacgatgaagcttgtggcatcagtattggcacttcaggaaaaagctgcctctcaagggcccagtgccctctgccaggctatgccacctactggctgcactcctacactctgtggcaccactgctgcgagcaggacctgtgcaacatagccgcttccccacagcagctcaccagcctcctcgcctccctgcccctctttgtggccagcttcgctgggagaggacacctcctccactagcttcc

SEQ ID NO: 4787 - DNA, 501 bp, Homo sapiens; identical to SEQ ID NO: 4785

SEQ ID NO: 4788 - DNA, 399 bp, Homo sapiens
atgggcacctccagcatcttcctctgcgtgctgttcctctgtggggcactgggtctcaccatgtcccctgcccggggaaggctccgctgctacatctgtggcttcaccaaaccctgccaccctgttcccaccgagtgtcgggacgatgaagcttgtggcatcagtattggcacttcagaccagagtgagatcactgagtgaaaaagctgcctctcaagggcccagtgccctctgccaggctatgccacctactggctgcactcctacactctgtggcaccactgctgcgagcaggacctgtgcaacatagccgcttccccacagcagctcaccagcctcctcgcctccctgcccctctttgtggccagcttcgctgggagaggacacctcctccactag

SEQ ID NO: 4789 - DNA, 399 bp, Homo sapiens; identical to SEQ ID NO: 4788

SEQ ID NO: 4790 - DNA, 399 bp, Homo sapiens; identical to SEQ ID NO: 4788

SEQ ID NO: 4791 - DNA, 501 bp, Homo sapiens; identical to SEQ ID NO: 4785

SEQ ID NO: 4792 - DNA, 501 bp, Homo sapiens; identical to SEQ ID NO: 4785

SEQ ID NO: 4793 - DNA, 399 bp, Homo sapiens; identical to SEQ ID NO: 4788

SEQ ID NO: 4794 - DNA, 399 bp, Homo sapiens; identical to SEQ ID NO: 4788

SEQ ID NO: 4795 - DNA, 501 bp, Homo sapiens; identical to SEQ ID NO: 4785

SEQ ID NO: 4796 - DNA, 399 bp, Homo sapiens; identical to SEQ ID NO: 4788

SEQ ID NO: 4797 - DNA, 501 bp, Homo sapiens; identical to SEQ ID NO: 4785

SEQ ID NO: 4798 - DNA, 384 bp, Homo sapiens
atgggcacctccagcatcttcctctgcgtgctgttcctctgtggggcactgggtctcaccatgtcccctgcccggggaaggctccgctgctacatctgtggcttcaccaaaccctgccaccctgttcccaccgagtgtcgggacgatgaagcttgtggcatcagtattggcacttcagtgaaaaagctgcctctcaagggcccagtgccctctgccaggctatgccacctactggctgcactcctacactctgtggcaccactgctgcgagcaggacctgtgcaacatagccgcttccccacagcagctcaccagcctcctcgcctccctgcccctctttgtggccagcttcgctgggagaggacacctcctccactagcttcc

SEQ ID NO: 4799 - DNA, 383 bp, Homo sapiens; identical to SEQ ID NO: 4786

SEQ ID NO: 4800 - DNA, 383 bp, Homo sapiens; identical to SEQ ID NO: 4786

SEQ ID NO: 4801 - DNA, 383 bp, Homo sapiens; identical to SEQ ID NO: 4786

SEQ ID NO: 4802 - DNA, 383 bp, Homo sapiens; identical to SEQ ID NO: 4786

SEQ ID NO: 4803 - DNA, 383 bp, Homo sapiens; identical to SEQ ID NO: 4786

SEQ ID NO: 4804 - DNA, 383 bp, Homo sapiens; identical to SEQ ID NO: 4786

SEQ ID NO: 4805 - DNA, 920 bp, Homo sapiens
gagaacttggcaggctctccccatggcagtcttattcctcctcctgttcctatgtggaactccccaggctgcagacaacatgcaggccatctatgtggccttgggggaggcagtagagctgccatgtccctcaccacctactctacatggggacgaacacctgtcatggttctgcagccctgcagcaggctccttcaccaccctggtagcccaagtccaagtgggcaggccagccccagaccctggaaaaccaggaagggaatccaggctcagactgctggggaactattctttgtggttggagggatccaaagaggaagatgccgggcggtactggtgcactgtgctaggtcagcaccacaactaccagaactggagggtgtacgacgtcttggtgctcaaaggatcccagttatctgcaagggctgcagatggatccccctgcaatgtcctcctgtgctctgtggtccccagcagacgcatggactctgtgacctggcaggaagggaagggtcccgtgaggggccgtgttcagtccttctggggcagtgaggctgccctgctcttggtgtgtcctggggaggggctttctgagcccaggagccgaagaccaagaatcatccgctgcctcatgactcacaacaaaggggtcagctttagcctggcagcctccatcgatgcttctcctgccctctgtgccccttccacgggctgggacatgccttggattctgatgctgctgctcacaatgggccagggagttgtcatcctggccctcagcatcgtgctctggaggcagagggtccgtggggctccaggcagagatgcctcgattcctcagttcaaacccgaaatccaggtctatgagaacatccatttggcccgtcttggcccacctgcccacaagcccaggtgatttt

SEQ ID NO: 4806 - DNA, 920 bp, Homo sapiens; identical to SEQ ID NO: 4805

SEQ ID NO: 4807 - DNA, 1193 bp, Homo sapiens
gggacaccaggtcttggagcaagagaacttggcaggctctccccatggcagtcttattcctcctcctgttcctatgtggaactccccaggctgcagacaacatgcaggccatctatgtggccttgggggaggcagtagagctgccatgtccctcaccacctactctacatggggacgaacacctgtcatggttctgcagccctgcagcaggctccttcaccaccctggtagcccaagtccaagtgggcaggccagccccagaccctggaaaaccaggaagggaatccaggctcagactgctggggaactattctttgtggttggagggatccaaagaggaagatgccgggcggtactggtgcactgtgctaggtcagcaccacaactaccagaactggagggtgtacgacgtcttggtgctcaaaggatcccagttatctgcaagggctgcagatggatccccctgcaatgtcctcctgtgctctgtggtccccagcagacgcatggactctgtgacctggcaggaagggaagggtcccgtgaggggccgtgttcagtccttctggggcagtgaggctgccctgctcttggtgtgtcctggggaggggctttctgagcccaggagccgaagaccaagaatcatccgctgcctcatgactcacaacaaaggggtcagctttagcctggcagcctccatcgatgcttctcctgccctctgtgccccttccacgggctgggacatgccttggattctgatgctgctgctcacaatgggccagggagttgtcatcctggccctcagcatcgtgctctggaggcagagggtccgtggggctccaggcagaggaaaccgaatgcggtgctacaactgtggtggaagccccagcagtacttgcaaagaggccgtgaccacctgtggcgagggcagaccccagccaggcctggaacagatcaagctacctggaaaccccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatag

SEQ ID NO: 4808 - DNA, 1629 bp, Homo sapiens
gaactaatacagtatagtttcttgttcttcagaagcttacagtcagcaaggaacagaaagccaaataaagtaggaaagggctcaggcctgtaggcattctcccctctgtggcttggtgccctcgccagaccatggctgatgtcagagctggtttcctagtgattgcccctcagggtcttcctgcttttctaccctaccctgccggtgagggacacctactcatgcaccacttgaagttgagttccagaaagaagacgccagggatgaggctggacagagggtctcacggatggccccgctgccaggagcagaactggttcggaggccactgcagctctaccgatacttgctgcgctgttgccagcagctgccgaccaagggcatccagcagcattacaagcatgctgtcaggcagagttttcgggttcattcagatgaagacaaccctgagagaatccagcagattattaaaagagccattgaagatgctgactggatcatgaacaaatataaaaaacaaaactgagagctccgagggtgagccttcctggcctctggaagttgagaggcccctcttctggagctcagcagcagcagctggtttggaagagccattggccttgttggctgaaagccagaaatcaggggagaagctgaccttgctccagaggctcctcttgccgcggccatgttgctagcatcctttatgtttgcacttccagccacttacgatgtgaaatttggggagaatgtagtatttttttgcttcttttgtgtgttttttatttttgtgtttttgttcttttacttttctctgaaagtgattcatttattctggagatctctttatcattctctgagtcccagagcagatgtcccctcaggtagcaacctgtacagaagaaagcacgtgggttttagaaccagacagatctggatttgaatcccagatgcaataagatgaaggtgaagtgcctcacacaggatgtggcacatgacagtgcctgaagggctcccttcaaggaagccgtcctgccccgccccctcctctgctcctgcagcgccctgcacagctctgctccccgcatgcaccgcatcgggtctcagttttttgtttgcgagcttgccctgtccctgcttgtagcccctgagccctcacagttgtcacacacccagcagtctgccaaggagctgcttttcctgactactgtctctccatgcctagggaagtcaaagccctgggccttgccttcagggagttgacagtgtccttgaagtggtgaagtgcccaccacatgaaccaaggagagacgccaaagcagctgccatggactctggcctgtccaagcctctgtgcacctgcagtctctttccactggcacttccctgctttgctaccatcgtggaagaatggaagggagggggagaaggtgggtgggctcagggagaacggccagagtggccagaagatgcagagagaagccccactgggatctgagtattccccaagggcactcagccacagggatgaactagtgtttgtttgtatccttgcagttatgtgacttaaagtgactcagagatatctatgtatgcgagtgtactccgctggcaatgaagtaaatatat

SEQ ID NO: 4809 - DNA, 2974 bp, Homo sapiens
aaggggcggggccgaagcggcccagggggcgggcgtttgaaatcagtgccttagagtagaccctaaacctcattttataccttcaagaaccaattacttaatgtctcttccgtcttttccgtccccgaccccctcccagactccttcattccggtactgcgtggacggaaagccccgggtagccgacaccacgtccccggctagcgggagagagcgtggaaaaggattacaccaaactgtttaaatccaacgactcctgcttccatcctttctcctgagctagaaccaacaaacctagagagttgggcttcggaaaaactagtgttttcatttaattggatatgaagaaagaacaaatatgtacggggcaaccacgatctttacaaagaacataagttccaggaaagcaggaaccttgtctctcttgttcactgggtgtatcctctgcatatagaacagtgcctggcacataataggtgctgaattttgttctaaacactgaggacattctctgctacatttgggtcgtacccccaggtctgagtaattcaatagacttaagaagacagagcccagcagcaaccgaaacataacagagttgcaggatcagctaacgtcaatgcctgggcaaagctgctgcccagagtggaatctcactagtgaataaacaagcccaagaaagattatcatctcatttgcaaaaaaaaaagtacgctggtagatcctgctacctcatagataacaccagtcaaatttttttttaaagtagcattttcctacattgtcaactatctagaacatacctaaaaactaagagtttactgcttattaaatggaaactatgaagtctaaggccaactgtgcccagaatccaaattgtaacataatgatatttcatccaaccaaagaagagtttaatgattttgataaatatattgcttacatggaatcccaaggtgcacacagagctggcttggctaagataattccacccaaagaatggaaagccagagagacctatgataatatcagtgaaatcttaatagccactcccctccagcaggtggcctctgggcgggcaggggtgtttactcaataccataaaaaaaagaaagccatgactgtgggggagtatcgccatttggcaaacagtaaaaaatatcagactccaccacaccagaatttcgaagatttggagcgaaaatactggaagaaccgcatctataattcaccgatttatggtgctgacatcagtggctccttgtttgatgaaaacactaaacaatggaatcttgggcacctgggaacaattcaggacctgctggaaaaggaatgtggggttgtcatagaaggcgtcaatacaccctacttgtactttggcatgtggaaaaccacgtttgcttggcatacagaggacatggacctttacagcatcaactacctgcaccttggggagcccaaaacttggtatgtggtgcccccagaacatggccagcgcctggaacgcctggccagggagctcttcccaggcagttcccggggttgtggggccttcctgcggcacaaggtggccctcatctcgcctacagttctcaaggaaaatgggattcccttcaatcgcataactcaggaggctggagagttcatggtgacctttccctatggctaccatgctggcttcaaccatggtttcaactgcgcagaggccatcaattttgccactccgcgatggattgattatggcaaaatggcctcccagtgtagctgtggggaggcaagggtgaccttttccatggatgccttcgtgcgcatcctgcaacctgaacgctatgacctgtggaaacgtgggcaagaccgggcagttgtggaccacatggagcccagggtaccagccagccaagagctgagcacccagaaggaagtccagttacccaggagagcagcgctgggcctgagacaactcccttcccactgggcccggcattccccttggcctatggctgcccgcagtgggacacggtgccacacccttgtgtgctcttcactcccacgccgatctgcagttagtggcactgctacgcagccccgggctgctgctgtccacagctctaagaagcccagctcaactccatcatccacccctggtccatctgcacagattatccacccgtcaaatggcagacgtggtcgtggtcgccctcctcagaaactgagagctcaggagctgaccctccagactccagccaagaggcccctcttggcgggcacaacatgcacagcttcgggcccagaacctgagcccctacctgaggatggggctttgatggacaagcctgtaccactgagcccagggctccagcatcctgtcaaggcttctgggtgcagctgggcccctgtgccctaagtccacgggctgtctttatatcccactgccctgctgtgtgacagtttgatgaaactggttacatttacatcccaaaactttggttgagtttgcaggactctaggcatgcatgaaagagcccccctggtgatgcccttggatgctgccaagtccatggtagttttcaattttgccatacttttgttcttcctaccggaccctggaatgtctttggatattgctaaaatctatttctgcagctgaggttttatccactggacacatttgtgtgtgagaactaggtcttgttgaggttagcgtaacctggtatatgcaactaccatcctctgggccaactgtggaagctgctgcacttgtgaagaatcctgagctttgattcctcttcagtctacgcatttctctcttcccctccctcaccccctttttcttataaaactaggttctttatacagataaggtcagtagagttccagaataaaagatatgacttttctgagttatttatgtacttaaaatatgttgtcacagtatttgttcccaaatatattaaaggtaaccaaaatgttaaaa

SEQ ID NO: 4810 - DNA, 1753 bp, Homo sapiens
tgttcctgcctctccgccacctccaccgcggcttatcccctggctggcggcgttggcggggcgggggacagtagttgtagacgcccgcccctgcctcagagaagataccacattgaatgaacaaagactgaactttgtttacagataccttttataaaagatgtctgtggagtagtgttacagttcaaataacaaaggattttgcattatgagatgagtgagagtggagaattggacaaaaattgatttttgatctctgaattgtggtttttagctcaccagttattgtgtagtctcactatttgaaaattcatgctgaaaaactgagtgaatatgatcagatttctccaccaaattctcagcctgataaggaaaatcccgttttgtcaacctaatgaagcattcaaagaagacatatgactcttttcaagatgaacttgaagattatattaaagtacagaaagccagaggcttagagccaaagacttgtttcagaaagatgaaaggggactatttggaaacctgtgggtacaaaggagaggttaattccagacccacgtatagaatgtttgaccagagactcccatctgaaaccatccagacctacccaagatcatgcaatattccacaaacagtggaaaatcggttgcctcagtggttaccagcccatgacagcagattgagactagactctctgagctactgtcagttcacgagggactgtttctcagaaaaaccagtacccctgaactttaatcaacaagaatatatttgtggctcacatggtgtagaacatagagtttacaagcacttctcctcagataacagtaccagtactcatcaagccagtcacaaacagatacatcagaagaggaaaaggcacccagaggaaggcagagaaaaatcagaggaggagcggtctaagcataagagaaaaaaaagctgcgaggaaattgacttagacaaacacaagagcatccaaagaaagaaaacagaggtggaaatagaaaccgtacatgtcagtacagaaaagcttaagaatcgaaaggagaaaaaaagccgagatgtagtctctaagaaagaggaacgtaagcgtacaaaaaagaaaaaggaacaaggccaagaaaggacagaggaggaaatgctttgggaccagtctattcttggattttgaagctttcaaagttggttctcccaaagttaaattgaaaaaataggtgagagcttggttttatgatatccgtgttcataccacttttcttatgtgaataggttctttaacttctaacaaaggcctagtaaacaaagtgtttagcatgcttgctctccaacacagaaattgcttttcctcattttctaaaagcattattacattttttgaacatatagtgtaatttcctttaatgaaagtgactctgcttttattcatcaaattgctttgatggtggaaatattttctgttgggaggttatttattttaaattggaggattaatgacctttgcacaatctgtttcttgattgggtttgttatagttttgagttgggtattttatgttcattggtttttctctgtgaagcaatttttttctcctttattagatctaacttgcagtgtattttctaggctggaaagtggaaaatgaaatatattataatcttaggttacataaagtttctaaagtttcaaagagtcttgatacaaaatcagtttatattctgaaaatatttataataaagtattctaatttcta

SEQ ID NO: 4811 - DNA, 2479 bp, Homo sapiens
cttttgggaaatgaagtcttttctcaaagaccttgccgctcaactggatccaggcccttgcatcttggcggatctgaggcgtttggagggacaacaacctagatgtggagccgaaatttgagggtgtgacctatcttatgcggagcggacctttgaggatctctgagtggaaggtgtactacaaattcttgcaatcctcacgctcttcgtctgcggcgacagttcacctggggtgggcctgatttgttcctgactctagcaaacaaaccccgggaccggggagagctgggatgttggagcgccctgaggccaggctacttgggggcaaactgaggaaagagtgttgaggattatttctagagttcaaaggtcagaggtcaatgtagcgaggagttgtgggggagtccaaagtcggaggggtgcttaggggagaattagggagggactgaatactcaagggacagatttgtggataagtagcttggagggaggagaaaccgggagggggcagatggcgtagtgctggggaggcggggacacaggggaagagagagggggaaaggaatcccctgaatattcattcccagacttcaggcctgtcagtcgcagtctcggtcgtacctcccctagttgcaaccttagctgttggcagggtgaagagatggcttccccgtctagacagcccccgccaggggggtcaggactgcttcaagggagccgggctcgttcatatggaagcctggtgcaatcggcctgctccccagtgagggaaagacgcctggagcatcagttggagcccggagacaccctggctggactagcactcaaatatggggtgacgatggaacagattaaacgtgcaaaccgcctttatactaatgactccatcttcctgaagaaaaccctctacatccccatcctgacagagcccagagacctgttcaatggtttggactctgaggaagagaaagatggagaggaaaaagtacacccaagtaacagtgaagtttggccacactcaactgagaggaagaaacaagagacaggagcaggacgtgccaatggtgaagtcctccccacacctggccaggaaacccccacgcccatccatgacctctctgcctctgatttccttaagaagcttgattcacagatcagcctgtccaagaaggctgctgctcagaagctgaaaaaaggggaaaatggggtacctggggaggatgcaggtctccacctgagctccccttggatgcagcaacgagcagtcctaggtcctgtgccgctgacccgtacctctcggacccggacactacgggaccaggaggatgaaatcttcaaactctgatgtccccagaactgactgagagaagcaagatgttgaaagagaaacttcagggggagaggagcctgaggtgaggctcaagaacatggcttatgagcctgcctccctccactccagccatcctccccagcctccttgtctgccaaaaattccttggcctggggcagttttattggcaagattagggaatgggaactggacctttcccagttcttgggctgaatctagagttgagtcctttagactcaaaaggctctttttatatccttgttgcctttcctatcctttttacctttccctggccttagaacagggaagcagagactccccctcagcttcttcctcatctccaactatgtgacataatttatttggtgctaatattgaagtaatatttatttgctatattttatttcttcccactcttagctgaaaaatggaatttctatagccctggggtgaggagaacccgggaacagtgagccagtgactgctggttctccactttccccaccttgttagccaaacatgttattgaggatgaggcaatcggtgatatagcccaccacagagaatggatgactgttggccttttctccaatctcaaagtgacagatttgggctgattctttttttttttttttttggtaccccattcctgttgaatgggctcagtcttgacaaaccaattccctgtaactttttcacaattcttgactctgagaaaaagcagcactgtagggacctgaactctccattctaccagttcacccttctgacctgttctgctcagcctgtggtgaggggaacagatggaagaaggctttccttggggtttgaagaggaagccagttgtgggagtctctttgttacaccccctcccctccagaccctctctctctatgccttcctcctcactgcatatttatttgcgatttgtagcactgatctatggtacagttgttttgtttcttaaacagaagtaggtaagggaacctcagtaataatggaaatctgcctcagtctcctgtttggaaatgatgagaggtgagataagtaatgtttatatacctcctttcttctgtgatgattataaggtatacgaagctggacagattaaacattgagccctgtgca

SEQ ID NO: 4812 - DNA, 1003 bp, Homo sapiens
ggtgccctgcgactccgcagacgcggagccttttgggaaatgaagtcttttctcaaagaccttgccgctcaactggatccaggcccttgcatcttggcggatctgaggcgtttggagggacaacaacctagatgtggagccgaaatttgagggtgtgacctatcttatgcggagcggacctttgaggatctctgagtggaagatggaacagattaaacgtgcaaaccgcctttatactaatgactccatcttcctgaagaaaaccctctacatccccatcctgacagagcccagagacctgttcaatggtttggactctgaggaagagaaagatggagaggaaaaagtacacccaagtaacagtgaagtttggccacactcaactgagaggaagaaacaagagacaggagcaggacgtgccaatggtgaagtcctccccacacctggccaggaaacccccacgcccatccatgacctctctgcctctgatttccttaagaagcttgattcacagatcagcctgtccaagaaggctgctgctcagaagctgaaaaaaggggaaaatggggtacctggggaggatgcaggtctccacctgagctccccttggatgcagcaacgagcagtcctaggtcctgtgccgctgacccgtacctctcggacccggacactacgggaccaggaggatgaaatcttcaaactctgatgtccccagaactgactgagagaagcaagatgttgaaagagaaacttcagggggagaggagcctgaggtgaggctcaagaacatggcttatgagcctgcctccctccactccagccatcctccccagcctccttgtctgccaaaaattccttggcctggggcagttttattggcaagattagggaatgggaactggacctttcccagttcttgggctgaatctagagttgagtcctttagactcaaaaggctctttttatatccttgttgcctttcctatcctttttacctttccct

SEQ ID NO: 4813 - DNA, 1759 bp, Homo sapiens
ggaagtacccttggcattggcagagctggaaggtctgtgcaagctggctcctgctggggaatcaataaaggaggcagagcaacgctttttttttttttcgccgtggccagggcagggttctgccagggctctatcgccaatggagcaggggtccacctggggcctaggacgcctgcagatagccctctcttagccccaacggccgcgggcttcagcgctccccggctccctcgctctgcagggtcttcccggtaccggcaggccgcggcgggagctgctttcgctcttaaccttgcaggtgcgtgtgccgcgggcgcccggggcaggcaggacgcagaggaggaggcgcccgccatgcccggcctgcggctccccgcctcggcttcccgtccgccgcccccgcggaacggcctgctgcagcccctgtgaagaggaagaggcggcggcggcggcggaggaggaggaggcgccgcccccttggcaagctccccgacccggcggcctcggcaggacccatggcggattcctcgcccgcactgtccctgcgggaaggcggcccccgcgcgccgcggccctcggccccctcgccgccgccgcgctcgcgctccggctccgagtccgaggaggccgagctgtcgctgagcctggcccgcaccaagacccgctcgtacggcagcaccgccagcgtgcgggcgccgctgggcgccggcgtcatcgagcgccatgtggagcaccgggtccgcgcgggcgacacgctgcagggcatcgcgctcaagtacggtgtcacgatggaacagattaaaagggccaataaactgtttaccaatgattgtatatttctgaagaaaactttgaacatcccagttatatcagagaagcctttgttgtttaatggacttaactccattgattctccagaaaatgaaactgctgataacagtttttctcaggaagaggagccagtggtggccggggaagacctccctcctcccagtcctcaagaatctgatgttcagcctgtgcagcctgaggaagtgtcagccagagatttcctgcagagacttgacttgcagattaagttatcaacacaggcagccaagaagctaaaagaagagagcagagatgaagaaagtccctatgcaacttccctctatcacagttaggtgatttgggggcataactctaaccaaaattaagatatgtttggaccataaagaatccaacaactgaagattcaaaaacatcccttctggattcctatagtgtccatcttaaaatcataactaggtagttctacctgctgcagttgcactgaagtgattagttccctctggctttctataattttaagtctttattatggcatgatggcaaggttgtagcctaaagctcatcacttttgtaggtggtgttagtttttagactagcttttataaatactaattgacataaagcatcaaagattatttatatatttaggctaaaaataatgtttatctccttatgcaatcctgattatgtgaaaatatggttgctgtttaagtgatgctgaatttgctgtgtgtttataacttaagtgctatatatatatttcgatatgtcttacatattctctattaatataaagaaccaaattttgtctgctattttgtaaaaataaactacaaaagcctgaatgagaaaataaactatgttttcaaacttgagtctcctttttttttttaacaaatgagaaaataaaattgacttttaaattata

SEQ ID NO: 4814 - DNA, 1228 bp, Homo sapiens
ggccgggcgcggcgccggggcgcgcggctgcagcggagcaggctgggaagcgtagttcccggctgagcctcgccgcggccccgcagtcccccagccccgcccttccccgacaggtgtcctctcccggaatcggggtctgaaccccgccacagctctgcaggggaggaagcacctgggtcggggagaagcctgggcaggctctttggagacgctcggggctccggagagcgtggatggcaaaggctttcaagcctgtgatgagcattcctgtgagcgagcatcctgacacggaagccgcgttgagagcggtctcagatggaacagattaaaagggccaataaactgtttaccaatgattgtatatttctgaagaaaactttgaacatcccagttatatcagagaagcctttgttgtttaatggacttaactccattgattctccagaaaatgaaactgctgataacagtttttctcaggaagaggagccagtggtggccggggaagacctccctcctcccagtcctcaagaatctgatgttcagcctgtgcagcctgaggaagtgtcagccagagatttcctgcagagacttgacttgcagattaagttatcaacacaggcagccaagaagctaaaagaagagagcagagatgaagaaagtccctatgcaacttccctctatcacagttaggtgatttgggggcataactctaaccaaaattaagatatgtttggaccataaagaatccaacaactgaagattcaaaaacatcccttctggattcctatagtgtccatcttaaaatcataactaggtagttctacctgctgcagttgcactgaagtgattagttccctctggctttctataattttaagtctttattatggcatgatggcaaggttgtagcctaaagctcatcacttttgtaggtggtgttagtttttagactagcttttataaatactaattgacataaagcatcaaagattatttatatatttaggctaaaaataatgtttatctccttatgcaatcctgattatgtgaaaatatggttgctgtttaagtgatgctgaatttgctgtgtgtttataacttaagtgctatatatatatttcgatatgtcttacatattctctattaatataaagaaccaaattttgtctgctattttgtaaaaataaactacaaaagcctgaatgagaaaataaactatgttttcaaa

SEQ ID NO: 4815 - DNA, 1026 bp, Homo sapiens
ttggcagagctggaaggtctgtgcaagctggctcctgctggggaatcaataaaggaggcagagcaacgctttttttttttttcgccgtggccagggcagggttctgccagggctctatcgccaatggagcaggggtccacctggggcctaggacgcctgcagatagccctctcttagccccaacggccgcgggcttcagcgctccccggctccctcgctctgcagggtcttcccggtaccggcaggccgcggcgggagctgctttcgctcttaaccttgcagatggaacagattaaaagggccaataaactgtttaccaatgattgtatatttctgaagaaaactttgaacatcccagttatatcagagaagcctttgttgtttaatggacttaactccattgattctccagaaaatgaaactgctgataacagtttttctcaggaagaggagccagtggtggccggggaagacctccctcctcccagtcctcaagaatctgatgttcagcctgtgcagcctgaggaagtgtcagccagagatttcctgcagagacttgacttgcagattaagttatcaacacaggcagccaagaagctaaaagaagagagcagagatgaagaaagtccctatgcaacttccctctatcacagttaggtgatttgggggcataactctaaccaaaattaagatatgtttggaccataaagaatccaacaactgaagattcaaaaacatcccttctggattcctatagtgtccatcttaaaatcataactaggtagttctacctgctgcagttgcactgaagtgattagttccctctggctttctataattttaagtctttattatggcatgatggcaaggttgtagcctaaagctcatcacttttgtaggtggtgttagtttttagactagcttttataaatactaattgacataaagcatcaaagattatttatatatttaggctaaaaataatgtttatctccttatgcaatcctgattatgtgaaaatatggt

SEQ ID NO: 4816 - DNA, 1117 bp, Homo sapiens
ggcctcctcattcctcctgagcatgatgggccctctggctctctttccccaggcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggcccccccaggcccctgccccaactgattctgcccagataatcgtgtctcctgcctccactcagctgcttctcagtcatgaatgtggccatggccccggggtccccttgctgctgtgggctccctgtccctgggcaggagtgctggtgaggaggtggagccttttgagggg

SEQ ID NO: 4817 - DNA, 1072 bp, Homo sapiens
aagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggtgaatgtccccactgacccccccgccctttgtgtctgcatcctcgtggcttggggactgctgcagcactagctttgccctgagtcctgtccggcctccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggtcagtggggggaccatttcccactcccacttctctgcctccagccaggtgcctctcgtgatcccctcttaatcccctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggc

SEQ ID NO: 4818 - DNA, 868 bp, Homo sapiens
gaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatcca

SEQ ID NO: 4819 - DNA, 907 bp, Homo sapiens
gagtgtgtctgcgggagaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacaggcggggccctgtccctctacacggccctcacctgcccccaccctctggctggcatcgtggcgttgagctgctggctgcctctgcaccgggccttcccccaggtgaatgtccccactgacccccccgccctttgtgtctgcatcctcgtggcttggggactgctgcagcactagctttgccctgagtcctgtccggcctccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggtcagtggggggaccatttcccactcccacttctctgcctccagccaggtgcctctcgtgatcccctcttaatcccctcaggagatggcagctgtgaaggaatttcttgagaagctgctgcctcctgtctaactagtcgctggcc

SEQ ID NO: 4820 - DNA, 1590 bp, Homo sapiens
ggaagttccggcgggggcggccgagggggaagagtgtgtctgcgggagaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggcccccccaggcccctgccccaactgattctgcccagataatcgtgtctcctgcctccactcagctgcttctcagtcatgaatgtggccatggccccggggtccccttgctgctgtgggctccctgtccctgggcaggagtgctggtgaggaggtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctc

SEQ ID NO: 4821 - DNA, 1810 bp, Homo sapiens
gtctcgaatctacaaggtgggagcgggtgagaacccagcgactgcgcggctgaatgacagggagtagccccgccgcctccaacatggcagcttctatccagcgaagccgggtccccgcttccgggttccgtactgtcggccaggctacttccggcagcgcgatggctgggttcccgggactcgaacggaagttccggcgggggcggccgagggggaagagtgtgtctgcgggagaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggcccccccaggcccctgccccaactgattctgcccagataatcgtgtctcctgcctccactcagctgcttctcagtcatgaatgtggccatggccccggggtccccttgctgctgtgggctccctgtccctgggcaggagtgctggtgaggaggtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaa

SEQ ID NO: 4822 - DNA, 1548 bp, Homo sapiens
ggaagttccggcgggggcggccgagggggaagagtgtgtctgcgggagaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacaggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggcccccccaggcccctgccccaactgattctgcccagataatcgtgtctcctgcctccactcagctgcttctcagtcatgaatgtggccatggccccggggtccccttgctgctgtgggctccctgtccctgggcaggagtgctggtgaggaggtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctc

SEQ ID NO: 4823 - DNA, 614 bp, Homo sapiens
gagtgtgtctgcgggagaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccc

SEQ ID NO: 4824 - DNA, 429 bp, Homo sapiens
tttgcagtcagtggcagcagcagcaggacagaacctgggtgctgtgtggggctgatggcctggtggcctcttgggccaggagtgtgtcctgtgcctggttttgctcttgaccgccgccccgatgtatgcaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctgg

SEQ ID NO: 4825 - DNA, 3368 bp, Homo sapiens
agttggctctacgaccgccgttgccgctgccagagagggccagggcagggcagggacgcgcagcatcggggcgggcgtggggccggagaaaagggtgtcggggccacacacgcaccctcgctgcagtccagctcctcccgaagctcgcacgcccagagcgcacggagcgggggactgcccgcccagacgcccgcccgccaacccgcccacgagccggggccaaagcctgggagcctgcgaggggaggaggcccaggggggcggggtggggggcgggggtgggtgccgcgctgccgcggagctgctactcggcgcgttttgcatgaagatggcggctcccaccgccaacaaggcagcctccctgggctgtaacaacaagcctgcgttcccggagctggatttcaggtcgggagctcgggtggaggaattgaacaaactcatccaagaatttacgaagcacgaccagcgggaatacgacgaccagagagcgctggagattcacacagccaaggatttcatcttttccatgctgggaatggtgcaaaagctggaccaaaagcttccagtggctaatgaatacctgttgctctctggaggtgtccgggaaggcgtggtggacctggacttagatgagcttaatgtctatgcccggggtactgactatgatatggactttaccctcttggtgccagccctcaagctgcatgaccgtaatcagcctgtgacactcgacatgcgccactcagccttgtgccactcttggctgagccttcggctctttgatgaggggacaatcagtaaatggaaagactgctgcaccattgtagatcacatcaatggtgccaccaactacttcttctcacctaccaaagtggctgactggttctatgactctatcagcattgtcctatcagaaatacagaagaaaccccagcgagggatgccaaaggtagaaaaggtggaaaaaaatgggaccatcatctccatcattctgggtgtagggagtagtcgcatgttgtatgatattgtccctgtggtatctttcaaaggttggcctgcagtggcccagagctggctcatggagaaccacttttgggatgggaagattactgaggaagaggtcatcagtgggttttacttggtgcctgcttgctcctacaagggtaagaaggacaatgaatggcggctgtcctttgccaggagcgaggtgcagttgaagaagtgcatctccagcagcctcatgcaggcctatcaggcctgcaaagccatcatcattaaactgctgtcccggcccaaggctattagcccctatcacctgcggagcatgatgctctgggcctgcgacagacttcctgccaactacttggctcaagaagactatgcagcccactttttgctgggcctcatcgatgacctgcaacactgtctggtcaacaagatgtgccccaattatttcatccctcagtgcaacatgctggaacatctgtctgaggagacagtcatgcttcacgcccggaagctgtcctctgtgcgctcagacccggcagagcacttgcgcaccgccattgagcatgtcaaggcagccaaccggctgacactggagctccagaggcgaggtagcaccaccagcatcccctctccacagtctgacggaggggaccccaaccagcctgatgaccgtttggcaaaaaaactgcagcagctagtgactgagaacccgggaaagtcaatctctgtctttatcaatcctgacgatgtcacaaggccccatttcagaattgatgacaaatttttctgagtgttagctgacttttttttttcctgattcttaaactctgataatgtgtcgtgtggtttgtgatgctatctttctgttttttacatatccagcctagattggatttgttaagaacaaattttaagtttcctggttctgcaggatggtgcaggctctgaaacagtatattactatttcatattctgcctctgatttcgttgtttactttttgtagttattgtcatgctctttagtttgttggagttttttttctttttaaggagatcttaagccatagatgaaaatgcccatgaatcctcttgcttttttctgtttcatacttggtgcaaatttgttcatgggtatggggaaacaaatctctttctgatgcttaacgattctatcctattatttttattattttgtttttgtcttttttcttatgagctttcaccactactgatatttgagaatcatatgaacctgggaactacttggcatgttagctggatttatttattttggccagtgaccagagtagtttccccccttttccaccaaacaatgtaaactttgaaagtgataatactacaaattgtgttttggagcaacttcattgaatgtaattgtcctcaaatcagagaacactgggtggtttgaagggtgtctttgacagttttccaagcagaattaaggtttccaaatgttaattttagcatatgtaattatttgaagccttatttaaatcctattaaagaacataccattataattattatttgcactaatctttgccattgtcagaattgcaaagtgtgtttcaatataaattaacaaccactctcgaaattctatcattttttcattttgcccatttctatcagtgaaatgattctttgcatttgcttagttctccttcagttgtggggtcctgctttgccctctttgatattcctggttcctgtcttactgagagaagttgttaaagctttatacatgttgaccccatctaaagctggggaaaatatacacttgatgaagtaggtgtctttgtatttatttcttttggggtcatagaggtaagcttttttgtaaaatctctactcttcctgagagttttgagaaaaactggcaggaagaacttataatccccaaatagaagataccacgtctgttcaaaagcaggtattgctatagagcagcacccaggaaatatctgtgggtggcagccttggtatagaggtgtcctgtcttcatgagtgaagttacttgcctgattaggtgctggaaggtattggctccctgttttggtgtggactcatggcaagctggtgtttaagaggtcaggaggcctgctgatctttcaaaggacacccatgatgtctactcatagaaagggcaagtaacgtgttcattttggtcttgaatgtccaaactcaagggttggattttggccaattgaaatcagacatatgcgatcttgggtttttgcatggaaattaatgtaatgcttataaatgaaaaatgaaaacatttcaaccatctaagtcaaacacaaaaataataaaaaaagaaacatactggccttgaaa

SEQ ID NO: 4826 - DNA, 3229 bp, Homo sapiens
atttttactgccagctttcaagttggaagagggaaattacgtttaaaggtcagcagatgacagatggattttcacaatttggaaataaaaacatgagtgaagggttcggaaggcaagtctctggtccattacacacttccagaaaaacttagtacccagagactcacattactgggagtgctatctactcacaagtgttgcactccattgagaaaaaaaaaaaaaccaggaagttgctgttctactgaggactgaccaagaagccatgaaataccttactgtgggagacttagaagattgcctactgaataaggtggacttgaggcgccagcagatttcccaggctgtggaggaggtgcagaaagtcgttcatcatttgaccacaaacatcagcaaccaagacattagatttcaagctgtgccttactctgacacgtacaatgaaaatattaaggttttggctcccagtcagttcctcgtcacagtcccaataaaaggcctggccgggtacagggaggccagggagcagcactggcggtactacacactgcagggcaccaggctgccctgcccgttgcgggaccctgagggtctgcagcagtggctggaggtggaacagtttatgaagagcctgtggcagtggcatgagacagatgtgaacatcgacggagacattgtgcctgccaaggtcctcctagtgttccggaagctggtggaaaatgcagttagaacctgtcacctctcaggtaaggtcagcctgctaggaaaccgctctgcagtttgggttgctgtggaaacatctgcatatcaggtggaactggagctggtccccgcagtggagatccccaccacctggtccaagaaagcccggtggcctcgatgtctgcagcgctggccttcccaagagagagtggagtgcatcaagtcgtttggatttaacttgttggcctgttcaaattatcactggcagctgagcttcctccgtgctgagcaggtgttactggaacagctggatgaagatgggggctgccgtaggaagtgttttcaggtcatgaggcacctgaaggaggacatctggtgcccagggaacaggccggttatcacgtcccaccatctgcagactgtgctcttttggacctgcgagaaatatccccactttaaagactggcaggtcttcagcaaagcatttctgcgcctggtgaggaaactgcacaagtgcgtgagccagcacttcctgaaacactatttcgtccggaacagcaacctctttcagtgcaccaacccgactgaactggacactgtggcccaaaagctggccaccttcctgaagaacccccagatcggcccgccctgatggttgccccggcctgggaggctcttggacattttattctggcttaacattgttctttggatggttcctcagtcaggtgccaggatcctgcctaggagaaaggccacgaatggcagcggaaattacatcaaaccagaaacacttcagcagggggaaaactgtgccccaggatgtctggcccaggcctccctggagcccagcaagcatttctgccctagctaattctcctggagacagctctcatcaggcttccccaggcacagatttggaactggtgacagttctgaacttagtttcccttgttcaggctgtgatcgtctcacagtgaagatggagacagaacccctggaagtctggacatgagcctgctggccaatactgtgcccagcccactgatcatgggcacattctcctgccatttgtaaaatgggaatgttaacgtgcctacctctgagcagggctgtgtgcctatgaaactgtgctggcgccttttcaaggggaaggcattggatcaacacaaagtgttcctggttggttgagtagctggtgtttgcatcctggatcggtacccacagcactgacgcaaaattgcacctgatgagttagtgagcctgtgcttccttgctgccctccagcttccttagcatgtgggtcagtggctcctgatgttctgtctgcttcgctggtattctctaagcagggaggggaatggttttgatgataagtgtaagtcaaagatgaaagtacaactcttggcctgatcccaaccatagccctctctttgcttcccatgccatgggccatggatggaacttccttatatatttatgtaaataacctagtactatgatctgcatggagtgaccttaggtgtctgtcactgctcagtgtgttcctttgctcacttcattcactcactcactcattgacaaataatgctcattaggcaccgggaacacagcaaagagcaaagtggatgaggacctccccctggggatgccacctaatggtggagacaagaaatgaacgacagataaacacgcacagttattacagatggaagcaagtgcttcaaaggaaataaacagaatgttgaagtagagtccacagaaaggtccccgaaggatgaaaatgcaaatagctgaaggggaaggaaaagtgaccaaaggcaggcatggtggggctggcatgagtcagagcacctggccttgtaaagccaggaaggaatcagtattttattctaagatcaaaggtgtgacatttggcctctccagaagcagaagagtatcacgatctgactgcattttaaacaattgttctggtaactgcatgaagaaggtctggggactcacacaggagctgggcactgagtgctcttgagccacccatttggaatttcacagaggcccacaaggcaacatattctgtgtggcacaaccgatcaggaattctaggagttctcggtgagatcaatggtttttttctggcgtttatgtaatgcttctcaactcaaggggctcctttattacttttgaatgtttttgcccaaatgtctataccaaagataaatttctaaagcatgaactactgattttgttttcatgaaaattcacatttgaaaatgaaaatgattacttttcaaaagtactgtaaacggcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatagatccaggagctggttttttgaaaggatcaacaaaattgatagactgctagcaagactaat

SEQ ID NO: 4827 - DNA, 5171 bp, Homo sapiens
gggaacttggattaggtggagaggcagttggggggcctcgttgttttgcgtcttagttccgccctcctgtccatcaggagaaggaaaggataaaccctgggccatgaggctacccctgctcctggtttttgcctctgtcattccgggtgctgttctcctactggacaccaggcaatttttaatctataatgaagatcacaagcgctgcgtggatgcagtgagtcccagtgccgtccaaaccgcagcttgcaaccaggatgccgaatcacagaaattccgatgggtgtccgaatctcagattatgagtgttgcatttaaattatgcctgggagtgccatcaaaaacggactgggttgctatcactctctatgcctgtgactcaaaaagtgaatttcagaaatgggagtgcaaaaatgacacacttttggggatcaaaggagaagatttattttttaactacggcaacagacaagaaaagaatattatgctctacaagggatcgggtttatggagcaggtggaagatctatggaaccacagacaatctgtgctccagaggttatgaagccatgtatacgctactaggcaatgccaatggagcaacctgtgcattcccgttcaagtttgaaaacaagtggtacgcagattgcacgagtgctgggcggtcggatggatggctctggtgcggaaccactactgactatgacacagacaagctatttggatattgtccattgaaatttgagggcagtgaaagcttatggaataaagacccgctgaccagcgtttcctaccagataaactccaaatccgctttaacgtggcaccaggcgaggaaaagctgccaacaacagaacgctgagctcctgagcatcacagagattcatgagcaaacatacctgacaggattaaccagttccttgacctcaggactctggattggacttaacagtctgagcttcaacagcggttggcagtggagtgaccgcagtcctttccgatatttgaactggttaccaggaagtccatcagctgaacctggaaaaagctgtgtgtcactaaatcctggaaaaaatgctaaatgggaaaatctggaatgtgttcagaaactgggctatatttgcaaaaagggcaacaccactttaaattcttttgttattccctcagaaagtgatgtgcctactcactgtcctagtcagtggtggccgtatgccggtcactgttacaagattcacagagatgagaaaaaaatccagagggatgctctgaccacctgcaggaaggaaggcagtgacctcgcaagtatccacaccattgaggaattcgactttattatctcccagctaggatatgagccaaatgacgaattgtggatcggcttaaatgacattaagattcaaatgtactttgagtggagtgatgggacccctgtaacgtttaccaaatggcttcgtggagaaccaagccatgaaaacaacagacaggaggattgtgtggtgatgaaaggcaaggatgggtactgggcagatcggggctgtgagtggcctcttggctacatctgcaagatgaaatcacgaagccaaggtccagaaatagtggaagtcgaaaaaggctgcaggaaaggctggaaaaaacatcacttttactgctatatgattggacatacgctttcaacatttgcagaagcaaaccaaacctgtaataatgagaatgcttatttaacaactattgaagacagatatgaacaagccttcctgactagtttcgttggcttaaggcctgaaaaatatttctggacaggactttcagatatacaaaccaaagggacttttcagtggaccatcgaggaagaggttcggttcacccactggaattcagatatgccagggcgaaagccagggtgtgttgccatgagaaccgggattgcagggggcttatgggatgttttgaaatgtgatgaaaaggcaaaatttgtgtgcaagcactgggcagaaggagtaacccacccaccgaagcccacgacgactcccgaacccaaatgtccggaggattggggcgccagcagtagaacaagcttgtgtttcaagctgtatgcaaaaggaaaacatgagaagaaaacgtggtttgaatctcgagatttttgtcgagctctgggtggagacttagctagcatcaataacaaagaggaacagcaaacaatatggcgattaataacagctagtggaagctaccacaaactgttttggttgggattgacatatggaagcccttcagaaggttttacttggagtgatggttctcctgtttcatatgaaaactgggcttatggagaacctaataattatcaaaatgttgaatactgtggtgagctgaaaggtgaccctactatgtcttggaatgatattaattgtgaacaccttaacaactggatttgccagatacaaaaaggacaaacaccaaaacctgagccaacaccagctcctcaagacaatccaccagttactgaagatgggtgggttatttacaaagactaccagtattatttcagcaaagagaaggaaaccatggacaatgcgcgagcgttttgcaagaggaattttggtgatcttgtttctattcaaagtgaaagtgaaaagaagtttctatggaaatatgtaaacagaaatgatgcacagtctgcatattttattggtttattgatcagcttggataaaaagtttgcttggatggatggaagcaaagtggattacgtgtcttgggccacaggtgaacccaattttgcaaatgaagatgaaaactgtgtgaccatgtattcaaattcagggttttggaatgacattaactgtggctatccaaacgccttcatttgccagcgacataacagtagtatcaatgctaccacagttatgcctaccatgccctcggtcccatcagggtgcaaggaaggttggaatttctacagcaacaagtgtttcaaaatctttggatttatggaagaagaaagaaaaaattggcaagaggcacgaaaagcttgtataggctttggagggaatctggtctccatacaaaatgaaaaagagcaagcatttcttacctatcacatgaaggactccactttcagtgcctggactgggctgaatgatgtcaattcagaacacacgttcctttggacggatggacgaggagtccattacacaaactgggggaaaggttaccctggtggaagaagaagcagtctttcttatgaagatgctgactgtgttgttattattggaggtgcatcaaatgaagcaggaaaatggatggatgatacctgcgacagtaaacgaggctacatatgccagacacgatccgacccttccttgactaatcctccagcaacgattcaaacagatggctttgttaaatatggcaaaagcagctattcactcatgagacaaaaatttcaatggcatgaagcggagacatactgcaagcttcacaattcccttatagccagcattctggatccctacagtaatgcatttgcgtggctgcagatggaaacatctaatgaacgtgtgtggatcgccctgaacagtaacttgactgataatcaatacacttggactgataagtggagggtgaggtacactaactgggctgctgatgagcccaaattgaaatcagcatgtgtttatctggatcttgatggctactggaagacagcacattgcaatgaaagtttttactttctctgtaaaagatcagatgaaatccctgctactgaacccccacaactgcctggcagatgcccggagtcagatcacacagcatggattcctttccatggtcactgttactatattgagtcctcatatacaagaaactggggccaagcttctctggaatgtcttcgaatgggttcctctctggtttccattgaaagtgctgcagaatccagttttctgtcatatcgggttgagccacttaaaagtaaaaccaatttttggataggattgttcagaaatgttgaagggacgtggctgtggataaataacagtccggtctcctttgtcaactggaacacaggagatccctctggtgaacggaatgattgtgtagctttacatgcgtcttctgggttttggagtaatattcactgttcttcctacaaaggatatatttgtaaaagaccaaaaattattgatgctaaacctactcatgaattacttacaacaaaagctgacacaaggaagatggacccttctaaaccgtcttccaacgtggccggagtagtcatcattgtgatcctcctgattttaacgggtgctggccttgccgcctatttcttttataagaaaagacgtgtgcacctacctcaagagggcgcctttgaaaacactctgtattttaacagtcagtcaagcccaggaactagtgatatgaaagatctcgtgggcaatattgaacagaatgaacactcggtcatctagtacctcaatgcgattctgagatatttgaatttcataaaattgtaactgaaatttaaaatttttagttcaatgtgattgttttctttaaaatgagtactgaattgtactggtctgtccttttttcctttgcctaattgaagaaataattgcttgttttctagcctggcaagatattttcataaaagagggataacaatgctgattactaccttttaaaatattttagataaatgcacagcaccacagcaccacatctaagcattagtgatgggtagctgatgtcagcttcatgtggattttaagcactctagaaacaatgaagcttcttggcatattttaaggagctcccaaaatgtgttacctattaaattgtaactcagcaagtagaagaccatttgaaaagtcaggtacaaatatcctcaagtggcataaaaatgtagtcagttttctcttttaccagtttttatttccactccaattatttagaactttatttgtacatgtgcagaagaataaggcagctgagaatcttgtttcccccaagagagttttacaggctgagtgttgcaaatgtgttctttgtcctgttatatgtatatcaggaatacaaggatgtgaaataaaactgtaaatttgcataactggatgtacttagataatgtgaaataaacattaaagacaaggtctatttttaata

SEQ ID NO: 4828 - DNA, 1600 bp, Homo sapiens
gggaacttggattaggtggagaggcagttggggggcctcgttgttttgcgtcttagttccgccctcctgtccatcaggagaaggaaaggataaaccctgggccatgaggctacccctgctcctggtttttgcctctgtcattccgggtgctgttctcctactggacaccaggcaatttttaatctataatgaagatcacaagcgctgcgtggatgcagtgagtcccagtgccgtccaaaccgcagcttgcaaccaggatgccgaatcacagaaattccgatgggtgtccgaatctcagattatgagtgttgcatttaaattatgcctgggagtgccatcaaaaacggactgggttgctatcactctctatgcctgtgactcaaaaagtgaatttcagaaatgggagtgcaaaaatgacacacttttggggatcaaaggagaagatttattttttaactacggcaacagacaagaaaagaatattatgctctacaagggatcgggtttatggagcaggtggaagatctatggaaccacagacaatctgtgctccagaggttatgaagccatgtatacgctactaggcaatgccaatggagcaacctgtgcattcccgttcaagtttgaaaacaagtggtacgcagattgcacgagtgctgggcggtcggatggatggctctggtgcggaaccactactgactatgacacagacaagctatttggatattgtccattgaaatttgagggcagtgaaagcttatggaataaagacccgctgaccagcgtttcctaccagataaactccaaatccgctttaacgtggcaccaggcgaggaaaagctgccaacaacagaacgctgagctcctgagcatcacagagattcatgagcaaacatacctgacaggattaaccagttccttgacctcaggactctggattggacttaacagtctgagcttcaacagcggttggcagtggagtgaccgcagtcctttccgatatttgaactggttaccaggaagtccatcagctgaacctggaaaaagctgtgtgtcactaaatcctggaaaaaatgctaaatgggaaaatctggaatgtgttcagaaactgggctatatttgcaaaaagggcaacaccactttaaattcttttgttattccctcagaaagtgatgtgcctactcactgtcctagtcagtggtggccgtatgccggtcactgttacaagattcacagagatgagaaaaaaatccagagggatgctctgaccacctgcaggaaggaaggcagtgacctcgcaagtatccacaccattgaggaattcgactttattatctcccagctaggatatgagccaaatgacgaattgtggatcggcttaaatgacattaagattcaaatgtactttgagtggagtgatgggacccctgtaacgtttaccaaatggcttcgtggagaaccaagccatgaaaacaacagacaggaggattgtgtggtgatgaaaggcaaggctggagtgcaatggcacaatcttggctcaatgcaacctctgcctcgagagttcaagcgattctcctgcctcagcctcccgagtagctga

SEQ ID NO: 4829 - DNA, 2198 bp, Homo sapiens
acaggacagggtggggtgcggtcagccccaggcaccggcaggattgcatttccacccaaggccagcagagggagcacgaacaccgcccacttgagcatagcaaactcctggccccgcagcgcctccaccccagagacccggaccaagttcacacaggacaatctgtgccacgcccagcgcgagcgcctggactcggccaacctgtgggtgctggtggactgcatccttcgcgacacctccgaggacctgggactccagtgtgacgccgtgaacctggccttcgggcgccgctgtgaggaactggaggacgcgcggcacaagctgcagcaccacctgcacaaggtggggcaccctgaaccccgaagacggctccggcgcctgcccaccactctgccccctctcatcacctggcctgggccctcaacacctttctcctctgtcccacttatcccgagggaccccagaagcaagtgtcacctctccgtaaacctatgtaaaaccaggtgacactgggtatgatcgcagtgtgttgcaacccccatgactgagaaggaggagctgtggggaggatggaggcaggagctggtctggggagcattgactgcctgggaggtccccaagagtcctggcctggcaggcagggctctgactctagggcctcagcatggcctttaccacctctgagtccccagtccttgagcaggatttgggtcctggtgaccaccaaggatgggggttcttggaccagagctaagagacaacaggctgcctgactctccagagcccgctgggggccccgtgcacattgttcccctcacccacgcctccccagggccactggtcaggaccaccctctggacacagccccaggagctgggtaggaccagactggtctctacattccatatgcccgggcatgggggcacaggcccaaggggcactgtcctgtctgcagatgctgcgggaaatcacagatcaggaacacaacgtggtggcactgaaggaggccatcaaggacaaggaggaacctctgcacatagcccagacccggctgtagctgctctcacaccggcccaacatgcagctgtgccgcgatgcagcccagttcaggtactgcctgggcctctgaggcagtcccaggtgcccccgtccacctcctcgctgcgaccctctccaataaacactccaatctccacacacacatcccccacaggtgctgagaggggagggagactctgcggccacacacaacatgcaagcacgccttaaacacacagatatagacatgacactgggcaggtcatgggtcgggggcctccccgtgccagggacctgtgcccacgtggtctcaccccaccctgtgctacctcatcttcccgggaggaagctccttcagacaaggtgagctcctggaggccacggggccagagaggccagagagggccattccctgctgccctgagggtgctgtccccacctctggtggaaagtatgacctacgcctgggctacaggcatagatgggccgtccttttgtttcccttgttaacggatgcctggtggccccttctgagcctaagtacctttcttccttccctgcccctcagttccttcaaggaactgggtgcctccttccgtcaaatatcaggaatggaaagaactgagcctggtcggctgaggccagtcctgtcctgtcagggtcgagattgcacgcgggtcactcattcccactcaggtccgcgctccctgggaggaccctcgtaatttatgctctgccctagagccgctttcctggtaggatcctttcatggcgtcttcccaggacctcctgccagctcccattgggagttttgggtcccctccaccccagtaggtgcatacttctgccctccccagccccagctcacaccccccaacacccccaagctggtgagtgaggtggaggagctgtacaagtccatcacagcgctgcgggagaagcttctacaagcggagcagtccctgcgcaacctcaaggacatccacatgagcctggagaaggacgtcaccgccatgaccaacagtgtcttcatcgaccgccagaagtgcatggcccatcgtacttgctaccccaccattctgcagctggctggctaccagtgagcagcggcacggtgcttccccccaatcccccaaataaacagtgcgttagctttctgc

SEQ ID NO: 4830 - DNA, 2485 bp, Homo sapiens
ccccactgtctgccccgcaggctgtgcactgcccttccatcatctggcaggcccccaaaggtcagcccccggtgccacacgagattccaacgtcaatggaattccaggaggtgcagcagacacaggcgctggcctggcaggcccagaaggcccccactcacatctggcagcccctgcctgcccaggaggcccagaggcaggctccccccttggtccagctggagcagccctttcagggagccccgccctcccaaaaagccgtgcaaatccagctacccccccagcaggcccaggcatcgggtccgcaagcggaggtgcccacactgccgctccagccttcctggcaggcaccgcctgcagtcttgcaggcccagcccggacccccggtagcagcggcaaattttcccctgggctccgctaaatcattgatgactccatcaggagaatgcagggcctcttctatagaccgcaggggctcctctaaagagcgcaggacctcctcgaaggagcgcagggccccttcaaaagaccgcatgatctttgctgccaccttctgtgctcccaaggcagtgtcagctgcgcgagcacacctgccagctgcctggaaaaacctgcctgccacaccggagacctttgctccctcctcaagtgtcttcccagctacctcccagtttcagcctgcctctctgaatgcctttaaaggcccctctgctgcctcagagaccccaaagtcactgccatatgctctgcaggatccctttgcctgtgtagaggccctgcctgcagttccatgggtcccacagcccaatatgaatgcctcaaaggcatcgcaggcagtgcccaccttcctgatggctacagcagctgccccccaggcaactgccaccactcaagaggcctccaagacctccgtcgagccgccacgccgctccggcaaggccacccggaagaagaagcatctggaagcccaagaggacagccgtggccacacgctagcctttcatgactggcagggcccaaggccctgggagaatctaaatctgagtgactgggaggtccaaagccctatccaggtctcgggtgactgggagcacccaaacaccccccgtggcctgagtggttgggagggccctagcacctccaggatcctgagtggctgggaagggcccagcgcatcctgggccctgagtgcctgggagggcccgagcacctccagggccctgggtctctctgaaagcccagggagctctctgcccgtagttgtgtctgaggtcgcaagtgtctctccgggatccagtgccacccaggataattccaaggtggaggcacagcccttgtctcccttggatgagagggcaaatgcgttggtgcagttcctcttagtcaaggaccaagccaaggtgcctgtccagcgctcggagatggtgaaagtcatcctccgagagtataaagatgagtgcttagatatcatcaaccgtgccaacaataagctggagtgtgcctttggttatcaattgaaagaaattgataccaaaaaccacgcctatattatcatcaacaagctgggctaccatacagggaatttggtggcatcctatttagacaggcccaagtttggccttctgatggtggtcttgagcctcatctttatgaaaggcaactgtgtcagggaggatctgatctttaattttctgttcaagttagggttggatgtccgggagacaaacggtctctttggaaatactaagaagctcatcaccgaagtgtttgtcaggcagaagtacctagagtacaggcgaatcccttacactgagcccgcagagtatgagttcctctggggccctcgagcattcctggaaaccagcaagatgcttgtcctgaggtttttggccaagctccataagaaagatccacagagctggccattccattaccttgaagcgctcgcagagtgtgagtgggaagacacagatgaggatgaacctgacaccggtgacagtgcccacggccccaccagcaggccccctccccgctaataggtgtagcagagatctcgctcctgtgtttccctggccagaggccactgacagggtggggggacatttttgttcctggtgtttgtgttccagttccacgagtgtacgtttggattttcaacttggtttcgtatctgccaaagctttgtacattttttatgtggtgttgatttcaatcggctactgttctgttctgtattttggcatctgtgtttttaagtgagatctgtggttctctgttttgtgttttaattgttatgttttggtatcagctttgtgctggctttgtgaaatgaattgagaagctatccatctcatttctggtatagttcatgtagcattgtaatcggttgttctttgaacgttcaaatgactcatcagtaaaaactgtctacagagaagtaaatatctatatctatatatataaatatactttcagcataacagaa

SEQ ID NO: 4831 - DNA, 2991 bp, Homo sapiens
acattgcgcctgcgccggaaggaggctgttagcgtgctggactctgcggacatagaggtcacagacagtcgcctgcctcatgccactattgtggatcaccggccccaggtaccatctcatccttctatcggaggcctcctgcctcagggcaaactatgtacacctgtgtcctttattccagcaccgttggttagagacatgtaacgcacctccccaattgatccagggtaaggcacatagtgctccgaagccatcccaggcctctggtcatttctctgtggagctggttcgcggttacgcaggctttggcctcaccttaggtgggggccgggatgtagctggggacactccgctggccgtgcgcgggctgctgaaggatggcccagcacagcgctgtggtcgtttggaggtcggggacgtcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttgtcccgtcatggccagatcgcagcccagatcctggagggccggaggtaacggggtctcgcagcagcagcacttccctagttcagcaccctccatcccggacgacgctcaagaagacccggggcagcccggagcctagtccagaggcggccgccgatggccccacggtttctcctcctgagcgccgcgctgaggatcccaacgaccagatcccgggttccccggggccctggctagtgcccagcgaggaacggctctcgcgggccctaggggtccggggggcagcgcagttcgctcaggagatggcagccggaaggcggagacactgagcctacctctgacagcgcggggctcactagttaccgcccaacctggatccggcgcgtgtggccgctgggcacttggcacctccccaagagcttccacttggtttggtccccccacccgctgctcagtggctctgaccacactcccctcgcagcgtcagtggtacgacccttccagccggctagcctgcgcttctggttctgggagggggaggtaataaaatggttcgatccggtcttgacttgccaggcgctcgaggcggggtggggctgcccgggccactctgtaaaggagcaggtgggtcgatcctgcttgagtaatcgctgacgagcttcgtgctgctgctttcctgcttgcacatgttatctttgcttctgccggtcctcagtctggcgtgctttctttttctcttcgccgtctcctgctcctctccttattcattaatttcacctttttggaggtgtacagggtctcacacataaattattgtgcatggcatggagaatgcagaggtgagcctgtcgtggcaggactgcaccagtgtatccacagtcctgtctcggaatcatacagaccctcagctgacgtcgggatagcaaggctagaagcctagaagcagggcagcttccttcgccagaggcctgcggtctcccacttccggcctagtctgccagcttttgctggcacgtaggctaccactctccgggcaccggctggggccctggagccccctttggggcggagtggggaaggtgtgagtcagcgcccctggacgggccgggctaaaaaaggctgttagaacctttgggccgtgcccccattttccgtacatggtgaagaactgcagccgggcttgtgtgcacacgccacacactgggcgttcccggcacgggagaggcccagagtttccttcaccctgggaacagagccctacagccagggcttatatggccagcgggactccaaccggggtagccgcgaggaaggcgctggcagaggacagaaatgtccagtcacctccgctgtcaccacatcctgagcactcggccccatccccccacaggagggaagctgtggtctgacggaatgggcaactttcgcccctgtggggaggggacggggaaggaagaaagaatttaaaggaccggaatgcgagagtccaggtggccttggagaggaaagaggaacggtgaagacaagctgcgagagctgggagctggagggtgaagaggtgaacacttgagtggttagagctgtagatagacattgtggggaagtgtgccagggtggcttccagctacccctgacttagagcctggtggaggtgtggttcttcagaagtcagcaaagggctcaagagccccagtctataaatacagtcacacccaggagactaataatagtaaccccagccaccatgtacttagttttatccctgctactggctttattgcaatatttattttcatctacaatagttgcacatctactcaactatccgaatatgtccatttcgcagaggaggaaagtgaggcccagggagtgcagatagctacagagaggagggtcaaagcacgatttaatcaaggcctgattcccaagtctgtcctctcaatttcacctgcattgacaagtattaattgaaccccaactgtatatgttgcactgtgctaggtactgtggagatgctggaggaacaagacataaaatttctttgtgtagctgatgtatgtaatgagagtagacagatgtcagacaaaaaagacgagaaaatgaataaataaaaaaccaggccaggcgtggtggctcacgcctgtaatcccagcactttgggaggccgaggctggtggatcacgaggtcaagagttcaagagcagcctggccaagatggtgaaaccccgtctctactgaaaatacaaaaattagccaggtgtggtagcaggtgcctgtaatcacagctactcgggaggctgaggcagagaattgcttgaacccaggaggtggaggttgcagcgagccaagatcgcaccactgcactccagcctgggtgacagagcgagaatcagtctcaaaaaaaaaaaaaaaa

SEQ ID NO: 4832 - DNA, 2308 bp, Homo sapiens
acggaggcctccttgctggccgccagataggccaccccgcagatacaggaaccaggcacgggcccgccaccctgtttccagggtctgagcgggtcaccaggtgagcacgccccagagctcaaaactcgtcgctggctgccctgcgtccacccggccgactactggccatggagccgcgcacagggggcgccgcgaaccctaaggggagcagaggaagtacagggattggggatgttggggaaggacagagcgagtcgccgccacccccgtcccgcctgtctgctccacaccttttccttctgacaggtggtaaacagagcggctctggcgcccaagtgaaggtggcagggggcaggggcccagcgatggaggctgggctggaggtcccctacccacacccacacacgagggaaagggccgcgcaccagagcaggggaggggctctcaggagtctccagggagacgtgcagatgtgcggggaggggtctgcccgtggtcactggggacacctgggcactcagggtcttagtgaactggggggaggggagctgggggcccctggggacctgtggagggggactctggaggtatgtgggccatggggggaacgggccctctgagggaattcatgggggtagcagcggttgcctaggatacttagacggggaattgggggttccggggctacggcgtcaggccgtgttctcccaggatatctggggaaatggggtcccctgagatatcgcgggcgaagagttgggcatccagggtgattagggggcagtcgaggacctcacggggtgttcggaggtgtctaggactattgcagtcaaacagcgatctccagggacaccgtgggagcaagcgggggtgcaccggctacccgcgacggtcggggatcgcgtgaggggagggacagcagtgacctccgaaactatcgagggagtggccaggggtcgccgggtatcctgaggggcatttctaggtcttcgagcgtccggaagcataggggttggccgaggccgagggtcggcgttgacctgtcccctcttgcgcgcaggccgcggcccctccccgctcgcgggccctagcgcccggcagctcctggcgcggttggacgcgcgccccctggcggcgcgagctgcggtcgacgtggcagcgctggtacgcagggcgggcgccacattgcgcctgcgccggaaggaggctgttagcgtgctggactctgcggacatagaggtcacagacagtcgcctgcctcatgccactattgtggatcaccggccccaggtaccatctcatccttctatcggaggcctcctgcctcagggcaaactatgtacacctgtgtcctttattccagcaccgttggttagagacatgtaacgcacctccccaattgatccagggtaaggcacatagtgctccgaagccatcccaggcctctggtcatttctctgtggagctggttcgcggttacgcaggctttggcctcaccttaggtgggggccgggatgtagctggggacactccgctggccgtgcgcgggctgctgaaggatggcccagcacagcgctgtggtcgtttggaggtcggggacgtcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttgatcgcagcccagatcctggagggccggaggtaacggggtctcgcagcagcagcacttccctagttcagcaccctccatcccggacgacgctcaagaagacccggggcagcccggagcctagtccagaggcggccgccgatggccccacggtttctcctcctgagcgccgcgctgaggatcccaacgaccagatcccgggttccccggggccctggctagtgcccagcgaggaacggctctcgcgggccctaggggtccggggggcagcgcagttcgctcaggagatggcagccggaaggcggagacactgagcctacctctgacagcgcggggctcactagttaccgcccaacctggatccggcgcgtgtggccgctgggcacttggcacctccccaagagcttccacttggtttggtccccccacccgctgctcagtggctctgaccacactcccctcgcagcgtcagtggtacgacccttccagccggctagcctgcgcttctggttctgggagggggaggtaataaaatggttcgatccggt

SEQ ID NO: 4833 - DNA, 1238 bp, Homo sapiens
atggagccgcgcacagggggcgccgcgaaccctaaggggagcagaggaagccgcggcccctccccgctcgcgggccctagcgcccggcagctcctggcgcggttggacgcgcgccccctggcggcgcgagctgcggtcgacgtggcagcgctggtacgcagggcgggcgccacattgcgcctgcgccggaaggaggctgttagcgtgctggactctgcggacatagaggtcacagacagtcgcctgcctcatgccactattgtggatcaccggccccagcaccgttggttagagacatgtaacgcacctccccaattgatccagggtaaggcacatagtgctccgaagccatcccaggcctctggtcatttctctgtggagctggttcgcggttacgcaggctttggcctcaccttaggtgggggccgggatgtagctggggacactccgctggccgtgcgcgggctgctgaaggatggcccagcacagcgctgtggtcgtttggaggtcggggacgtcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttgtcccgtcatggccagatcgcagcccagatcctggagggccggaggtaacggggtctcgcagcagcagcacttccctagttcagcaccctccatcccggacgacgctcaagaagacccggggcagcccggagcctagtccagaggcggccgccgatggccccacggtttctcctcctgagcgccgcgctgaggatcccaacgaccagatcccgggttccccggggccctggctagtgcccagcgaggaacggctctcgcgggccctaggggtccggggggcagcgcagttcgctcaggagatggcagccggaaggcggagacactgagcctacctctgacagcgcggggctcactagttaccgcccaacctggatccggcgcgtgtggccgctgggcacttggcacctccccaagagcttccacttggtttggtccccccacccgctgctcagtggctctgaccacactcccctcgcagcgtcagtggtacgacccttccagccggctagcctgcgcttctggttctgggagggggaggtaataaaatggttcgatccgg

SEQ ID NO: 4834 - DNA, 711 bp, Homo sapiens
gccgcggcccctccccgctcgcgggccctagcgcccggcagctcctggcgcggttggacgcgcgccccctggcggcgcgagctgcggtcgacgtggcagcgctggtacgcagggcgggcgccacattgcgcctgcgccggaaggaggctgttagcgtgctggactctgcggacatagaggtcacagacagtcgcctgcctcatgccactattgtggatcaccggccccagggtaaggcacatagtgctccgaagccatcccaggcctctggtcatttctctgtggagctggttcgcggttacgcaggctttggcctcaccttaggtgggggccgggatgtagctggggacactccgctggccgtgcgcgggctgctgaaggatggcccagcacagcgctgtggtcgtttggaggtcggggacgtcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttgatcgcagcccagatcctggagggccggaggtaacggggtctcgcagcagcagcacttccctagttcagcaccctccatcccggacgacgctcaagaagacccggggcagcccggagcctagtccag

SEQ ID NO: 4835 - DNA, 642 bp, Homo sapiens
gcctggggggtcagcagctactgccctgtcttggctgttagcgtgctggactctgcggacatagaggtcacagacagtcgcctgcctcatgccactattgtggatcaccggccccagcaccgttggttagagacatgtaacgcacctccccaattgatccagggtaaggcacatagtgctccgaagccatcccaggcctctggtcatttctctgtggagctggttcgcggttacgcaggctttggcctcaccttaggtgggggccgggatgtagctggggacactccgctggccgtgcgcgggctgctgaaggatggcccagcacagcgctgtggtcgtttggaggtcggggacgtcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttgatcgcagcccagatcctggagggccggaggtaacggggtctcgcagcagcagcacttccctagttcagcaccctccatcccggacgacgctcaagaagacccggggcagcccggagcctagtcca

SEQ ID NO: 4836 - DNA, 1057 bp, Homo sapiens
aaaactcgtcgctggctgccctgcgtccacccggccgactactggccatggagccgcgcacagggggcgccgcgaaccctaaggggagcagaggaagccgcggcccctccccgctcgcgggccctagcgcccggcagctcctggcgcggttggacgcgcgccccctggcggcgcgagctgcggtcgacgtggcagcgctggtacgcagggcgggcgccacattgcgcctgcgccggaaggaggctgttagcgtgctggactctgcggacatagaggtcacagacagtcgcctgcctcatgccactattgtggatcaccggccccaggtcggggacgtcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttgtcccgtcatggccagatcgcagcccagatcctggagggccggaggtaacggggtctcgcagcagcagcacttccctagttcagcaccctccatcccggacgacgctcaagaagacccggggcagcccggagcctagtccagaggcggccgccgatggccccacggtttctcctcctgagcgccgcgctgaggatcccaacgaccagatcccgggttccccggggccctggctagtgcccagcgaggaacggctctcgcgggccctaggggtccggggggcagcgcagttcgctcaggagatggcagccggaaggcggagacactgagcctacctctgacagcgcggggctcactagttaccgcccaacctggatccggcgcgtgtggccgctgggcacttggcacctccccaagagcttccacttggtttggtccccccacccgctgctcagtggctctgaccacactcccctcgcagcgtcagtggtacgacccttccagccggctagcctgcgcttctggttctgggagggggaggtaataaaatggttcgatccgg

SEQ ID NO: 4837 - DNA, 553 bp, Homo sapiens
aagattacttgaggggatggtgcgtaaatggtgggccagtttgtatatgagctgcaggggcaagacaagtagatgaggctagaatgttaactcagggaacaggtcctaggtagtttccatggcatgtcccccaacagccctctccactgcttttatctcccagctgttagcgtgctggactctgcggacatagaggtcacagacagtcgcctgcctcatgccactattgtggatcaccggccccaggtcggggacgtcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttgatcgcagcccagatcctggagggccggaggtaacggggtctcgcagcagcagcacttccctagttcagcaccctccatcccggacgacgctcaagaagacccggggcagcccggagcctagtccagaggcggccg

SEQ ID NO: 4838 - DNA, 602 bp, Homo sapiens
cggccgactactggccatggagccgcgcacagggggcgccgcgaaccctaaggggagcagaggaagccgcggcccctccccgctcgcgggccctagcgcccggcagctcctggcgcggttggacgcgcgccccctggcggcgcgagctgcggtcgacgtggcagcgctggtacgcagggcgggcgccacattgcgcctgcgccggaaggaggctgttagcgtgctggactctgcggacatagaggtcacagacagtcgcctgcctcatgccactattgtggatcaccggccccaggtcggggacgtcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttgatcgcagcccagatcctggagggccggaggtaacggggtctcgcagcagcagcacttccctagttcagcaccctccatcccggacgacgctcaagaagacccggggcagcccggagcctagtccagaggcggccg

SEQ ID NO: 4839 - DNA, 730 bp, Homo sapiens
cgccatttgtctatggcaggcagggtggctgccttagctgccggaggttccgcactctctaaggccccgggtgaagccccacctctgctgcgcgcagcctgcggtgcgggtcatggcgcggctaccgaagctggcagtctttgatttggattacactctctggcctttctgggtcgacacgcacgtagaccctccgttccataagagcagtgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtactttgttcatcgggaaatctatccaggcagcaagatcacacactttgagaggttgcagcagaagactggaattcctttctcccagatgatcttctttgatgatgagaggcggaatattgtagacgtcagcaaactgggtgttacctgcattcacatccagaatggaatgaatcttcaaactctaagtcaagggttagagacatttgcgaaggcccaaactgggcctttgaggtccagccttgaggagagcccatttgaggcctaaactgaaaggaaatcaagaaggcattttcaggtgcatttgtaatttattaaagttcatctgtgtgtgacagaagagattttacccaca

SEQ ID NO: 4840 - DNA, 582 bp, Homo sapiens
ccatttgtctatggcaggcagggtggctgccttagctgccggaggttccgcactctctaaggccccgggtgaagccccacctctgctgcgcgcagcctgcggtgcgggtcatggcgcggctaccgaagctggcagtctttgatttggattacactctctggcctttctgggtcgacacgcacgtagaccctccgttccataagagcagtgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtgttacctgcattcacatccagaatggaatgaatcttcaaactctaagtcaagggttagagacatttgcgaaggcccaaactgggcctttgaggtccagccttgaggagagcccatttgaggcctaaactgaaaggaaatcaagaaggcattttcaggtgcatttgtaatttattaaagttcatctgtgtgtgacagaagagatttta

SEQ ID NO: 4841 - DNA, 2834 bp, Homo sapiens
atggcggcgccccctgcaccagccgccaaggggtccccgcagccggagccgcacgccccagagcccggcccggggagcgccaagcgagggcgagaggacagcagagccggtcgcctctcattctgtacaaaggtgtgctatggcattggtggggtccccaaccagatagcctccagcgccacagccttttacctgcagcttttcctgcttgatatagcacagatccctgccgcccaggtgtcacttgttctgtttgggggaaaagtgtctggggcggctgctgaccctgtggctgggttcttcatcaacaggagccagaggacagggtctggacggctcatgccttgggtgctgggctgcacccccttcatcgccctggcctacttcttcctgtggttcctgccccccttcaccagcctgcgaggcctctggtacacgactttctactgcctgttccaggccctggccacgttcttccaggtgccctacacagcgctcaccatgctgctgactccctgcccaagggagcgggactcggccaccgcctaccggatgactgtggagatggcgggaacactgatgggggccactgtccacgggctcatcgtgtccggcgcccacagaccccacaggtgcgaggccactgcgaccccggggccagtcactgtctccccgaatgcagcccatctctactgcattgcggctgccgtggttgtagtgacttaccccgtgtgcatcagtttactgtgcctaggggtgaaggagcggccagacccctctgccccagcctcaggcccaggcttgagtttcctggctgggctgagcctcactacccggcacccaccctacctgaagctggtgatctccttcctgttcatctctgctgctgttcaggtggagcagagctacctggtcctgttctgtacacatgcctcccagctacacgaccacgtccagggcctggtactaactgtcctggtctcagccgtgctgagcaccccgctgtgggagtgggttctccagcgctttgggaagaagacgtcagcctttgggatctttgcgatggtgccctttgcgatcttgctggctgctgtgcccacagcacctgtggcatatgtcgtggcctttgtatctggcgtgagcattgctgtgtccttgctgctaccctggtccatgctgccagacgtggtggatgactttcagctgcagcaccgtcacgggccaggcctggagaccatcttctactcctcctacgtcttcttcaccaagctgtctggcgcatgtgccctgggcatctccaccctcagtctggagttctcggggtataaggcaggggtctgcaagcaagcagaggaggtggtggtcaccctcaaagtcctcattggcgccgtgcccacctgcatgatccttgctgggctctgcatcctcatggtcggctccactccaaagacacccagtcgggacgcctccagccggctgagccttcggaggaggaccagctacagcctggcctaaagcttaggagggcgactgtgaatggacacaggagccagcaccctcggggcctgacatcgccctcctcagccctccagcacctggtctggcagtttagtatgtgacctttctccctgggatgtggagtcttcggcaacgtgtcctgaagggactggcccgcactccaggaccccacttggcatttcttgtctgttgccttcagactatctcagataggcctgtgcccctgactagcccagtagcacttgtctctagaaaaaggaagctcctgcccaacctggcttgtggaccagtaatatctgtggcctaccacccattcaagaaaacgttacagccggctcactgcaaaatccgcctcccgggttcacgccattctcctgcctcagcctcccgagtagctgggactacaggtgcccgccaccacgcccagctaatttttgtatttttagtagagacggggtttcaccgtgttagccagaatggtttcgatctcctgacctcgtgatccgccccgcctcagcctcccaaaggcatgagccaccgtactcggcctgcccaggctggtcttaaactcctggcctcaggtgatcctactgcctcagcctcctgagtagctgggattacagacacagcccccgttcccagctctagcatttcttaaggacaaaattggtgtgtaagtaacaggaaattcacattatgctgtactcattctctaatatcacagccatgttagaacaaatttgggttttcaaaacaagcgtaactgaacagagtatatatatgtatgtatataaatatatagaaatcctaaatggtccctgtgacataagaaatacacatttggtctctgccccaggttcctggcacagagcttctaaaatgctagtaacttcctgagtggtaggggtgaggggaacatcttttgttatacataagaagcccttttcaaacagatctgagtttatgctaatgatgtgactggcagaggatgggggctggttgccagagaaaccaaccatgtgattagaaggttgaaactttcagccttatcttcctaccgggaggggacaggggctgaagactgagctcatcatcaatgatttaatcaattgtgcccatgtaatggagcctccacttccaaacgaagggtttcagagagcttctaggttggtgaacacatccatgtaccaggaggtctaccccactccacggggacagaaactcttgtgtaggggacccttttagatttcattctatatacctcttcagctggctgttcattttataatcaaccaataaatgttaagtaaagtgtt

SEQ ID NO: 4842 - DNA, 1528 bp, Homo sapiens
cggcgctgcggtggcaatggcggcgccccctgcaccagccgccaaggggtccccgcagccggagccgcacgccccagagcccggcccggggagcgccaagcgagggcgagaggacagcagagccggtcgcctctcattctgtacaaaggtgtgctatggcattggtggggtccccaaccagatagcctccagcgccacagccttttacctgcagcttttcctgcttgatatagcacagatccctgccgcccaggtgtcacttgttctgtttgggggaaaagtgtctggggcggctgctgaccctgtggctgggttcttcatcaacaggagccagaggacagggtctggacggctcatgccttgggtgctgggctgcacccccttcatcgccctggcctacttcttcctgtggttcctgccccccttcaccagcctgcgaggcctctggtacacgactttctactgcctgttccaggccctggccacgttcttccaggtgccctacacagcgctcaccatgctgctgactccctgcccaagggagcgggactcggccaccgcctaccggatgactgtggagatggcgggaacactgatgggggccactgtccacgggctcatcgtgtccggcgcccacagaccccacaggtgcgaggccactgcgaccccggggccagtcactgtctccccgaatgcagcccatctctactgcattgcggctgccgtggttgtagtgacttaccccgtgtgcatcagtttactgtgcctaggggtgaaggagcggccagacccctctgccccagcctcaggcccaggcttgagtttcctggctgggctgagcctcactacccggcacccaccctacctgaagctggtgatctccttcctgttcatctctgctgctgttcaggtggagcagagctacctggtcctgttctgtacacatgcctcccagctacacgaccacgtccagggcctggtactaactgtcctggtctcagccgtgctgagcaccccgctgtgggagtgggttctccagcgctttgggaagaagacgtcagcctttgggatctttgcgatggtgccctttgcgatcttgctggctgctgtgcccacagcacctgtggcatatgtcgtggcctttgtatctggcgtgagcattgctgtgtccttgctgctaccctggtccatgctgccagacgtggtggatgactttcagctgcagcaccgtcacgggccaggcctggagaccatcttctactcctcctacgtcttcttcaccaagctgtctggcgcatgtgccctgggcatctccaccctcagtctggagttctcggggtataaggcaggggtctgcaagcaagcagaggaggtggtggtcaccctcaaagtcctcattggcgccgtgcccacctgcatgatccttgctgggctctgcatcctcatggtcggctccactccaaagacacccagtcgggacgcctccagccggctgagccttcggaggtaagccccgcacgccccctgc

SEQ ID NO: 4843 - DNA, 3151 bp, Homo sapiens
accaatgagcggcgccgtgggcgggccgcgggcgcgcatgctctgggcccgcagttgaagtggcgagagcgctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtcctgcccagaatgccggatcacatctaactttgtcattccaagtgagtactgggtggaggagaaagaagagaagcagaaactcattctgaaatacaaggaggcaatgagcaacaaggcgtgcaggtattttgatgaaggacgtgggagctgcccatttggagggaactgtttttacaagcatgcgtaccctgatggccgtagagaggagccacagagacagaaagtgggaacatcaagcagataccgggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctcagacagcagctgtcccctgtggtggtgtggcagtgcctgtgttctctcctaggcaggcctctcaactccaggtgctgtcctaagaatttttacccagggcctgtcttctcaacccctcacctttccctgaggagtgtgttgttttccctgttgaaaaaagttacaaaaataaatcttaaagttagttttttgtaacacgaatttaactgtcagacagttagtgtaggtgtgttgcgtcatctgttttcaaccagattgcatttatggacttttcacacactcattttgaggaccccaggttcaaaagtaaaagcagtggccctgctttggggtccaagaataggagtgatgggtgaagggacctaagctggccaatagccctctgccccagacatgggatgtggatccttgaggtttctggtgaaatctgcacatctgtgtttttatatctgttccctaccctgtaatccctaccacgtgcacttgttctgtggttttggtctcttgtttaattgcacacaagtaatactactgggtaaccagaatcaggtgtgaatgtgttgagattttttactgttttgcatgataggaaaattgagaaagaatacgtataaaagatagagaggcataacatcaatgcagagttggaagttggctcccaagggctgacatggtgtgagtgtgtgggtgtgtgataagcttctcatccctgcatagatgcagtattcttagccttagtagaaaaacctggtttagtggtttaagccttgtgtggcagatagatcttaaagggcaaagcagtatattggtagttgtcaatatagcagtgctagctctgtctatataaatagagaaatggggttagccatagaggttaaaactacctggttatcccatataataacacaaactgggtcttggatacacagttgtatttaatgttttacgatctagcctttccagtacaggcactttctgagaaacctttgtcctcacttgaggcattttgttgtcgggtttttgtgtttgtttttgtgggtatttgcctcattccacccctgagctttcaggtagacagacgtgattcaaaactctgttctaaggtgtttattgtagtggagtaatgggtttgcagtgataagtcatacttttccaccgaaagggagggcttgggaatccctgagattagctaaagttaagttgttggaagaattccttgattggaaattgtacctttgtgttttgttgctctgtttcctgaaaataactcggggatgctcctggtttgtccatctactgctttgattccttggatcccacccattctttcactttaagaaaaaacaaataattgttgcagaggtctctgtattttgcagctgcccttttgtaagaagcacttttcccaaataaaacaattaaaaaaaaagttggctgttc

SEQ ID NO: 4844 - DNA, 1390 bp, Homo sapiens
ctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagtcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtcctgcccagaatgccggatcacatctaactttgtcattccaagtgagtactgggtggaggagaaagaagagaagcagaaactcattctgaaatacaaggaggcaatgagcaacaaggcgtgcaggtattttgatgaaggacgtgggagctgcccatttggagggaactgtttttacaagcatgcgtaccctgatggccgtagagaggagccacagagacagaaagtgggaacatcaagcagataccgggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctcagacagcagctgtcccctgtggtggtgtggcagtgcctgtgttctctcctaggcaggcctctcaactccaggtgctgtcctaagaatttttacccagggcctgtcttctcaacccctcacctttccctgaggagtgtgttgttttccctgttgaaaaaagttacaaaaataaatcttaaagttagttttttgtaacacgaatttaactgtcagacagttagtgtaggtgtgttgcgtcatctgttttcaaccagattgcatttatggacttttcacacactcattttgaggaccccaggttcaaaagtaaaagcagtggccctgctttggggtccaa

SEQ ID NO: 4845 - DNA, 3745 bp, Homo sapiens
agtagagacgggctttctccgtgttggtcaggctggtcttgaactcccgacctcaggtgatctgccggcctcagcctcccaaagtgctgggattagaggcgtgagccaccgcacccggtctatgatccttatcgttcactttgagctctctgagaagagtagggccctattttatctgcagggctttctttcctcagttcctcagtttctttcctcagttccagtatcatgaacaggatactcagttactgagtatcctgagcagatactgagtaaatgcttgagtgatgttgataaagtcatatacctagaattacccactttaacaggaactttgtaagattcctctgctttcattaaaaaaaaaaaaaacaaaacttgtaaattaccaaagacaaagtacttaacagaacacatgtgtatcttccttttttttttttttttttgagatggagtgtcgctctgtcgcccaggctggagtgcagtggcgagatctcagctcactgcaacctctgcctcctgggttcaagcgattctcctgcctcagcctcctgagtaggtgggattacgcccggccacatgtatattttttctggaactaccttattcaatcattcagtaagtaaacattgcactccagcctgggtgacagagtgagatttcgtctcaaaaaaaaaaaaaaagaaagaaggaaatccttcagaaattctttatctgagtgctgtgacgtccatagtgaaatttattacttggaaactacatagtggttgtgagaggaaataagtaataaatattaaatggtattaaaaagattatgcaactgggaaagaaaaattaatttgctatcgctaccatgattcaccatcacatctagctgtcttctacagccttttatttatttattttttttttgagacggagtctcagtggcgtgatcctggttcactgcaacctctgggccccccccaacccactgcgagttcaagcaattctgcctcagcctcccaagtagctgggactacaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtcctgcccagaatgccggatcacatctaactttgtcattccaagtgagtactgggtggaggagaaagaagagaagcagaaactcattctgaaatacaaggaggcaatgagcaacaaggcgtgcaggtattttgatgaaggacgtgggagctgcccatttggagggaactgtttttacaagcatgcgtaccctgatggccgtagagaggagccacagagacagaaagtgggaacatcaagcagataccgggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctcagacagcagctgtcccctgtggtggtgtggcagtgcctgtgttctctcctaggcaggcctctcaactccaggtgctgtcctaagaatttttacccagggcctgtcttctcaacccctcacctttccctgaggagtgtgttgttttccctgttgaaaaaagttacaaaaataaatcttaaagttagttttttgtaacacgaatttaactgtcagacagttagtgtaggtgtgttgcgtcatctgttttcaaccagattgcatttatggacttttcacacactcattttgaggaccccaggttcaaaagtaaaagcagtggccctgctttggggtccaagaataggagtgatgggtgaagggacctaagctggccaatagccctctgccccagacatgggatgtggatccttgaggtttctggtgaaatctgcacatctgtgtttttatatctgttccctaccctgtaatccctaccacgtgcacttgttctgtggttttggtctcttgtttaattgcacacaagtaatactactgggtaaccagaatcaggtgtgaatgtgttgagattttttactgttttgcatgataggaaaattgagaaagaatacgtataaaagatagagaggcataacatcaatgcagagttggaagttggctcccaagggctgacatggtgtgagtgtgtgggtgtgtgataagcttctcatccctgcatagatgcagtattcttagccttagtagaaaaacctggtttagtggtttaagccttgtgtggcagatagatcttaaagggcaaagcagtatattggtagttgtcaatatagcagtgctagctctgtctatataaatagagaaatggggttagccatagaggttaaaactacctggttatcccatataataacacaaactgggtcttggatacacagttgtatttaatgttttacgatctagcctttccagtacaggcactttctgagaaacctttgtcctcacttgaggcattttgttgtcgggtttttgtgtttgtttttgtgggtatttgcctcattccacccctgagctttcaggtagacagacgtgattcaaaactctgttctaaggtgtttattgtagtggagtaatgggtttgcagtgataagtcatacttttccaccgaaagggagggcttgggaatccctgagattagctaaagttaagttgttggaagaattccttgattggaaattgtacctttgtgttttgttgctctgtttcctgaaaataactcggggatgctcctggtttgtccatctactgctttgattccttggatcccacccattctttcactttaagaaaaaacaaataattgttgcagaggtctctgtattttgcagctgcccttttgtaagaagcacttttcccaaataaaacaatt

SEQ ID NO: 4846 - DNA, 1601 bp, Homo sapiens
gctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtattttatgcatggggtttgtaaggaaggagacaactgtcgctactcgcatgacctctctgacagtccgtatagtgtagtgtgcaagtattttcagcgagggtactgtatttatggagaccgctgcagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtactgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaatcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtgagactcctccccagtcttcatttgtgctttctcttttggggaagaatttagtaacttgtgccaactttcaaccagatggaccgcatttaaatgcatgcattttatcttgaaactgggatattctaatggggatttcttctttgtatttcagctagcttctaggttagttggtctatctacttttatttgaatgaggaaaccctgtgtatcagttagaatcttcgtgctttttctgaggagattgtgtttaatggattattagccagtttaggctcagtgaacaaactgatctagctctgaatgtatgtttcctgacgttttacatttccactttcctattccattcattaagctagccaacaatccaccatcctttaaagattgttctcataactgaacaaaaaccacataatctaaacagagcaaagctacaagaaataaatttatttaaacgaaa

SEQ ID NO: 4847 - DNA, 2553 bp, Homo sapiens
atgttcgcggctgtagctgaaggacttacttgaagaaagtttaccaaggagaatgactaatttccctgcatacaggagtggggctcggggataccacagagcttataagggcgatgtttgatcgtgtatcgcaacgtaacccattcaggtcctaactttaaacacctaacctctgctgggcgccagactttgtagtgcgcctgcgccttgcccttggctgcgtggttgccaggaaaccgcgaagccgcggtccctgcctctgagtctctctcgaccatggccaaattcgtcatcgcgggtagagcagattgtccatattatgctaaaacagaacttgtggcagactatttacaaaagaatcttcctgattttcggatacataaaatcacacaacgtcctgaggtttgggaggattggctaaaagatgtgtgtgaaaagaataagtggagtcacaagaattcccctatcatctggagagagctgttggatcgtggaggaaagggtttgcttttgggaggatataatgagttcctggagcatgctcagctttattatgatgtcacctctagcatgacgactgaactgatgatggtaattgctcaagagaacctgggggcacatatagaaaaagagcaggaggaagaagccctgaaaacttgcatcaaccccttgcaggtctggatcaccagtgcctctgctcctgcctgctacaacctaattcccatattgacgagtggcgaagtgtttgggatgcatacagaaattagcataactctatttgacaacaagcaggcggaagaacatctcaaaagccttgtggtggagacccaagacctggcatctcccgtcctgcgcagtgtctccatctgcacgaaggtggaggaggccttccgccaggcccacgtcattgtggtgctggatgacagcaccaacaaggaggtgttcactctggaggactgcctccgaagcagggtgcctctctgcaggctctatgggtacctgatagagaaaaatgctcatgagtctgtcagagtcatcgtgggagggagaacctttgtaaacctgaagacagttttactcatgagatatgccccacgcattgcacacaacattattgctgtggcgctgggggtggaaggtgaagcgaaagccatactggccagaaaactgaagacagctccttcatacattaaagacgtgatcatttggggtaatatcagtggaaataattacgttgatctgagaaaaacaagggtgtacagatatgagagtgccatttggggacctcttcattattcacgccctgttttaaacttgatttttgacagtgagtgggtaaaaagagaatttgtggcaattcttaaaaacttgaccaccacaggaagacaatttggaggcattttggctgcacacagtatagccactacactgaaatactggtaccatggctcaccacctggggagattgtatctttaggaatattgagtgaaggccagtttggtattccgaaagggatcgtcttttctatgcctgtgaaatttgagaatggaacttgggtggttcttacagatctcaaagatgttgaaataagtgaacaaataatgacccgaatgacaagtgatctaattcaggagaaacttgttgcacttggagacaagatacattttcagccataccaatcaggacataaagatctggtccctgatgaagaaaaaaatctagctatgtcagatgcagcagagtttccaaatcagattcctcaaaccacctttgaaaagccacagagtcttgagttcctaaatgaatttgaaggcaaaaccgtggaatcctaacagatcaaattggatgaaatatataattacttgatagcacaataaacatagaaagaatttatatgaatgtctatatttaaggaagaataatttgaaagatttatgtcagtcttagataataccatgcaaggcaattaaatcactgtgacagcacagaggtcagagttccgtcattttgcattacttgtatccactcatgtttgtttcataataattgcattttcttagaactattttggtgtcaaatgctattttttatattacattaaaatagagttgtcagtcattgcatctgcccatacatcttctgagagaacctgcttccttccatcagccatacctaagacctgcacctaagtggccatgtttgctcaaatgtcctcatcaccttggcctcaactaattaggccaaacagatgtacttcactcaaggagaaccaatcatattttctctctgtctctcaaaaaaaaattgaactgagaccagtgagtaagttggtgtctgggtcaggttaatggtggtgaactatgtgcctgtgagctcttcagagctggttgggttcaccaccttcataagacctgcctctgtaccatttttccttgagtgtgctttgtataaaggtctgtacaataaatcacacttttttaaagcttagattgaataggtttctgctccttgacaagagatatggcctgaataaaatgaattttgaaagaaaa

SEQ ID NO: 4848 - DNA, 1128 bp, Homo sapiens
atgttcgcggctgtagctgaaggacttacttgaagaaagtttaccaaggagaatgactaatttccctgcatacaggagtggggctcggggataccacagagcttataagggcgatgtttgatcgtgtatcgcaacgtaacccattcaggtcctaactttaaacacctaacctctgctgggcgccagactttgtagtgcgcctgcgccttgcccttggctgcgtggttgccaggaaaccgcgaagccgcggtccctgcctctgagtctctctcgaccatggccaaattcgtcatcgcgggtagagcagattgtccatattatgctaaaacagaacttgtggcagactatttacaaaagaatcttcctgattttcggatacataaaatcacacaacgtcctgaggtttgggaggattggctaaaagatgtgtgtgaaaagaataagtggagtcacaagaattcccctatcatctggagagagctgttggatcgtggaggaaagggtttgcttttgggaggatataatgagttcctggagcatgctcagctttattatgatgtcacctctagcatgacgactgaactgatgatggtaattgctcaagagaacctgggggcacatatagaaaaagagcaggaggaagaagccctgaaaacttgcatcaaccccttgcaggtctggatcaccagtgagtgggtaaaaagagaatttgtggcaattcttaaaaacttgaccaccacaggaagacaatttggaggcattttggctgcacacagtatagccactacactgaaatactggtaccatggctcaccacctggggagattgtatctttaggaatattgagtgaaggccagtttggtattccgaaagggatcgtcttttctatgcctgtgaaatttgagaatggaacttgggtggttcttacagatctcaaagatgttgaaataagtgaacaaataatgacccgaatgacaagtgatctaattcaggagaaacttgttgcacttggagacaagatacattttcagccataccaatcagacacacccaggatcaatactttgcatccttcaatccaatcaagttggcactcggtattaaccatcacaattagaaaaagataa

SEQ ID NO: 4849 - DNA, 1795 bp, Homo sapiens
gagtctctctcgaccatggccaaattcgtcatcgcgggtagagcagattgtccatattatgctaaaacagaacttgtggcagactatttacaaaagaatcttcctgattttcggatacataaaatcacacaacgtcctgaggtttgggaggattggctaaaagatgtgtgtgaaaagaataagtggagtcacaagaattcccctatcatctggagagagctgttggatcgtggaggaaagggtttgcttttgggaggatataatgagttcctggagcatgctcagctttattatgatgtcacctctagcatgacgactgaactgatgatggtaattgctcaagagaacctgggggcacatatagaaaaagagcaggaggaagaagccctgaaaacttgcatcaaccccttgcaggtctggatcaccagtgcctctgctcctgcctgctacaacctaattcccatattgacgagtggcgaagtgtttgggatgcatacagaaattagcataactctatttgacaacaagcaggcggaagaacatctcaaaagccttgtggtggagacccaagacctggcatctcccgtcctgcgcagtgtctccatctgcacgaaggtggaggaggccttccgccaggcccacgtcattgtggtgctggatgacagcaccaacaaggaggtgttcactctggaggactgcctccgaagcagggtgcctctctgcaggctctatgggtacctgatagagaaaaatgctcatgagtctgtcagagtcatcgtgggagggagaacctttgtaaacctgaagacagttttactcatgagatatgccccacgcattgcacacaacattattgctgtggcgctgggggtggaaggtgaagcgaaagccatactggccagaaaactgaagacagctccttcatacattaaagacgtgatcatttggggtaatatcagtggaaataattacgttgatctgagaaaaacaagggtgtacagatatgagagtgccatttggggacctcttcattattcacgccctgttttaaacttgatttttgacagtgagtgggtaaaaagagaatttgtggcaattcttaaaaacttgaccaccacaggaagacaatttggaggcattttggctgcacacagtatagccactacactgaaatactggtaccatggctcaccacctggggagattgtatctttaggaatattgagtgaaggccagtttggtattccgaaagggatcgtcttttctatgcctgtgaaatttgagaatggaacttgggtggttcttacagatctcaaagatgttgaaataagtgaacaaataatgacccgaatgacaagtgatctaattcaggagaaacttgttgcacttggagacaagatacattttcagccataccaatcaggacataaagatctggtccctgatgaagaaaaaaatctagctatgtcagatgcagagtttccaaatcagattcctcaaaccacctttgaaaagccacagagtcttgagttcctaaatgaatttgaaggcaaaaccgtggaatcctaacagatcaaattggatgaaatatataattacttgatagcacaataaacatagaaagaatttatatgaatgtctatatttaaggaagaataatttgaaagatttatgtcagtcttagataataccatgcaaggcaattaaatcactgtgacagcacagaggtcagagttccgtcattttgcattacttgtatccactcatgtttgtttcataataattgcattttctt

SEQ ID NO: 4850 - DNA, 819 bp, Homo sapiens
atcgcacgtgcacgccctgcgcgcgtgctgcgtgaggacgcgtgcgcatgcggacgcgcgcgggttcggtgcggcgcggcgggcttggcagtgcgcctgtgcggccggcgcatcccgatggagcgcggcggcggcggctccgggacgggatcccggcctgaggggactgcgcggggaacctctctcccagggaagatcgcagaaccgggcgcggtgcggacctctcagcccaactaccggcctcaaggcatggagggatttttgaaatcagatgagaggcagagattggccaaagaaagacgagaagaaagagaaaaatgtctggctgctcgggagcaacagatcctggagaaacagaaaagagccaggctgcagtacgaaaagcaaatggaggagcgatggcgaaaactggaagagcagcggcagcgggaggaccaaaagagagctgctgtggaagagaaaaggaaacagaagctccgggaggaggaggaacggctggaggcgatgatgcgccggtccctggagcgcacacagcagctggagctgaaaaagaagtattcgtggggagcaccactggccattggacccggaggacatgatggtgaatcagaaaataccccaccccctcctctaggtttagcagccagcaccctccctccggatgcagggaccactgccgcagctgccgagtccaccaacgcatgtgacaaactttcaacatcaactatgagtttgccaaagccaacggagcctcccatgaataaacgcctgtcttcatccaccgtggcaatatcctattccccagaccgagatgaaaag

SEQ ID NO: 4851 - DNA, 3918 bp, Homo sapiens
cgggcttggcagtgcgcctgtgcggccggcgcatcccgatggagcgcggcggcggcggctccgggacgggatcccggcctgaggggactgcgcggggaacctctctcccagggaagatcgcagaaccgggcgcggtgcggacctctcagcccaactaccggcctcaaggcatggagggatttttgaaatcagatgagaggcagagattggccaaagaaagacgagaagaaagagaaaaatgtctggctgctcgggagcaacagatcctggagaaacagaaaagagccaggctgcagtacgaaaagcaaatggaggagcgatggcgaaaactggaagagcagcggcagcgggaggaccaaaagagagctgctgtggaagagaaaaggaaacagaagctccgggaggaggaggaacggctggaggcgatgatgcgccggtccctggagcgcacacagcagctggagctgaaaaagaagtattcgtggggagcaccactggccattggacccggaggacatgatgcatgtgacaaactttcaacatcaactatgagtttgccaaagccaacggagcctcccatgaataaacgcctgtcttcatccaccgtggcaatatcctattccccagaccgagctcatcacatgcaccttagtccaatggaagccattcttgtttcgcgactgttgacacccacacagtcttctttagccagaagcagagcttcagtcatgctctctgggcaggccaatgattcagtattccatgtctgtcctcgtttagctcctcttggccctcttaacccttcttacaagtcttcacccactcgaaacattgagaagaagaaagctacatctacgtctacatctggtgcaggagatgttgggaaagaagccctttcaggaggagaggcctctctggtggagaaggtgaagcgggggcaacgaacagcaacttctcttcctgttgtgaacttcgggtcccctctgagaagatgtgagttttctggaggcattcctaagagaccatcttctcctgtgatatccaagacagctactaaagcttatccacagtctccaaagacaacgaaacctccctacccagggtctcctgtgaagtaccgcttacctgccctttctggccaagacatgcccaagaggaaagcggagaaagagaagagcaacaaggaaagggaaggtaccttggctcagcaggctgctggcccgcaaggagaggaagccctagagaagcatgtagtggacaagcatgccagcgagaagcatgctgctgccgcaggagggaaagccgaaaacagcgcagccttggggaagcccacagcaggcaccactgatgcaggagaggctgcgaagatcttggctgaaaagagaagacaggcccggctgcagaaggaacaggaggagcaagaacgactggagaaggaagaacaagataggctggagagagaggaattgaaaagaaaggcagaggaggaaaggcttcgcctagaagaggaagcccgaaagcaggaagaagaaaggaagcggcaggaagaggaaaagaaaaaacaggaaggggaagagaaaagaaaggcaggcgaggaggccaagcggaaggctgaggaggagctgttgttgaaagaaaagcaagaacaagaaaaacaagagaaagccatgattgaaaagcagaaagaagcagcagaaacaaaggcccgggaggtagctgaacagatgcgtctcgagagagaacagattatgctgcagattgagcaggagagactggagagaaagaagagaatagatgaaatcatgaagagaacaaggaaaagtgatgtgtctccacaagtgaagaaagaagaccccaaagtgggggtccagcctgctgtgtgtgtggaaaagaagacaaaactggttgtccccaacaaaatggaaatcaatggattgaacacctgccaggaagttaatggtgtggatcacgctgccccagaaacttatccccaagacattttctctaatgggcttaagccagctgggggactcattcatctggatgcccttgatgggaaatcaaatagcctggatgattcaactgaagaagttcagtctatggatgtgagtcctgtttcaaaagaagagcttatctctatcccggaattttcaccagtgagtgaaatgattcctggggtgtctctggaccaaaatggaactggtaatgcccgagcacttcaagatctcttagatttcactggtcccccgacattccccaagagatccagtgaaaatctcagcctggacgactgtaacaaaaaccttatcgaaggatttaacagtcctggccaagaaactcctctcaacaccttctgttgacaaatacagcatccctttaataaaaggtgtttggagaacccgtaaagctgctgatagtcaaatccgagctactagctgcttgaagaagcttctgtcacccttaccgctggatcccaaattattagctcggaatgtaactgtattcctaggtagtatgtcaaacactggccactcttggtagaaaccttgaaactttcaccttgctgggctttagcaaagtttccttttacagttctgtttatgagcttcagctactgataaagcacttcctgaacttctctattatcatagtgaccctctgaataacctgagtgactggctcggcaattcgctttataaccattcttattcccaaagttggagcacataaacatttagatgtcttttcctgtaaaatattctagacatttacccaaactctagttcaacatatactcaacttgcactgtatatctccctgtcttttttgagacagagaagaaattcaggaggttccccatctccagagtttctctgttggaaagcagtatcaagaagcctttaaaaaattgttgttaagctttgccacctgcagaaatgcattgccccacattattcttctggggttaaagtagtaagtttggttgaggaaggaagtcaaaacagtcagtaatgatttctgttctcttatgcatattcgtgtatacatgggcaactgaatctagcaaggactctttcgtgtcacaccttaaaatcttcatgctgtagtcactccagaccatggagtggctttccagctgaatgaatcctatgtctcgcgtgcaggtggttggttttcaatgttcttgctaattttttttctattggatcttgggagttttctttgtttgctcctgtgtttgcccagctttaataaaaccaggcgcaaacaaaaaccatagcattctgaaacaatagggggcccacattggacccagtatgtcactttaatggacttcaagaaaaaatctgaatgggaaaaatgacactagaatgtatactccacacattttatgccatataatggtgtgttttcttaattttgtttcttgtggcgaaatgtggctttcaaattaaaatgaccttttcttctttgaaactttttgttttgacttgtataattaagggtttggaaagattcataattctgagagaggtttgcaaccaggagatacaaagaagtctcagtagtaatcttgttcatgtgcttttacagccagctacatttaagaatgtattagttacagaaattatatgtctgtgtatgtgtctctactcaataaagtacatgcctccacataatgcggtgctgtccatctcggcaaatactggccaagtccctttatgacaggcacacagaaaccatagcatggtctggctttcagaaaatgcctctcatctttcctggaaccttattttgctaaatgtctgttttcttgtgatttgttgtacctcacagcaccattgtgaccatggtgatgcctcatttgcatgatatgtaccttgtgtttaatgtgaaatacattttcattgaagagtc

SEQ ID NO: 4852 - DNA, 3930 bp, Homo sapiens
gtgcggccggcgcatcccgatggagcgcggcggcggcggctccgggacgggatcccggcctgaggggactgcgcggggaacctctctcccagggaagatcgcagaaccgggcgcggtgcggacctctcagcccaactaccggcctcaaggcatggagggatttttgaaatcagatgagaggcagagattggccaaagaaagacgagaagaaagagaaaaatgtctggctgctcgggagcaacagatcctggagaaacagaaaagagccaggctgcagtacgaaaagcaaatggaggagcgatggcgaaaactggaagagcagcggcagcgggaggaccaaaagagagctgctgtggaagagaaaaggaaacagaagctccgggaggaggaggaacggctggaggcgatgatgcgccggtccctggagcgcacacagcagctggagctgaaaaagaagtattcgtggggagcaccactggccattggacccggaggacatgatgcatgtgacaaactttcaacatcaactatgagtttgccaaagccaacggagcctcccatgaataaacgcctgtcttcatccaccgtggcaatatcctattccccagaccgagtattccatgtctgtcctcgtttagctcctcttggccctcttaacccttcttacaagtcttcacccactcgaaacattgagaagaagaaagctacatctacgtctacatctggtgcaggagatgttgggaaagaagccctttcaggaggagaggcctctctggtggagaaggtgaagcgggggcaacgaacagcaacttctcttcctgttgtgaacttcgggtcccctctgagaagatgtgagttttctggaggcattcctaagagaccatcttctcctgtgatatccaagacagctactaaagcttatccacagtctccaaagacaacgaaacctccctacccagggtctcctgtgaagtaccgcttacctgccctttctggccaagacatgcccaagaggaaagcggagaaagagaagagcaacaaggaaagggaaggtaccttggctcagcaggctgctggcccgcaaggagaggaagccctagagaagcatgtagtggacaagcatgccagcgagaagcatgctgctgccgcaggagggaaagccgaaaacagcgcagccttggggaagcccacagcaggcaccactgatgcaggagaggctgcgaagatcttggctgaaaagagaagacaggcccggctgcagaaggaacaggaggagcaagaacgactggagaaggaagaacaagataggctggagagagaggaattgaaaagaaaggcagaggaggaaaggcttcgcctagaagaggaagcccgaaagcaggaagaagaaaggaagcggcaggaagaggaaaagaaaaaacaggaaggggaagagaaaagaaaggcaggcgaggaggccaagcggaaggctgaggaggagctgttgttgaaagaaaagcaagaacaagaaaaacaagagaaagccatgattgaaaagcagaaagaagcagcagaaacaaaggcccgggaggtagctgaacagatgcgtctcgagagagaacagattatgctgcagattgagcaggagagactggagagaaagaagagaatagatgaaatcatgaagagaacaaggaaaagtgatgtgtctccacaagtgaagaaagaagaccccaaagtgggggtccagcctgctgtgtgtgtggaaaagaagacaaaactggttgtccccaacaaaatggaaatcaatggattgaacacctgccaggaagttaatggtgtggatcacgctgccccagaaacttatccccaagacattttctctaatgggcttaagccagctgggggactcattcatctggatgcccttgatgggaaatcaaatagcctggatgattcaactgaagaagttcagtctatggatgtgagtcctgtttcaaaagaagagcttatctctatcccggaattttcaccagtgagtgaaatgattcctggggtgtctctggaccaaaatggaactggtaatgcccgagcacttcaagatctcttagatttcactggtcccccgacattccccaagagatccagtgaaaatctcagcctggacgactgtaacaaaaaccttatcgaaggatttaacagtcctggccaagaaactcctctcaacaccttctgttgacaaatacagcatccctttaataaaaggtgtttggagaacccgtaaagctgctgatagtcaaatccgagctactagctgcttgaagaagcttctgtcacccttaccgctggatcccaaattattagctcggaatgtaactgtattcctaggtagtatgtcaaacactggccactcttggtagaaaccttgaaactttcaccttgctgggctttagcaaagtttccttttacagttctgtttatgagcttcagctactgataaagcacttcctgaacttctctattatcatagtgaccctctgaataacctgagtgactggctcggcaattcgctttataaccattcttattcccaaagttggagcacataaacatttagatgtcttttcctgtaaaatattctagacatttacccaaactctagttcaacatatactcaacttgcactgtatatctccctgtcttttttgagacagagaagaaattcaggaggttccccatctccagagtttctctgttggaaagcagtatcaagaagcctttaaaaaattgttgttaagctttgccacctgcagaaatgcattgccccacattattcttctggggttaaagtagtaagtttggttgaggaaggaagtcaaaacagtcagtaatgatttctgttctcttatgcatattcgtgtatacatgggcaactgaatctagcaaggactctttcgtgtcacaccttaaaatcttcatgctgtagtcactccagaccatggagtggctttccagctgaatgaatcctatgtctcgcgtgcaggtggttggttttcaatgttcttgctaattttttttctattggatcttgggagttttctttgtttgctcctgtgtttgcccagctttaataaaaccaggcgcaaacaaaaaccatagcattctgaaacaatagggggcccacattggacccagtatgtcactttaatggacttcaagaaaaaatctgaatgggaaaaatgacactagaatgtatactccacacattttatgccatataatggtgtgttttcttaattttgtttcttgtggcgaaatgtggctttcaaattaaaatgaccttttcttctttgaaactttttgttttgacttgtataattaagggtttggaaagattcataattctgagagaggtttgcaaccaggagatacaaagaagtctcagtagtaatcttgttcatgtgcttttacagccagctacatttaagaatgtattagttacagaaattatatgtctgtgtatgtgtctctactcaataaagtacatgcctccacataatgcggtgctgtccatctcggcaaatactggccaagtccctttatgacaggcacacagaaaccatagcatggtctggctttcagaaaatgcctctcatctttcctggaaccttattttgctaaatgtctgttttcttgtgatttgttgtacctcacagcaccattgtgaccatggtgatgcctcatttgcatgatatgtaccttgtgtttaatgtgaaatacattttcattgaagagtctgatgacttgctagcgttttattttttctgtaagctcaatgtgctgaaaccaaaccaggcttttaaaaacctgtgtagaagaaaaccaaaaaatcctgtgtgggtgtcctttccctgtcaaactcattaaaaattcctttgttgccagtgccaa

SEQ ID NO: 4853 - DNA, 2476 bp, Homo sapiens
gcgcctgtgcggccggcgcatcccgatggagcgcggcggcggcggctccgggacgggatcccggcctgaggggactgcgcggggaacctctctcccagggaagatcgcagaaccgggcgcggtgcggacctctcagcccaactaccggcctcaaggcatggagggatttttgaaatcagatgagaggcagagattggccaaagaaagacgagaagaaagagaaaaatgtctggctgctcgggagcaacagatcctggagaaacagaaaagagccaggctgcagtacgaaaagcaaatggaggagcgatggcgaaaactggaagagcagcggcagcgggaggaccaaaagagagctgctgtggaagagaaaaggaaacagaagctccgggaggaggaggaacggctggaggcgatgatgcgccggtccctggagcgcacacagcagctggagctgaaaaagaagtattcgtggggagcaccactggccattggacccggaggacatgatgctcctcttggccctcttaacccttcttacaagtcttcacccactcgaaacattgagaagaagaaagctacatctacgtctacatctggtgcaggagatgttgggaaagaagccctttcaggaggagaggcctctctggtggagaaggtgaagcgggggcaacgaacagcaacttctcttcctgttgtgaacttcgggtcccctctgagaagatgtgagttttctggaggcattcctaagagaccatcttctcctgtgatatccaagacagctactaaagcttatccacagtctccaaagacaacgaaacctccctacccagggtctcctgtgaagtaccgcttacctgccctttctggccaagacatgcccaagaggaaagcggagaaagagaagagcaacaaggaaagggaaggtaccttggctcagcaggctgctggcccgcaaggagaggaagccctagagaagcatgtagtggacaagcatgccagcgagaagcatgctgctgccgcaggagggaaagccgaaaacagcgcagccttggggaagcccacagcaggcaccactgatgcaggagaggctgcgaagatcttggctgaaaagagaagacaggcccggctgcagaaggaacaggaggagcaagaacgactggagaaggaagaacaagataggctggagagagaggaattgaaaagaaaggcagaggaggaaaggcttcgcctagaagaggaagcccgaaagcaggaagaagaaaggaagcggcaggaagaggaaaagaaaaaacaggaaggggaagagaaaagaaaggcaggcgaggaggccaagcggaaggctgaggaggagctgttgttgaaagaaaagcaagaacaagaaaaacaagagaaagccatgattgaaaagcagaaagaagcagcagaaacaaaggcccgggaggtagctgaacagatgcgtctcgagagagaacagattatgctgcagattgagcaggagagactggagagaaagaagagaatagatgaaatcatgaagagaacaaggaaaagtgatgtgtctccacaagtgaagaaagaagaccccaaagtgggggtccagcctgctgtgtgtgtggaaaagaagacaaaactggttgtccccaacaaaatggaaatcaatggattgaacacctgccaggaagttaatggtgtggatcacgctgccccagaaacttatccccaagacattttctctaatgggcttaagccagctgggggactcattcatctggatgcccttgatgggaaatcaaatagcctggatgattcaactgaagaagttcagtctatggatgtgagtcctgtttcaaaagaagagcttatctctatcccggaattttcaccagtgagtgaaatgattcctggggtgtctctggaccaaaatggaactggtaatgcccgagcacttcaagatctcttagatttcactggtcccccgacattccccaagagatccagtgaaaatctcagcctggacgactgtaacaaaaaccttatcgaaggatttaacagtcctggccaagaaactcctctcaacaccttctgttgacaaatacagcatccctttaataaaaggtgtttggagaacccgtaaagctgctgatagtcaaatccgagctactagctgcttgaagaagcttctgtcacccttaccgctggatcccaaattattagctcggaatgtaactgtattcctaggtagtatgtcaaacactggccactcttggtagaaaccttgaaactttcaccttgctgggctttagcaaagtttccttttacagttctgtttatgagcttcagctactgataaagcacttcctgaacttctctattatcatagtgaccctctgaataacctgagtgactggctcggcaattcgctttataaccattcttattcccaaagttggagcacataaacatttagatgtctttt

SEQ ID NO: 4854 - DNA, 2233 bp, Homo sapiens
gagataaacgccctttccctggcccaggatcgtccggacgtgcatccaagggccgcacccctctctgtgcgagtggcggggttctttcttggggcgacctgggcatggagggatttttgaaatcagatgagaggcagagattggccaaagaaagacgagaagaaagagaaaaatgtctggctgctcgggagcaacagatcctggagaaacagaaaagagccaggctgcagtacgaaaagcaaatggaggagcgatggcgaaaactggaagagcagcggcagcgggaggaccaaaagagagctgctgtggaagagaaaaggaaacagaagctccgggaggaggaggaacggctggaggcgatgatgcgccggtccctggagcgcacacagcagctggagctgaaaaagaagtattcgtggggagcaccactggccattggacccggaggacatgatgcatgtgacaaactttcaacatcaactatgagtttgccaaagccaacggagcctcccatgaataaacgcctgtcttcatccaccgtggcaatatcctattccccagaccgagctcctcttggccctcttaacccttcttacaagtcttcacccactcgaaacattgagaagaagaaagctacatctacgtctacatctggtgcaggagatgttgggaaagaagccctttcaggaggagaggcctctctggtggagaaggtgaagcgggggcaacgaacagcaacttctcttcctgttgtgaacttcgggtcccctctgagaagatgtgagttttctggaggcattcctaagagaccatcttctcctgtgatatccaagacagctactaaagcttatccacagtctccaaagacaacgaaacctccctacccagggtctcctgtgaagtaccgcttacctgccctttctggccaagacatgcccaagaggaaagcggagaaagagaagagcaacaaggaaagggaaggtaccttggctcagcaggctgctggcccgcaaggagaggaagccctagagaagcatgtagtggacaagcatgccagcgagaagcatgctgctgccgcaggagggaaagccgaaaacagcgcagccttggggaagcccacagcaggcaccactgatgcaggagaggctgcgaagatcttggctgaaaagagaagacaggcccggctgcagaaggaacaggaggagcaagaacgactggagaaggaagaacaagataggctggagagagaggaattgaaaagaaaggcagaggaggaaaggcttcgcctagaagaggaagcccgaaagcaggaagaagaaaggaagcggcaggaagaggaaaagaaaaaacaggaaggggaagagaaaagaaaggcaggcgaggaggccaagcggaaggctgaggaggagctgttgttgaaagaaaagcaagaacaagaaaaacaagagaaagccatgattgaaaagcagaaagaagcagcagaaacaaaggcccgggaggtagctgaacagatgcgtctcgagagagaacagattatgctgcagattgagcaggagagactggagagaaagaagagaatagatgaaatcatgaagagaacaaggaaaagtgatgtgtctccacaagtgaagaaagaagaccccaaagtgggggtccagcctgctgtgtgtgtggaaaagaagacaaaactggttgtccccaacaaaatggaaatcaatggattgaacacctgccaggaagttaatggtgtggatcacgctgccccagaaacttatccccaagacattttctctaatgggcttaagccagctgggggactcattcatctggatgcccttgatgggaaatcaaatagcctggatgattcaactgaagaagttcagtctatggatgtgagtcctgtttcaaaagaagagcttatctctatcccggaattttcaccagtgagtgaaatgattcctggggtgtctctggaccaaaatggaactggtaatgcccgagcacttcaagatctcttagatttcactggtcccccgacattccccaagagatccagtgaaaatctcagcctggacgactgtaacaaaaaccttatcgaaggatttaacagtcctggccaagaaactcctctcaacaccttctgttgacaaatacagcatccctttaataaaaggtgtttggagaacccgtaaagctgctgatagtcaaatccgagctactagctgcttgaaga

SEQ ID NO: 4855 - DNA, 3409 bp, Homo sapiens
gatgatgcgccggtccctggagcgcacacagcagctggagctgaaaaagaagtattcgtggggagcaccactggccattggacccggaggacatgatggtttagcagccagcaccctccctccggatgcagggaccactgccgcagctgccgagtccaccaacgcatgtgacaaactttcaacatcaactatgagtttgccaaagccaacggagcctcccatgaataaacgcctgtcttcatccaccgtggcaatatcctattccccagaccgagctcctcttggccctcttaacccttcttacaagtcttcacccactcgaaacattgagaagaagaaagctacatctacgtctacatctggtgcaggagatgttgggaaagaagccctttcaggaggagaggcctctctggtggagaaggtgaagcgggggcaacgaacagcaacttctcttcctgttgtgaacttcgggtcccctctgagaagatgtgagttttctggaggcattcctaagagaccatcttctcctgtgatatccaagacagctactaaagcttatccacagtctccaaagacaacgaaacctccctacccagggtctcctgtgaagtaccgcttacctgccctttctggccaagacatgcccaagaggaaagcggagaaagagaagagcaacaaggaaagggaaggtaccttggctcagcaggctgctggcccgcaaggagaggaagccctagagaagcatgtagtggacaagcatgccagcgagaagcatgctgctgccgcaggagggaaagccgaaaacagcgcagccttggggaagcccacagcaggcaccactgatgcaggagaggctgcgaagatcttggctgaaaagagaagacaggcccggctgcagaaggaacaggaggagcaagaacgactggagaaggaagaacaagataggctggagagagaggaattgaaaagaaaggcagaggaggaaaggcttcgcctagaagaggaagcccgaaagcaggaagaagaaaggaagcggcaggaagaggaaaagaaaaaacaggaaggggaagagaaaagaaaggcaggcgaggaggccaagcggaaggctgaggaggagctgttgttgaaagaaaagcaagaacaagaaaaacaagagaaagccatgattgaaaagcagaaagaagcagcagaaacaaaggcccgggaggtagctgaacagatgcgtctcgagagagaacagattatgctgcagattgagcaggagagactggagagaaagaagagaatagatgaaatcatgaagagaacaaggaaaagtgatgtgtctccacaagtgaagaaagaagaccccaaagtgggggtccagcctgctgtgtgtgtggaaaagaagacaaaactggttgtccccaacaaaatggaaatcaatggattgaacacctgccaggaagttaatggtgtggatcacgctgccccagaaacttatccccaagacattttctctaatgggcttaagccagctgggggactcattcatctggatgcccttgatgggaaatcaaatagcctggatgattcaactgaagaagttcagtctatggatgtgagtcctgtttcaaaagaagagcttatctctatcccggaattttcaccagtgagtgaaatgattcctggggtgtctctggaccaaaatggaactggtaatgcccgagcacttcaagatctcttagatttcactggtcccccgacattccccaagagatccagtgaaaatctcagcctggacgactgtaacaaaaaccttatcgaaggatttaacagtcctggccaagaaactcctctcaacaccttctgttgacaaatacagcatccctttaataaaaggtgtttggagaacccgtaaagctgctgatagtcaaatccgagctactagctgcttgaagaagcttctgtcacccttaccgctggatcccaaattattagctcggaatgtaactgtattcctaggtagtatgtcaaacactggccactcttggtagaaaccttgaaactttcaccttgctgggctttagcaaagtttccttttacagttctgtttatgagcttcagctactgataaagcacttcctgaacttctctattatcatagtgaccctctgaataacctgagtgactggctcggcaattcgctttataaccattcttattcccaaagttggagcacataaacatttagatgtcttttcctgtaaaatattctagacatttacccaaactctagttcaacatatactcaacttgcactgtatatctccctgtcttttttgagacagagaagaaattcaggaggttccccatctccagagtttctctgttggaaagcagtatcaagaagcctttaaaaaattgttgttaagctttgccacctgcagaaatgcattgccccacattattcttctggggttaaagtagtaagtttggttgaggaaggaagtcaaaacagtcagtaatgatttctgttctcttatgcatattcgtgtatacatgggcaactgaatctagcaaggactctttcgtgtcacaccttaaaatcttcatgctgtagtcactccagaccatggagtggctttccagctgaatgaatcctatgtctcgcgtgcaggtggttggttttcaatgttcttgctaattttttttctattggatcttgggagttttctttgtttgctcctgtgtttgcccagctttaataaaaccaggcgcaaacaaaaaccatagcattctgaaacaatagggggcccacattggacccagtatgtcactttaatggacttcaagaaaaaatctgaatgggaaaaatgacactagaatgtatactccacacattttatgccatataatggtgtgttttcttaattttgtttcttgtggcgaaatgtggctttcaaattaaaatgaccttttcttctttgaaactttttgttttgacttgtataattaagggtttggaaagattcataattctgagagaggtttgcaaccaggagatacaaagaagtctcagtagtaatcttgttcatgtgcttttacagccagctacatttaagaatgtattagttacagaaattatatgtctgtgtatgtgtctctactcaataaagtacatgcctccacataatgcggtgctgtccatctcggcaaatactggccaagtccctttatgacaggcacacagaaaccatagcatggtctggctttcagaaaatgcctctcatctttcctggaaccttattttgctaaatgtctgttttcttgtgatttgttgtacctcacagcaccattgtgaccatggtgatgcctcatttgcatgatatgtaccttgtgtttaatgtgaaatacattttcattgaag

SEQ ID NO: 4856 - DNA, 1530 bp, Homo sapiens
gcgcctgtgcggccggcgcatcccgatggagcgcggcggcggcggctccgggacgggatcccggcctgaggggactgcgcggggaacctctctcccagggaagatcgcagaaccgggcgcggtgcggacctctcagcccaactaccggcctcaaggcatggagggatttttgaaatcagatgagaggcagagattggccaaagaaagacgagaagaaagagaaaaatgtctggctgctcgggagcaacagatcctggagaaacagaaaagagccaggctgcagtacgaaaagcaaatggaggagcgatggcgaaaactggaagagcagcggcagcgggaggaccaaaagagagctgctgtggaagagaaaaggaaacagtgcagccttggggaagcccacagcaggcaccactgatgcaggagaggctgcgaagatcttggctgaaaagagaagacaggcccggctgcagaaggaacaggaggagcaagaacgactggagaaggaagaacaagataggctggagagagaggaattgaaaagaaaggcagaggaggaaaggcttcgcctagaagaggaagcccgaaagcaggaagaagaaaggaagcggcaggaagaggaaaagaaaaaacaggaaggggaagagaaaagaaaggcaggcgaggaggccaagcggaaggctgaggaggagctgttgttgaaagaaaagcaagaacaagaaaaacaagagaaagccatgattgaaaagcagaaagaagcagcagaaacaaaggcccgggaggtagctgaacagatgcgtctcgagagagaacagattatgctgcagattgagcaggagagactggagagaaagaagagaatagatgaaatcatgaagagaacaaggaaaagtgatgtgtctccacaagtgaagaaagaagaccccaaagtgggggtccagcctgctgtgtgtgtggaaaagaagacaaaactggttgtccccaacaaaatggaaatcaatggattgaacacctgccaggaagttaatggtgtggatcacgctgccccagaaacttatccccaagacattttctctaatgggcttaagccagctgggggactcattcatctggatgcccttgatgggaaatcaaatagcctggatgattcaactgaagaagttcagtctatggatgtgagtcctgtttcaaaagaagagcttatctctatcccggaattttcaccagtgagtgaaatgattcctggggtgtctctggaccaaaatggaactggtaatgcccgagcacttcaagatctcttagatttcactggtcccccgacattccccaagagatccagtgaaaatctcagcctggacgactgtaacaaaaaccttatcgaaggatttaacagtcctggccaagaaactcctctcaacaccttctgttgacaaatacagcatccctttaataaaaggtgtttggagaacccgtaaagctgctgatagtcaaatccgagctactagctgcttgaagaagcttctgtcaccctta

SEQ ID NO: 4857 - DNA, 3219 bp, Homo sapiens
gaaaggaggagaggaagagaggactaagaggggagcaaggcgaggaggccgcggcgggcgcagcgggcacctgggccgtgctgcccccgcgagcaaggcgccgccattccgctgctcggggcgccgccgccgccgccaccgcgcccaggggccatgctcccgccgcccccgcgccagccgccgccccaggcgcgtgcggcccgcggcgcggtgcgcctgcagcggcccttcctgcgcagcccgctgggcgtgttgcggctgctgcagctgctggccggcgctgccttctggatcactatcgccaccagcaagtaccagggccccgtgcacttcgcgctcttcgtgtccgtgctcttctggctgctcaccctgggcctctacttcctcacgctgctgggcaagcacgagctggtccccgtgctgggctcgcgctggctcatggtcaacgtggcgcacgatgtgctggcggccgcgctctacggcgccgccaccggcatcatgagcgaccagatgcagcgccacagctactgcaacctcaaggattacccgctcccctgcgcctaccacgccttcctggcggccgccgtctgcggcggcgtctgccacggcctctacctgctttcggcgctctatggctgcgggcgtcgctgccagggcaagcaggaggtggcgtgaggccgcccgcgcccgccgcggccccgatcggggcgggggaatccccggagaccagcctccttaatcccttcccccgccgccgccccgcgcgggtgcgccctggcaccctctccctgccctccagcgtttccactgtcgcccgcgcccgggaaccctgacgctcagctcccgcccgacggcagcgccgccgccgcccagaatcccagcccagaatcccgaccgccgcgccggacgcgccgtctcccgggacaagcgcaggctgcgatccgaggggctgacacacactcgcagacgagccgccccgaggcgaaacctcgcggttcctcttcccttccctgctgagactaagacgtggacaggggccgcgcagatccgggggaggctcccaaattggaaccaggcttctggctgcccccttccctcccgccccgtggtcggaagagcactcccttccctggcccctcatccagcctccggtgctgtaaaacgcaggcgctgggccgcgggcggagctgaggacaggccttggctggtcccaggatgagcgacgagtttggttttagctggggattgtgctggcatcctgcgaagctcctcccagccggtctctctgtgctcggttgtcttggggtggggcccatccgccgaggtggggaccgataggagaagccggtgggttgtacccttacacttgtggagtctcctcttgcctctacctactccgcctttgtccttaaggtttttgcaggccagtgccaaacacacactaactgtcctggcctctccgtgacacaagtctcttcccagccttcctcacaggcttctgccgcccccctcatctccaccctcccccatatctgtttgcattaggagttccacgaccatggtggaatgttaaggtgaaccccaccccttcttacagatggggacccagagcctgctcttgggaacagccagagtaagattggaacccagacttgcagtccagcgctgtttgcattaaaagggtgggtgagtcaggacccctggctcaggagccgcctctcctaaaagagggtttcaaggccaaatgggtttgtcaacggtgctgtctccctttcttggagatgctcattagcttatcaaagactgagaagtcccgctgttacagaaataatttagtttgctgtattaactgctcctgggcctggagcagtattcccaccttaagattcccagcatccctgtgctgtcccggctctcattcatgccgaagggcccaacccattggctgtgttctgtttgaagatttggggggcgccttctctttcttccccagggaattctctagcagagggaggggacccaccccagtgaggaagtagattgctgcctctagccagagacctgaactggggaatttgaacattcctttacattgttggagaaatgaagccaaagttattcagatggttttcccaggctaaaggaaagtcacctgcaagagatcccggcactgatctggagcagctgacagggtgggtctcccttaccaaagagaagaaccactctctggcgctggggtgacctgctggctgggcctgtaaggtttccatgttgctgaggccatggagattcccagagctggtcacaccgaccgctctcagggcccgctgccctgggctggcaacaccattctggccttggcctgcagaagctttcagagtcttcactggcagtagggggagatggggagaggaatgatctctgcccagccccttcctttccaaaccatgcaatggaagagcccagatgggtgaagattgattttgccttaactcaagagaattcctgttctccttgtgctatgatttggacacaagattctggatacctggaacttagctgtgtactcctgtaccctaaacagtggatttgagttccagcgtttattcttttttccttttttcagatcaccatctaagttacatctttagctcaggtccatccttctcaagatctccttcttagccccccagcccctggtgctgtctgtggtcaggtgaccttactcaggagcagatatctccttggccgccatggagcctcatccatccacacgtgcctgtagcattccagagctcactgcccttctagatgtgccttcccgcttggcttccagcggcttgtgctcactctgtctgccaggtatgagaagaacacgtaagaccgccaccacactcaccctccctcaaggccctgtgccataggggtggccacccgacctgcccccagaacttttggatactggaggcagttgcataggtctccctctctgggcaccaggactcagtccagcccaagactactctgggcagctcccatcccagtctggggccatttgcagactcaggaaaggatttctacagtgttctataaaagccaaaagagagagtgggtttgggaagagtgagggtggttggggagaggggaccgatgtgcctcattgtttagtggtgattacaaatatgcttttctggataaagtttggttgtttgctcttgg

SEQ ID NO: 4858 - DNA, 1526 bp, Homo sapiens
agtattatgcaaacctcatccaaaccctctgatttccttaacttggctaagaaaaagaggaagttctccgagttactcaccactgtggttctactatgccttctgaccccgtcttggacttcaactgggagaatgtggagccatttgaacaggctcctcttctggagcatattttcttctgtcacttgtagaaaagctgtattggattgtgaggcaatgaaaacaaatgaattcccttctccatgtttggactcaaagactaaggtggttatgaagggtcaaaatgtatctatgttttgttcccataagaacaaatcactgcagatcacctattcattgtttcgacgtaagacacacctgggaacccaggatggaaaaggtgaacctgcgatttttaacctaagcatcacagaagcccatgaatcaggcccctacaaatgcaaagcccaagttaccagctgttcaaaatacagtcgtgacttcagcttcacgattgtcgacccggtgacttccccagtgctgaacattatggtcattcaaacagaaacagaccgacatataacattacattgcctctcagtcaatggctcgctgcccatcaattacactttctttgaaaaccatgttgccatatcaccagctatttccaagtatgacagggagcctgctgaatttaacttaaccaagaagaatcctggagaagaggaagagtataggtgtgaagctaaaaacagattgcctaactatgcaacatacagtcaccctgtcaccatgccctcaacaggcggagacagctgtcctttctgtctgaagctactacttccagggttattactgttgctggtggtgataatcctaattctggctttttgggtactgcccaaatacaaaacaagaaaagctatgagaaataatgtgcccagggaccgtggagacacagccatggaagttggaatctatgcaaatatccttgaaaaacaagcaaaggaggaatctgtgccagaagtgggatccaggccgtgtgtttccacagcccaagatgaggccaaacactcccaggagctacagtatgccacccccgtgttccaggaggtggcaccaagagagcaagaagcctgtgattcttataaatctggatatgtctattctgaactcaacttctgaaatttacagaaacaaactacatctcaggatggagtctcactctgttgcccaggctggagttcagtagcgcgatcttggctcacttcaatctccatcttcccagttcaagcgattctcatgcctcgacctcccgagtagctgggattacaggtgcccgctaccacgcccagctaatttttgtatttttagtagagatggggtttcactatggtggccaggctggtcttgaactcctgacctcagatgatctgcctgcctcggcctcccaaagtgctggaactacaagcctgagccaccgtgcccggccctgaatcgctttagtaaataaagggtctccaagaataaattcatccgaacatgca

SEQ ID NO: 4859 - DNA, 1874 bp, Homo sapiens
cagaacccggactaagggctatataaagaggaacagttcaggaacttaggctagaaaggaacacagtaaactgaattgatccgtttagaagtttacaatgaagtttcttctaatactgctcctgcaggccactgcttctggagctcttcccctgaacagctctacaagcctggaaaaaaataatgtgctatttggtgaaagatacttagaaaaattttatggccttgagataaacaaacttccagtgacaaaaatgaaatatagtggaaacttaatgaaggaaaaaatccaagaaatgcagcacttcttgggtctgaaagtgaccgggcaactggacacatctaccctggagatgatgcacgcacctcgatgtggagtccccgatgtccatcatttcagggaaatgccaggggggcccgtatggaggaaacattatatcacctacagaatcaataattacacacctgacatgaaccgtgaggatgttgactacgcaatccggaaagctttccaagtatggagtaatgttacccccttgaaattcagcaagattaacacaggcatggctgacattttggtggtttttgcccgtggagctcatggagacttccatgcttttgatggcaaaggtggaatcctagcccatgcttttggacctggatctggcattggaggggatgcacatttcgatgaggacgaattctggactacacattcaggaggcacaaacttgttcctcactgctgttcacgagattggccattccttaggtcttggccattctagtgatccaaaggccgtaatgttccccacctacaaatatgttgacatcaacacatttcgcctctctgctgatgacatacgtggcattcagtccctgtatggagacccaaaagagaaccaacgcttgccaaatcctgacaattcagaaccagctctctgtgaccccaatttgagttttgatgctgtcactaccgtgggaaataagatctttttcttcaaagacaggttcttctggctgaaggtttctgagagaccaaagaccagtgttaatttaatttcttccttatggccaaccttgccatctggcattgaagctgcttatgaaattgaagccagaaatcaagtttttctttttaaagatgacaaatactggttaattagcaatttaagaccagagccaaattatcccaagagcatacattcttttggttttcctaactttgtgaaaaaaattgatgcagctgtttttaacccacgtttttataggacctacttctttgtagataaccagtattggaggtatgatgaaaggagacagatgatggaccctggttatcccaaactgattaccaagaacttccaaggaatcgggcctaaaattgatgcagtcttctactctaaaaacaaatactactatttcttccaaggatctaaccaatttgaatatgacttcctactccaacgtatcaccaaaacactgaaaagcaatagctggtttggttgttagaaatggtgtaattaatggtttttgttagttcacttcagcttaataagtatttattgcatatttgctatgtcctcagtgtaccactacttagagatatgtatcataaaaataaaatctgtaaaccataggtaatgattatataaaatacataatatttttcaattttgaaaactctaattgtccattcttgcttgactctactattaagtttgaaaatagttaccttcaaaggccaagagaattctatttgaagcatgctctgtaagttgcttcctaacatccttggactgagaaattatacttacttctggcataactaaaattaagtatatatattttggctcaaataaaattgaaaaaaaaa

SEQ ID NO: 4860 - DNA, 2274 bp, Homo sapiens
ggggcggagggcggtggccggccgcggtccgggcgtcaggccgggcggcgggggcggcagggaggcggcgctctggggccgcaggcggacgtactctgtgagcggcgcccgggcgcctgggcaggcgcctcccgagtaccggcgcccattttgcccgcccgctaaggagacccgtgcgcggcctacacgcttgggggacagccctttaagacgacatctccgcgaacgccggcctcttgagccagggggacgctcttttgaaagtcagtcccaaaacagttaaggttttattttattttgttttatttccaagtcacagcccccgaatctcgtacaactctccctggaccacttccggttgccggcccgcgcctcataacttcggttcgagtgacctcggcccgggatgcccctcggctcaccccgggctcacgtcgcgatcctggcttgagtggcccagggtgggagacctggaagttttagcctagctgttctcaaggcggattaattagcccaagaaacattatattcatgcttaggtggagaaaagcagggctagaattggaacccaaagcccagaatggcaggagaggatgtgggggctccacccgatcacctctgggttcaccaagagggtatctaccgcgacgaataccagcgcacgtgggtggccgtcgtggaagaggagacgagtttcctaagggcacgagtccagcaaattcaggttcccttaggtgacgcagctaggccaagtcaccttcttacctcccagctacctctcatgtggcaactctacccggaggagcgctacatggataacaactctcgcttgtggcagatacagcatcatttaatggtcaggggagtacaggagctgttgcttaagcttttgcctgatgactaacctggtgctgggattctacgaagatatgctcctttgttctgttcagtatttggcaatcacttcatccactactgcagtgcacccacccttgggcctggggggagggagtgggttgaaaaactgctcaagaaacagaagtttagcaagggtcatgaagaatactgcaagtgaaactgcagagagaggttacgtaggcagaaagcaagtcaacaaaagcacttagtcaggatccgtaacttgaaattgactcctttggaaattgccatagaacccttaatggacatcatcggctggacctgggatctgatgaatcccacaaaagtcagcaccttctacagaacagatgccctgatcaccaaggacttggtactgatttagagagaagagagcagctcctagcagcatcaacatctatttgtcgcttatttgccctgcagcaattcacctgcctttccttctcccatcctgtaaatatcctaggttttgctccagtgtttcccatcccagtactgacctaatttggatctgctgagtatttagagggctctgaaaagagatatgcattgatgaaattagctacaaaggcttgtgggcctttttttctatctgaaatcgtgtcttcaaattactggaagttgctgatcaaaattgtgggctcttgaattcattctctgattacagatattttaaataagctggtttctataagaacttcaagaaaaaccattttagctgcttaactggcacctttctcaggaagtaataacaccaaatattgctgattcctaggaaaacatttactacttgtaaagaatttcctgagttaaagtagttataacagtttatatacattaaaagtaaggttttactttaaaaaaaaaagtcttgggaataatagctaccatgtattggagtcctttccaggcactattgtatgtactttatatactttatcacatttaatcctcctgtcaatgctttgaggtaggtatgattcccattttatatatgagtaataaaaaaagctcaaggagtttaatcatttatcaagggtttcttctgcgaatgatagagccaggctgcgccgtcggctcctctagcctaacgttggtttacagtattcaaaaagagttgattgaattcaaggttttttttccatgtaaagctatttatatcttccaagcctaatgaaatggatattataaaaatacagttgattcatcctatgtttgggaagagtatttttagtgtaattattttccagcaattgtaagggcatatactgcttgtctcagaagaaaattccacgtagaggggctttaaagtctttatggaaaaaagaaaaataaaaatcatttttcttgttttag

SEQ ID NO: 4861 - DNA, 4980 bp, Homo sapiens
cggggcgcggttccggcgagattggcgacttgcttccttttgcagaacggccgctcctctctcggtccagctgcgacgctgggaaagcgccagacttggtctgtcacgggagcccccgcggggcgtggcgagggagagctggcctaggctgcgagggactctcgtttcttgcctggagagccaggaagagggcgagggcagagcatccttgggcggagatgcctttaaaaaatcatccaccgcagcggtagaaacagttttgtttggctttatttatacggaatggtttttcagtgaaatgctgtcttgcttaaaagaagagatgcctccccaggagctcacccggcgactggccacagtgatcactcatgtcgatgaaattatgcagcaggaagtcagacccctgatggcggtggagataatagaacaacttcacagacaatttgccattctttcaggaggccgaggggaggatggcgcccccatcatcacgttcccagagttttcggggttcaaacacatcccagatgaagacttcctgaatgtcatgacctacctgactagcatccccagtgtggaggctgccagcattggattcattgttgttatcgacagacgaagagacaagtggagctccgtaaaggcatccttgacacgaatagctgtggcatttccaggaaacttacagctcatattcatccttcgtccatctcgctttatccagaggacattcactgacattggcattaaatactatcgaaatgagtttaaaacgaaagtgccgatcatcatggtaaactctgtctctgaccttcacggctacatcgacaaaagccaactgacccgggaattaggggggactttggaatatcgccacggtcagtgggtaaatcaccgcactgccatcgaaaactttgccttgaccttgaagaccactgcccagatgctgcagacgtttgggtcctgcctggccacagcagagctgcccagaagcatgctatccacggaagaccttctcatgtcccacacaaggcagcgggacaagctgcaggatgagctgaaattacttggaaagcaggggaccacattgctgtcatgcatccaagaaccagcaaccaaatgtcccaacagcaaactcaatctcaaccaacttgagaatgtaactaccatggaaaggttattagttcaactggatgaaacagaaaaagcctttagtcacttttggtctgagcatcatctgaagcttaaccagtgcctacaactacagcattttgagcacgatttttgtaaggctaagcttgccctggataatttgctggaagagcaagcagagtttacaggcattggagacagcgtgatgcacgtggagcagattcttaaggaacacaaaaaactggaggaaaaaagccaggagcccctggaaaaggcccagctgctggcactggttggggaccagctcatccaaagccaccattatgcagcagatgccatcaggccccggtgtgtggagctcaggcacctctgtgacgatttcatcaatggaaacaagaaaaaatgggacattttaggaaagtccttagagtttcatagacagctggacaaggtcagccaatggtgtgaggcaggaatctacctcttggcttcccaagctgtagacaagtgccagtctcgagaaggggttgatatcgccttgaacgacattgcgacattcctgggcacagtcaaggagtacccgttgctcagccccaaggagttttacaacgagtttgagttgctgctcaccctcgatgcaaaggccaaagcccagaaagttttgcagaggctggatgatgtccaggaaatatttcacaagaggcaagtgagtctgatgaaactggcagccaaacagactcgtccagtgcaacctgtggccccacatcctgagtcttcaccaaaatgggtgtcatcaaaaaccagccagccctccacctcggtccctctagctcgtcctctgagaacgtctgaggaaccttatacggagacagagttgaactcccggggaaaggaagatgatgagactaaatttgaagtcaagagtgaagaaatctttgaaagccatcatgaaagggggaaccctgagctggagcagcaggccaggctcggagacctttccccccgcaggcgcattatacgtgacttgcttgagactgaagagatttacataaaagagattaaaagcataattgatggatatatcactccaatggattttatttggctaaagcatctaattccagatgttcttcagaataacaaggactttctctttgggaatattagagaactttacgaatttcacaacaggacttttctaaaagagttggaaaagtgtgctgagaaccctgaacttctggcacattgctttctcaagagaaaagaagatcttcagatatattttaaataccataagaatctgccccgagctagggcaatctggcaagagtgtcaagactgcgcctactttggggtatgccagcgccaactggatcacaatctccctctttttaagtatctcaaaggaccaagccagagacttataaaataccagatgctgttgaagggtctgctggatttcgagtctcctgaagatatggagatagacccaggtgaactaggaggctcggctaaggatgggccaaagagaaccaaagattcagcattctcaactgaactacaacaagctttggcagtgatagaggatttgatcaagtcctgtgagttggctgtggacctagcagcagtgactgaatgtccggacgatattggaaaactaggcaagctgttgctgcacggccctttcagcgtctggacaattcacaaggatcgttataaaatgaaggatttgattcgatttaaacccagccagaggcaaatctacctatttgaaaggggaatagtgttctgtaagatacgaatggagcctggggaccagggattatctcctcattacagcttcaagaagaccatgaagctgatgacactttcaattcgccagcttggaagggggagccatagaaagtttgagattgccagtcgaaatggacttgagaaatacatcctgcaggcagcttcaaaagaaatcagagactgttggttttcagaaataagtaaattattgatggaacaacaaaataatatcaaagaccaaggaaatccacagtttgaaatgagcacgagcaaaggcagtggagcaggatccggaccatggattaaaaatatggaaagagctaccactagcaaggaagacccggcctccagcacaggagggattaaaggctgctccagcagggagtttagctccatggacacctttgaagactgtgaaggcgcagaagacatggaaaaggagagcagtgctctgagtctcgcgggccttttccagtcggacgacagtcacgaaacctgttcctccaaatctgctttcctggagaggggagaaagcagccagggagaaaaagaagaacgcgatgaggaggaaacggcgacccgcagcaccgaggaggagcgcgctggggcgtccacgggccggctggctcctgcgggggcgacggctggtttccaggcgagggcgctgcgcccgaggacctccgcccaggagagctgacctccctgcggacgcccccgctcctcggctccagagcgcccgcattcccgggagaggcggtgtgggggcccgggccctgcccagctacgcagaaagcagccggagcctcggcggcggcagaaaggggacaaccagggcctcctccgaggagcccgaggggtgtcctgggtgcgcgcctagctccgcacgggggacctcggagctgctctaaggcgcctgcagaggcgagcagagcccgcagcccacgccttctcgaccgcgcacttcgatattcggagccgggcaattctttgctgcgtgggcttctctgtgctcccacggtaggatgtttagtagcacccctggcctctacccactaggtgccaggaatgcgccaccccatcctccaccccgcccccaaatcgtgacaatcaaaaatgcctgcagacacgcccgcatttctccagggcggggtgggaatcggttgagagccgcttagcccgagccttggaggagccggagccgctccaacccggcgggggccgcagactgggagctcccggtccgcctcccagcatccctgcgagcgttcatggggtgttcgtgttagtgccaagattgcttcgttgtagagagagttcgttccaagttactttctgaggtattttatgtatcgatttattagtttttaaatgagttttgttagtttcagttgtattttatttttagttttattagttgattttcatttctttgtagctttctggttatttaattttatagtttcagttactggtttatagttactttattttcaaagttatttagttgttcattttcagttatttatatgtagttgttttgttttaggagttacagatgttcaaattaatttgcttggaatttatttatttatttatttatttatttttcgagacggagtctcgctctgtcgcccaggctggagtgcagtggtgtgatctcggctcactgcaaaccgcctcccgggttcacgccattctcctgcctcagcctcctgagtagctgggactacaggcgcccgccaccacgcccggctaattttttatttggatttttagtagagacggggtttccccgtgttagccaggatggtctcgatctcctgacctcgtgatccccctgcctcggcctcccaaagtgctgggattacaggcgtgagccaccgcgcccagccggaatttatttttaattatctttacaattattatctgagttatttaccttcatagttatttcactttatcttattggagtttttgagttatttatttttacagtaacttatttgactattaaacactcactggaagttcatg

SEQ ID NO: 4862 - DNA, 3031 bp, Homo sapiens
ggagagccaggaagagggcgagggcagagcatccttgggcggagatgcctttaaaaaatcatccaccgcagcggtagaaacagttttgtttggctttatttatacggaatggtttttcagtgaaatgctgtcttgcttaaaagaagagatgcctccccaggagctcacccggcgactggccacagtgatcactcatgtcgatgaaattatgcagcaggaagtcagacccctgatggcggtggagataatagaacaacttcacagacaatttgccattctttcaggaggccgaggggaggatggcgcccccatcatcacgttcccagagttttcggggttcaaacacatcccagatgaagacttcctgaatgtcatgacctacctgactagcatccccagtgtggaggctgccagcattggattcattgttgttatcgacagacgaagagacaagtggagctccgtaaaggcatccttgacacgaatagctgtggcatttccaggaaacttacagctcatattcatccttcgtccatctcgctttatccagaggacattcactgacattggcattaaatactatcgaaatgagtttaaaacgaaagtgccgatcatcatggtaaactctgtctctgaccttcacggctacatcgacaaaagccaactgacccgggaattaggggggactttggaatatcgccacggtcagtgggtaaatcaccgcactgccatcgaaaactttgccttgaccttgaagaccactgcccagatgctgcagacgtttgggtcctgcctggccacagcagagctgcccagaagcatgctatccacggaagaccttctcatgtcccacacaaggcagcgggacaagctgcaggatgagctgaaattacttggaaagcaggggaccacattgctgtcatgcatccaagaaccagcaaccaaatgtcccaacagcaaactcaatctcaaccaacttgagaatgtaactaccatggaaaggttattagttcaactggatgaaacagaaaaagcctttagtcacttttggtctgagcatcatctgaagcttaaccagtgcctacaactacagcattttgagcacgatttttgtaaggctaagcttgccctggataatttgctggaagagcaagcagagtttacaggcattggagacagcgtgatgcacgtggagcagattcttaaggaacacaaaaaactggaggaaaaaagccaggagcccctggaaaaggcccagctgctggcactggttggggaccagctcatccaaagccaccattatgcagcagatgccatcaggccccggtgtgtggagctcaggcacctctgtgacgatttcatcaatggaaacaagaaaaaatgggacattttaggaaagtccttagagtttcatagacagctggacaaggtcagccaatggtgtgaggcaggaatctacctcttggcttcccaagctgtagacaagtgccagtctcgagaaggggttgatatcgccttgaacgacattgcgacattcctgggcacagtcaaggagtacccgttgctcagccccaaggagttttacaacgagtttgagttgctgctcaccctcgatgcaaaggccaaagcccagaaagttttgcagaggctggatgatgtccaggaaatatttcacaagaggcaagtgagtctgatgaaactggcagccaaacagactcgtccagtgcaacctgtggccccacatcctgagtcttcaccaaaatgggtgtcatcaaaaaccagccagccctccacctcggtccctctagctcgtcctctgagaacgtctgaggaaccttatacggagacagagttgaactcccggggaaaggaagatgatgagactaaatttgaagtcaagagtgaagaaatctttgaaagccatcatgaaagggggaaccctgagctggagcagcaggccaggctcggagacctttccccccgcagatactcttctcagtactttaagtaagtgtgatgaaggaatcatctagcaacttccttcttagaaaaaaaggaagtgccttcatatttccttgaaatttaaacttgttccattctattctaagcaaaaattaaaaggacacagttcagaagagctctttcagcaaataaataattgtttcacaaaagcactgctgtaaacaagatcactttgatggccagagacacttatgttttcaaccaatggcaaccttaaacacttccaagtatagatacacagggtatatatgggcaaaaggcaatacatcattaatcaatcaactaataaaaattaattataagcttgttgcttggtcaaatatgcttttgttctctatgtttttttaattggtcagaaaacttaaactgtaatgatctaaaaccctgtatctactctgaaagtaactacaacctagaatgtttgacactgtagttttgacattagttaaaaattctaaattatctaagcaatgtaaacaagcctcaaatttcaaaatagaaaaaaattaaaatttctgtaaacattaaaaagctacctgctaaaaattgtaagtatcatcattcagttgtgtatactgagaaatcttttttcgttttgttttgcgtgtttccgacatcaccttattatatgagacatctgattttccctaacaggtgcctctgcagtcaaaggccttagagtgagttcagtcactcttgctgaagtcattattttggccttcatataatctccctagcagtagacaccacctagttctttctgtagtgaagggaggtagtgtgtattatagccacatttttatcctgctttgtaaaataaatgtaacttactctattagatctcagacacatctctttgattacaaggaacatgcagctttaaaaatgctttaaccccaaactggcaacttttctatcacttttttactctgttttcaagtttgaaatatttagaaaataaagatcacctctgacagttattgatgaaaaataaattgttttagatatt

SEQ ID NO: 4863 - DNA, 957 bp, Homo sapiens
tatatggatgcctgtggaaatgaatgctaacctaacatcactttctcattctttcttgaaaggttattagttcaactggatgaaacagaaaaagcctttagtcacttttggtctgagcatcatctgaagcttaaccagtgcctacaactacagcattttgagcacgatttttgctaagcttgccctggataatttgctggaagagcaagcagagtttacaggcattggagacagcgtgatgcacgtggagctcaggcacctctgtgacgatttcatcaatggaaacaagaaaaaatgggacattttaggaaagtccttagagtttcatagacagctggacaaggccaaagcccagaaagttttgcagaggctggatgatgtccaggaaatatttcacaagaggcaagtgagtctgatgaaactggcagccaaacagactcgtccagtgcaacctgtggccccacatcctgagtcttcaccaaaatgggtgtcatcaaaaaccagccagccctccacctcggtccctctagctcgtcctctgagaacgtctgaggaaccttatacggagacagagttgaactcccggggaaaggaagatgatgagactaaatttgaagtcaagagtgaagaaatctttgaaagccatcatgaaagggggaaccctgagctggagcagcaggccaggctcggagacctttccccccgcagtgtgatcacagtgtgcgtttgtgagatgctgaccttgggtgttcaatagaacagaatgaactgaccagaaactaagtaggcgcattatacgtgacttgcttgagactgaagagatttacataaaagagattaaaagcataattgatggatatatcactccaatggattttatttggctaaagcatctaattccagatgttcttcagaataacaaggactttctctttgggaatattagagaactttacg

SEQ ID NO: 4864 - DNA, 2394 bp, Homo sapiens
ggcgagggcagagcatccttgggcggagatgcctttaaaaaatcatccaccgcagcggtagaaacagttttgtttggctttatttatacggaatggtttttcagtgaaatgctgtcttgcttaaaagaagagatgcctccccaggagctcacccggcgactggccacagtgatcactcatgtcgatgaaattatgcagcaggaagtcagacccctgatggcggtggagataatagaacaacttcacagacaatttgccattctttcaggaggccgaggggaggatggcgcccccatcatcacgttcccagagttttcggggttcaaacacatcccagatgaagacttcctgaatgtcatgacctacctgactagcatccccagtgtggaggctgccagcattggattcattgttgttatcgacagacgaagagacaagtggagctccgtaaaggcatccttgacacgaatagctgtggcatttccaggaaacttacagctcatattcatccttcgtccatctcgctttatccagaggacattcactgacattggcattaaatactatcgaaatgagtttaaaacgaaagtgccgatcatcatggtaaactctgtctctgaccttcacggctacatcgacaaaagccaactgacccgggaattaggggggactttggaatatcgccacggtcagtgggtaaatcaccgcactgccatcgaaaactttgccttgaccttgaagaccactgcccagatgctgcagacgtttgggtcctgcctggccacagcagagctgcccagaagcatgctatccacggaagaccttctcatgtcccacacaaggcagcgggacaagctgcaggatgagctgaaattacttggaaagcaggggaccacattgctgtcatgcatccaagaaccagcaaccaaatgtcccaacagcaaactcaatctcaaccaacttgagaatgtaactaccatggaaaggttattagttcaactggatgaaacagaaaaagcctttagtcacttttggtctgagcatcatctgaagcttaaccagtgcctacaactacagcattttgagcacgatttttgtaaggctaagcttgccctggataatttgctggaagagcaagcagagtttacaggcattggagacagcgtgatgcacgtggagcagattcttaaggaacacaaaaaactggaggaaaaaagccaggagcccctggaaaaggcccagctgctggcactggttggggaccagctcatccaaagccaccattatgcagcagatgccatcaggccccggtgtgtggagctcaggcacctctgtgacgatttcatcaatggaaacaagaaaaaatgggacattttaggaaagtccttagagtttcatagacagctggacaaggtcagccaatggtgtgaggcaggaatctacctcttggcttcccaagctgtagacaagtgccagtctcgagaaggggttgatatcgccttgaacgacattgcgacattcctgggcacagtcaaggagtacccgttgctcagccccaaggagttttacaacgagtttgagttgctgctcaccctcgatgcaaaggccaaagcccagaaagttttgcagaggctggatgatgtccaggaaatatttcacaagaggcaagtgagtctgatgaaactggcagccaaacagactcgtccagtgcaacctgtggccccacatcctgagtcttcaccaaaatgggtgtcatcaaaaaccagccagccctccacctcggtccctctagctcgtcctctgagaacgtctgaggaaccttatacggagacagagttgaactcccggggaaaggaagatgatgagactaaatttgaagtcaagagtgaagaaatctttgaaagccatcatgaaagggggaaccctgagctggagcagcaggccaggctcggagacctttccccccgcaggcgcattatacgtgacttgcttgagactgaagagatttacataaaagagattaaaagcataattgatggatatatcactccaatggattttatttggctaaagcatctaattccagatgttcttcagaataacaaggactttctctttgggaatattagagaactttacgaatttcacaacaggacttttctaaaagagttggaaaagtgtgctgagaaccctgaacttctggcacattgctttctcaagagagtaagtctgtactcccagtaaataatcatgttaaagtcagcccttacatttctgcgttaagtggcaaggacaaatggaaacatcaatggtctaaaaacatatctgcttccctccgactccaagctttactgaagtataattggtaaataaaaattgcatatattcaaacta

SEQ ID NO: 4865 - DNA, 4748 bp, Homo sapiens
atgctgtcttgcttaaaagaagagatgcctccccaggagctcacccggcgactggccacagtgatcactcatgtcgatgaaattatgcagcaggaagtcagacccctgatggcggtggagataatagaacaacttcacagacaatttgccattctttcaggaggccgaggggaggatggcgcccccatcatcacgttcccagagttttcggggttcaaacacatcccagatgaagacttcctgaatgtcatgacctacctgactagcatccccagtgtggaggctgccagcattggattcattgttgttatcgacagacgaagagacaagtggagctccgtaaaggcatccttgacacgaatagctgtggcatttccaggaaacttacagctcatattcatccttcgtccatctcgctttatccagaggacattcactgacattggcattaaatactatcgaaatgagtttaaaacgaaagtgccgatcatcatggtaaactctgtctctgaccttcacggctacatcgacaaaagccaactgacccgggaattaggggggactttggaatatcgccacggtcagtgggtaaatcaccgcactgccatcgaaaactttgccttgaccttgaagaccactgcccagatgctgcagacgtttgggtcctgcctggccacagcagagctgcccagaagcatgctatccacggaagaccttctcatgtcccacacaaggcagcgggacaagctgcaggatgagctgaaattacttggaaagcaggggaccacattgctgtcatgcatccaagaaccagcaaccaaatgtcccaacagcaaactcaatctcaaccaacttgagaatgtaactaccatggaaaggttattagttcaactggatgaaacagaaaaagcctttagtcacttttggtctgagcatcatctgaagcttaaccagtgcctacaactacagcattttgagcacgatttttgtaaggctaagcttgccctggataatttgctggaagagcaagcagagtttacaggcattggagacagcgtgatgcacgtggagcagattcttaaggaacacaaaaaactggaggaaaaaagccaggagcccctggaaaaggcccagctgctggcactggttggggaccagctcatccaaagccaccattatgcagcagatgccatcaggccccggtgtgtggagctcaggcacctctgtgacgatttcatcaatggaaacaagaaaaaatgggacattttaggaaagtccttagagtttcatagacagctggacaaggtcagccaatggtgtgaggcaggaatctacctcttggcttcccaagctgtagacaagtgccagtctcgagaaggggttgatatcgccttgaacgacattgcgacattcctgggcacagtcaaggagtacccgttgctcagccccaaggagttttacaacgagtttgagttgctgctcaccctcgatgcaaaggccaaagcccagaaagttttgcagaggctggatgatgtccaggaaatatttcacaagaggcaagtgagtctgatgaaactggcagccaaacagactcgtccagtgcaacctgtggccccacatcctgagtcttcaccaaaatgggtgtcatcaaaaaccagccagccctccacctcggtccctctagctcgtcctctgagaacgtctgaggaaccttatacggagacagagttgaactcccggggaaaggaagatgatgagactaaatttgaagtcaagagtgaagaaatctttgaaagccatcatgaaagggggaaccctgagctggagcagcaggccaggctcggagacctttccccccgcaggcgcattatacgtgacttgcttgagactgaagagatttacataaaagagattaaaagcataattgatggatatatcactccaatggattttatttggctaaagcatctaattccagatgttcttcagaataacaaggactttctctttgggaatattagagaactttacgaatttcacaacaggacttttctaaaagagttggaaaagtgtgctgagaaccctgaacttctggcacattgctttctcaagagaaaagaagatcttcagatatattttaaataccataagaatctgccccgagctagggcaatctggcaagagtgtcaagactgcgcctactttggggtatgccagcgccaactggatcacaatctccctctttttaagtatctcaaaggaccaagccagagacttataaaataccagatgctgttgaagggtctgctggatttcgagtctcctgaagatatggagatagacccaggtgaactaggaggctcggctaaggatgggccaaagagaaccaaagattcagcattctcaactgaactacaacaagctttggcagtgatagaggatttgatcaagtcctgtgagttggctgtggacctagcagcagtgactgaatgtccggacgatattggaaaactaggcaagctgttgctgcacggccctttcagcgtctggacaattcacaaggatcgttataaaatgaaggatttgattcgatttaaacccagccagaggcaaatctacctatttgaaaggggaatagtgttctgtaagatacgaatggagcctggggaccagggattatctcctcattacagcttcaagaagaccatgaagctgatgacactttcaattcgccagcttggaagggggagccatagaaagtttgagattgccagtcgaaatggacttgagaaatacatcctgcaggcagcttcaaaagaaatcagagactgttggttttcagaaataagtaaattattgatggaacaacaaaataatatcaaagaccaaggaaatccacagtttgaaatgagcacgagcaaaggcagtggagcaggatccggaccatggattaaaaatatggaaagagctaccactagcaaggaagacccggcctccagcacaggagggattaaaggctgctccagcagggagtttagctccatggacacctttgaagactgtgaaggcgcagaagacatggaaaaggagagcagtgctctgagtctcgcgggccttttccagtcggacgacagtcacgaaacctgttcctccaaatctgctttcctggagaggggagaaagcagccagggagaaaaagaagaacgcgatgaggaggaaacgtgagtgtgagcgaggaaagactaagcgcctctttgggccacggcgtctctgactttcttctcggaattgcagggcgacccgcagcaccgaggaggagcgcgctggggcgtccacgggccggctggctcctgcgggggcgacggctggtttccaggcgagggcgctgcgcccgaggacctccgcccaggagagctgacctccctgcggacgcccccgctcctcggctccagagcgcccgcattcccgggagaggcggtgtgggggcccgggccctgcccagctacgcagaaagcagccggagcctcggcggcggcagaaaggggacaaccagggcctcctccgaggagcccgaggggtgtcctgggtgcgcgcctagctccgcacgggggacctcggagctgctctaaggcgcctgcagaggcgagcagagcccgcagcccacgccttctcgaccgcgcacttcgatattcggagccgggcaattctttgctgcgtgggcttctctgtgctcccacggtaggatgtttagtagcacccctggcctctacccactaggtgccaggaatgcgccaccccatcctccaccccgcccccaaatcgtgacaatcaaaaatgcctgcagacacgcccgcatttctccagggcggggtgggaatcggttgagagccgcttagcccgagccttggaggagccggagccgctccaacccggcgggggccgcagactgggagctcccggtccgcctcccagcatccctgcgagcgttcatggggtgttcgtgttagtgccaagattgcttcgttgtagagagagttcgttccaagttactttctgaggtattttatgtatcgatttattagtttttaaatgagttttgttagtttcagttgtattttatttttagttttattagttgattttcatttctttgtagctttctggttatttaattttatagtttcagttactggtttatagttactttattttcaaagttatttagttgttcattttcagttatttatatgtagttgttttgttttaggagttacagatgttcaaattaatttgcttggaatttatttatttatttatttatttatttttcgagacggagtctcgctctgtcgcccaggctggagtgcagtggtgtgatctcggctcactgcaaaccgcctcccgggttcacgccattctcctgcctcagcctcctgagtagctgggactacaggcgcccgccaccacgcccggctaattttttatttggatttttagtagagacggggtttccccgtgttagccaggatggtctcgatctcctgacctcgtgatccccctgcctcggcctcccaaagtgctgggattacaggcgtgagccaccgcgcccagccggaatttatttttaattatctttacaattattatctgagttatttaccttcatagttatttcactttatcttattggagtttttgagttatttatttttacagtaacttatttgactattaaacactcactggaa

SEQ ID NO: 4866 - DNA, 992 bp, Homo sapiens
ggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccagagacggggtttcaccatgttggctaggctggtctcaaactcctgagctcgtgatcctcccgcctcagcctcccaaagtgctgggattataggtgtgagccaccgcacccagccttggttctccctttcttcatctggataaggaaggctggactgcaccttctctacaggctgagttggacattcgcagatctaccctcccaacctgcattctgcctcaagcagcaacgcccaccccaggctcaggccacatggagaagccacccctagttccagtggtggatgtggcacctcggcctggccaatcagagctcccttgtcctaggttcctagtgattggtttgagatggacacgtgacccaatgagcgacctttcctgggagttctaccaggagcatcaggaaggttgagctgggtgtatgggaaccaggccggggcgaggggttccggggggacctgagaacattgtgtggagccctggatccaactgtacctgacactagccaatttcatttcttcagtttcatggacccctaaattatgatttttgccaaaa

SEQ ID NO: 4867 - DNA, 1314 bp, Homo sapiens
aggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacaggtagctcctgggaccgcccgcccccactgccactcccagctgcaaggaccgtctctcagctgcgctgggaaccgctgcttctcgcttattagaaaactgtctctttccttttgtcctggtgtctggtgacctcctcttgtcctgtggcatctataacctgagttcagtcacttaataccgaggtcctgcgctctgctgtgtgcctggccctgggctgggcactggggacatagcagtgaccgagacagacaggctcacaaggagacatacgacaaccaggtaaacatggcagacaagagcatgtcagatgcgctgtgaagaacactgcggggcccctcctaggaggtggcatgagttacatgcagacagagacgatccgggggcagacggagttccatgtggggcagtggtgagggcagacgctctggggctgggatccctgggagtgttcgagaagcaccgagaaggcttctgtggctggagccggccagctgggggagatggggccagggagatggcaggggcctctccctgtcccaggacccagagccaagggaggctttaagcccaggaccaggggtctgaaaacgaaaagcactcacagtccttgaacattggaaagagaatttttgaagagtagcccttctttttgtttttgttggcattctaagttaataaacacgcttatgaa

SEQ ID NO: 4868 - DNA, 3874 bp, Homo sapiens
gcctcagctgagggcaagcgaggagatggctgtgaggcaggcggcgacggcgggcactcccgggcccaggagagaggaagaggcggcgcttctattcgagagggcccattaccggcacgacccgcgctggctgctgcccgtgaccccccgcctgtgcctggcctgcgcgctggagctgctgccggaccccggcgtgtcgttagtgcgcaagaagcacatgttgtcctgcttccaagatgcccttgtgaggcatacctccctggtcacgcaactggtgtctcaggatcagagagtctgcatccacttcataagtgtgctttttggactattatgcagcatggaagatgggagtgtgacagacctctgtattgaagtccttattcagatcacaacgcagctgaagctggagcagactatccgttgcctgctggatgagtgccacaaagagctgtgtaacatgccctccatgcgaggcagcctggccaccctgacccttcttggcaagttggtggatgccatccctgctctggcagacgagcttgtaatggagcatggcaacctgatggagcatctgttgagaggcttagtataccccagtgagggcatacaagcttctgtctgttacctttatgggaagctatactcctcaccagtggcagctgagatgctttcaggacacttccgtgagaagctttttcccctcttcctttccatcctggatggtgcccagacaaaggagctgcagattaactgcttgggtttgctgaggcagctgttgaagtatgatctctttgtgtccatgatcatgaaccaggatggactgggagaaagtgctaagaatatcgaagggtcatcaggaaatacctcactgcctttggtgctcaaaaagcttctcctctctagagatgaaaccctgcaggtggccagtgctcactgtataactgcggtgcttgtccactccccagcaaagcatgcgtcagccttcatccacgctgacatcccagagttcctctttgagcatctttcttcttccagtgaagtgctcgtctggtccagctgtaactgcttgacactcctggtagaagagccactctttttttccaagtgccacacggtgtatgggatcgaggcagtggtgaggagcctgcagggaagcctgaagatgaacaacatagagctgcacaagcagggcctgctgcttttcgctgaaatcctgacccggcagccagaggagatcaagctgttcacaagctcagccatgtgcagagatgctggccgtgccctccaagaagcagttagcagccctgtgctggaggtggctgctgaggccttgaaggccacttctgcttttctgaggaaggaccatcagagcactccacctgtgcagtatggggaactgcaggctttgctagaagccatgctaaaccgatgtgcggagttttcccagaccttgctgagcaggaggcccctgggccatgcctccagtagagattcagagaaggccattcttcaaaggggaaagttcctcctcagcactctggagggatttagaagtgcctgcaggttggctatagaattccagagtgagccttcagcccaggagaatccattcacagctcccagcgccaagaaggaagacaccttggaggccttctcagaatttcttctcagtgcctgtgactcgctgtgtatccccatggtgatgagacacttggagcagaccacccacccagctttgatggaagttttcctctcaattctacataacctctttgtcatcgttccccacatgaaggagaagttttccaagaagcttgcttcctcatccttcatacgactgaccctggagctgaaggccaggttttgcagtggtctgagtcactcagccctaaaccaggtgtgttccaatttcctctactatatgtgcctcaaccttctctcagctccagagaagacaggaccaccttccaaagaagaactctctgcagtgtctgagctcctgcagcatgggctgccccagataagcagcaggagccctgaaagccttgccttcctgtctgatcgccagtacatggagggagctgctcgccagagacagtactgcatcctgctcctcttctacttggcctacatccatgaagacaggtttgtctcagaggcagagttatttgaggctgtgcaaagcttcctcctgtcgctgcaggaccagggcgagcgccccccactggtggtcttcaaagcctccatctatctgcttgcaatctgccaggacaaagacaatacactacgtgagactatggtcagtgcaatcagaaaattcctagaaggcatcccagacctgcagctagtctatactcaccatccgctcctgctcaggttctttctgttgtatccagagctcatgagtaggtatgggcaccgtgtcctggaactttggttcttctgggaagagagcagctatgaggaactggatgatgtcacctctgctgggcagcccgcccttcctgccagcttagtagtcctgttccagttgctcagaagcatccccagcatcctgctcatcttgctggacctcatctattccagcccagtggacacagctcacaaggtactgattagcctgaggaccttcctgaggaggaatgaggatatccaagtgggcggtcttatccgaggccacttcctgctgatcctgcagcgtctgctagtggagcatggggcatccccatcaggagcctcggggaacctaccattgctgctgagcctcctctccctgatgcagctcaggaatgtgtcagagcaagaactggacagcgtggccatgaagctccttcaccaagtaagcaagctgtgtgggaagtgcagccccactgacgtggacatcctgcagccctccttcaacttcctgtattggagccttcatcagaccacacccagcagtcagaaaagagctgctgcagtgctcctgagcagcacaggcctgatggagcttctggagaagatgctggccctcaccttggcaaaggcagattctcccaggactgcactcctctgctctgcctggctgctcactgcctccttctctgcccagcagcacaagggcagtttgcaggttcaccagacactctctgtggaaatggaccaagtattgaaggctctcagctttccaaagaaaaaggctgcactactctcagctgccatcttatgcttcctgcggacagccctgcgacaaagcttttcctctgccctggtagccctggtgccctcaggggcccagccactgccagccaccaaggacactgtcctagctccactgcgaatgtcgcaagtccggtccctggtcattgggctgcagaacctcctggtgcagaaggaccctctattgtcccaggcctgtgttggctgcctggaggccttgcttgactacctggatgcccggagcccagacattgctctccacgtggcctcccagccttggaatcggtttttgctgtttaccctcttggatgctggagagaattccttcctcagacctgagattttgaggctcatgaccctgctccagagcatgggacacctggctgaccacagcatggcccagaccctgcaggcctccttggagggccttccccctagcacctcctcaggccagccacccctgcaggacatgctctgcctgggaggggtggctgtatccctgtcccacatcagaaactgatcctcaggacttgaaggcccagaagtggagagagaatgagacctggagacaaagggcataattgttggggaaatggatgacagctgaagctattcatatggagccatatactctattgttgaaatagaataaggaaataaaatgatacactcacat

SEQ ID NO: 4869 - DNA, 3901 bp, Homo sapiens
gcctcagctgagggcaagcgaggagatggctgtgaggcaggcggcgacggcgggcactcccgggcccaggagagaggaagaggcggcgcttctattcgagagggcccattaccggcacgacccgcgctggctgctgcccgtgaccccccgcctgtgcctggcctgcgcgctggagctgctgccggaccccggcgtgtcgttagtgcgcaagaagcacatgttgtcctgcttccaagatgcccttgtgaggcatacctccctggtcacgcaactggtgtctcaggatcagagagtctgcatccacttcataagtgtgctttttggactattatgcagcatggaagatgggagtgtgacagacctctgtattgaagtccttattcagatcacaacgcagctgaagctggagcagactatccgttgcctgctggatgagtgccacaaagagctgtgtaacatgccctccatgcgaggcagcctggccaccctgacccttcttggcaagttggtggatgccatccctgctctggcagacgagcttgtaatggagcatggcaacctgatggagcatctgttgagaggcttagtataccccagtgagggcatacaagcttctgtctgttacctttatgggaagctatactcctcaccagtggcagctgagatgctttcaggacacttccgtgagaagctttttcccctcttcctttccatcctggatggtgcccagacaaaggagctgcagattaactgcttgggtttgctgaggcagctgttgaagtatgatctctttgtgtccatgatcatgaaccaggatggactgggagaaagtgctaagaatatcgaagggtcatcaggaaatacctcactgcctttggtgctcaaaaagcttctcctctctagagatgaaaccctgcaggtggccagtgctcactgtataactgcggtgcttgtccactccccagcaaagcatgcgtcagccttcatccacgctgacatcccagagttcctctttgagcatctttcttcttccagtgaagtgctcgtctggtccagctgtaactgcttgacactcctggtagaagagccactctttttttccaagtgccacacggtgtatgggatcgaggcagtggtgaggagcctgcagggaagcctgaagatgaacaacatagagctgcacaagcagggcctgctgcttttcgctgaaatcctgacccggcagccagaggagatcaagctgttcacaagctcagccatgtgcagagatgctggccgtgccctccaagaagcagttagcagccctgtgctggaggtggctgctgaggccttgaaggccacttctgcttttctgaggaaggaccatcagagcactccacctgtgcagtatggggaactgcaggctttgctagaagccatgctaaaccgatgtgcggagttttcccagaccttgctgagcaggaggcccctgggccatgcctccagtagagattcagagaaggccattcttcaaaggggaaagttcctcctcagcactctggagggatttagaagtgcctgcaggttggctatagaattccagagtgagccttcagcccaggagaatccattcacagctcccagcgccaagaaggaagacaccttggaggccttctcagaatttcttctcagtgcctgtgactcgctgtgtatccccatggtgatgagacacttggagcagaccacccacccagctttgatggaagttttcctctcaattctacataacctctttgtcatcgttccccacatgaaggagaagttttccaagaagcttgcttcctcatccttcatacgactgaccctggagctgaaggccaggttttgcagtggtctgagtcactcagccctaaaccaggtgtgttccaatttcctctactatatgtgcctcaaccttctctcagctccagagaagacaggaccaccttccaaagaagaactctctgcagtgtctgagctcctgcagcatgggctgccccagataagcagcaggagccctgaaagccttgccttcctgtctgatcgccagtacatggagggagctgctcgccagagacagtactgcatcctgctcctcttctacttggcctacatccatgaagacaggtttgtctcagaggcagagttatttgaggctgtgcaaagcttcctcctgtcgctgcaggaccagggcgagcgccccccactggtggtcttcaaagcctccatctatctgcttgcaatctgccaggacaaagacaatacactacgtgagactatggtcagtgcaatcagaaaattcctagaaggcatcccagacctgcagctagtctatactcaccatccgctcctgctcaggttctttctgttgtatccagagctcatgagtaggtatgggcaccgtgtcctggaactttggttcttctgggaagagagcagctatgaggaactggatgatgtcacctctgctgggcagcccgcccttcctgccagcttagtagtcctgttccagttgctcagaagcatccccagcatcctgctcatcttgctggacctcatctattccagcccagtggacacagctcacaaggtactgattagcctgaggaccttcctgaggaggaatgaggatatccaagtgggcggtcttatccgaggccacttcctgctgatcctgcagcgtctgctagtggagcatggggcatccccatcaggagtaagcaagctgtgtgggaagtgcagccccactgacgtggacatcctgcagccctccttcaacttcctgtattggagccttcatcagaccacacccagcagtcagaaaagagctgctgcagtgctcctgagcagcacaggcctgatggagcttctggagaagatgctggccctcaccttggcaaaggcagattctcccaggactgcactcctctgctctgcctggctgctcactgcctccttctctgcccagcagcacaagggcagtttgcaggttcaccagacactctctgtggaaatggaccaagtattgaaggctctcagctttccaaagaaaaaggctgcactactctcagctgccatcttatgcttcctgcggacagccctgcgacaaagcttttcctctgccctggtagccctggtgccctcaggggcccagccactgccagccaccaaggacactgtcctagctccactgcgaatgtcgcaagtccggtccctggtcattgggctgcagaacctcctggtgcagaaggaccctctattgtcccaggcctgtgttggctgcctggaggccttgcttgactacctggatgcccggagcccagacattgctctccacgtggcctcccagccttggaatcggtttttgctgtttaccctcttggatgctggagagaattccttcctcagacctgagattttgaggctcatgaccctgtttatgcggtaccggagtagcagtgtcctctctcatgaagaggtgggtgatgttctgcaaggtgtggctttggctgacctgtctaccctctcgaacaccacactccaggccctgcatggcttcttccagcagctccagagcatgggacacctggctgaccacagcatggcccagaccctgcaggcctccttggagggccttccccctagcacctcctcaggccagccacccctgcaggacatgctctgcctgggaggggtggctgtatccctgtcccacatcagaaactgatcctcaggacttgaaggcccagaagtggagagagaatgagacctggagacaaagggcataattgttggggaaatggatgacagctgaagctattcatatggagccatatactctattgttgaaatagaataaggaaataaaatgatacactcacat

SEQ ID NO: 4870 - DNA, 4020 bp, Homo sapiens
gcgggaaagagtgccgcctcagctgagggcaagcgaggagatggctgtgaggcaggcggcgacggcgggcactcccgggcccaggagagaggaagaggcggcgcttctattcgagagggcccattaccggcacgacccgcgctggctgctgcccgtgaccccccgcctgtgcctggcctgcgcgctggagctgctgccggaccccggcgtgtcgttagtgcgcaagaagcacatgttgtcctgcttccaagatgcccttgtgaggcatacctccctggtcacgcaactggtgtctcaggatcagagagtctgcatccacttcataagtgtgctttttggactattatgcagcatggaagatgggagtgtgacagacctctgtattgaagtccttattcagatcacaacgcagctgaagctggagcagactatccgttgcctgctggatgagtgccacaaagagctgtgtaacatgccctccatgcgaggcagcctggccaccctgacccttcttggcaagttggtggatgccatccctgctctggcagacgagcttgtaatggagcatggcaacctgatggagcatctgttgagaggcttagtataccccagtgagggcatacaagcttctgtctgttacctttatgggaagctatactcctcaccagtggcagctgagatgctttcaggacacttccgtgagaagctttttcccctcttcctttccatcctggatggtgcccagacaaaggagctgcagattaactgcttgggtttgctgaggcagctgttgaagtatgatctctttgtgtccatgatcatgaaccaggatggactgggagaaagtgctaagaatatcgaagggtcatcaggaaatacctcactgcctttggtgctcaaaaagcttctcctctctagagatgaaaccctgcaggtggccagtgctcactgtataactgcggtgcttgtccactccccagcaaagcatgcgtcagccttcatccacgctgacatcccagagttcctctttgagcatctttcttcttccagtgaagtgctcgtctggtccagctgtaactgcttgacactcctggtagaagagccactctttttttccaagtgccacacggtgtatgggatcgaggcagtggtgaggagcctgcagggaagcctgaagatgaacaacatagagctgcacaagcagggcctgctgcttttcgctgaaatcctgacccggcagccagaggagatcaagctgttcacaagctcagccatgtgcagagatgctggccgtgccctccaagaagcagttagcagccctgtgctggaggtggctgctgaggccttgaaggccacttctgcttttctgaggaaggaccatcagagcactccacctgtgcagtatggggaactgcaggctttgctagaagccatgctaaaccgatgtgcggagttttcccagaccttgctgagcaggaggcccctgggccatgcctccagtagagattcagagaaggccattcttcaaaggggaaagttcctcctcagcactctggagggatttagaagtgcctgcaggttggctatagaattccagagtgagccttcagcccaggagaatccattcacagctcccagcgccaagaaggaagacaccttggaggccttctcagaatttcttctcagtgcctgtgactcgctgtgtatccccatggtgatgagacacttggagcagaccacccacccagctttgatggaagttttcctctcaattctacataacctctttgtcatcgttccccacatgaaggagaagttttccaagaagcttgcttcctcatccttcatacgactgaccctggagctgaaggccaggttttgcagtggtctgagtcactcagccctaaaccaggtgtgttccaatttcctctactatatgtgcctcaaccttctctcagctccagagaagacaggaccaccttccaaagaagaactctctgcagtgtctgagctcctgcagcatgggctgccccagataagcagcaggagccctgaaagccttgccttcctgtctgatcgccagtacatggagggagctgctcgccagagacagtactgcatcctgctcctcttctacttggcctacatccatgaagacaggtttgtctcagaggcagagttatttgaggctgtgcaaagcttcctcctgtcgctgcaggaccagggcgagcgccccccactggtggtcttcaaagcctccatctatctgcttgcaatctgccaggacaaagacaatacactacgtgagactatggtcagtgcaatcagaaaattcctagaaggcatcccagacctgcagctagtctatactcaccatccgctcctgctcaggttctttctgttgtatccagagctcatgagtaggtatgggcaccgtgtcctggaactttggttcttctgggaagagagcagctatgaggaactggatgatgtcacctctgctgggcagcccgcccttcctgccagcttagtagtcctgttccagttgctcagaagcatccccagcatcctgctcatcttgctggacctcatctattccagcccagtggacacagctcacaaggtactgattagcctgaggaccttcctgaggaggaatgaggatatccaagtgggcggtcttatccgaggccacttcctgctgatcctgcagcgtctgctagtggagcatggggcatccccatcaggagcctcggggaacctaccattgctgctgagcctcctctccctgatgcagctcaggaatgtgtcagagcaagaactggacagcgtggccatgaagctccttcaccaagtaagcaagctgtgtgggaagtgcagccccactgacgtggacatcctgcagccctccttcaacttcctgtattggagccttcatcagaccacacccagcagtcagaaaagagctgctgcagtgctcctgagcagcacaggcctgatggagcttctggagaagatgctggccctcaccttggcaaaggcagattctcccaggactgcactcctctgctctgcctggctgctcactgcctccttctctgcccagcagcacaagggcagtttgcaggttcaccagacactctctgtggaaatggaccaagtattgaaggctctcagctttccaaagaaaaaggctgcactactctcagctgccatcttatgcttcctgcggacagccctgcgacaaagcttttcctctgccctggtagccctggtgccctcaggggcccagccactgccagccaccaaggacactgtcctagctccactgcgaatgtcgcaagtccggtccctggtcattgggctgcagaacctcctggtgcagaaggaccctctattgtcccaggcctgtgttggctgcctggaggccttgcttgactacctggatgcccggagcccagacattgctctccacgtggcctcccagccttggaatcggtttttgctgtttaccctcttggatgctggagagaattccttcctcagacctgagattttgaggctcatgaccctgtttatgcggtaccggagtagcagtgtcctctctcatgaagaggtgggtgatgttctgcaaggtgtggctttggctgacctgtctaccctctcgaacaccacactccaggccctgcatggcttcttccagcagctccagagcatgggacacctggctgaccacagcatggcccagaccctgcaggcctccttggagggccttccccctagcacctcctcaggccagccacccctgcaggacatgctctgcctgggaggggtggctgtatccctgtcccacatcagaaactgatcctcaggacttgaaggcccagaagtggagagagaatgagacctggagacaaagggcataattgttggggaaatggatgacagctgaagctattcatatggagccatatactctattgttgaaatagaataaggaaataaaatgatacactcaca

SEQ ID NO: 4871 - DNA, 6731 bp, Homo sapiens
aagagaggataagttgtgggtgcacatttactaattcattcagaatctgtatctattctttgtccagtgatgagtgaaaggaagtgtcaggcagccccatatttacttttcatagccaccttaagacctcctctgccacggccatggctagaatttcactagcctctggcacaaagcagtggtgcccaggcatatggcagggataatgctctcccagccaaagtagcaatgtcatctcttctattctttcttcttctccctctaagtcactcagccctaaaccaggtgtgttccaatttcctctactatatgtgcctcaaccttctctcagctccagagaagacaggaccaccttccaaagaaggtaagatgctacaatttgaccactcatgtggcctgtgctggtctttagagtctgggtgccttgctgattgactagatagtgagttagtacagccacgagatttctttgcctgaggctgcccagaggaatcggagtgatgcaattataggttgattcctagggatatgaagtaatagaactggaaaatgatggaacccaaggctcctggcaccttagagttgagaaggatcctaatgttcatcaagtccagttccttcttcctgacagtctcctctgcaacatccccataccataggcctcaggagtccagtgttcactatagcattaatagtgtgttctatttcttcattcattcaagtagtgtttcttttttctttttctttttctttttgtttttcttttattttaagacagtctcgctctgttgcccaggctggagtgcagtggcatgatctcagctcactgcaacctctgccttccaggttcaagtgagtctcctgcctcagcctcccaagtagctgggattacaggctcctgccaccacgcctggctaatttttgcatttttagtagagacgggccttcaccatgttggccatgctggtttcaaactcctgacctcaggtaatctgcctcggcctcccaaagtgctgagattacagatgtgagctaccgtgcccagccaagaggtgtttcttgagcacctgttgtgtgtcagactccattccaggtgctggtgaaagagccagggatacaaagccctgctgtcataaattgaaacaggcaggcaataagcaaatgcatactatgtcagagatccataggcactatgaagaaaataaaactgggcaaaaggatagagagtgatagaaggaggagagagacatgttagatagggtggtcagggaaggcctccatgtggaagtggtatgtgagcagaggtctgagtcaagtaaaggaaagccatgcagaatctaggcaggaggaacagcagctgcagggctgagagctggaagtttttcctcttgttgaacattcattgagcttctgctacctgccaggggaggcctaggtactgctgtggatagagcgattataacagtatgttatttgccctgaggggttcctctatcttagacctgtctcctgatataatagaaaacagtttaataattgtttcatcattcattcaacaaatatacctctgtgggtaagacctagttctggctcttttcccccttattatatttgtgaagattctgtgtcctctcccccactctctacacctgctgctctcttttatctttcccagacatcatgctgagagggagcaaagcccaggtgagcatttttattgcttccaacatagcttggctactggttctctcactatgctggctactcctttctgcaatctccctgttaaggcatgatctggcctgcagagagaatagcatgatttctgccatgtagcctaagactattggcagtcacatcaccatcacctctcatgctcataagtgcctgctccactgcttctggcagttcccttgcttgtcaaaccaaggggagccccacacatctcctgccttaaacactggggcttcttaaatctcattgtgccaggaaatgcagcacatctctcataacattcagactgctttcttttatatatcaggagaaaggcaggtggatgtgtgtggctgaaggatatttgtttcattattattatattgatgagagcatgctttggtggacaagcactgaacttggaattaggagagctgacctggctctgctaccaaattgctgtgggacatgcgctatcctcaccctctgcttgcccaggacttggccctggcaggatggattctttcggttgaccttcaactgaggtcctgtctttcaatctctcatccactcactgctggaaggattatctgaaaacaaagtcttaacatcttaactcccctggctttcagctgtggtctccacacatcagtctgtggagtagtgtcaaatagtgatgaagttttctctggtccatggtgaaatgtggaacataaggataaagttgactttatttaggtttttttgtttgttttgttttttgaggcagagtctcagtctgttgcccaggctggagttgagtgatgtcagctcactgcaacctccacctcccagattcaagtgattcttgtgtctcagcctcacgaatagctgggactacaagcatatgtcaccatgcccaggtgatttttttgtatttttagtagagatggggttttgccatgttggccaggctggtcttgaactcctggcctcaaacaatctacctgccttggactccaaagtgctaggattacaggtgtgagccaccgcacctggcctttattcaaattttaaactctgaagtcagtctttttctttcctttttttttgttttgggacagcgtcttgttctgttgcccaggctggagtgcagtggcgtgatctcggctcattgcaacctccacctcccgggttcaagcaattctcctgcgtcagcttcctgagtagctaggactacaggcacttgccaccacgcttgtctaatttttgtatttttaatagagacagggttttgccatgttggccaggctggtctcgaactcctgacctcaggtgatccacctgccttggtttcccaaagtgctggcattaccggcttgagccaccacgcctatccttctttcctgttcttttggtattaaaatattctttcttttatgaaaccgttttcgtaagaaatctagaagtctctgccctcaggatgaagtcccaattccttaagtggcatttgcttaaaggtctttcacagtccaactgcagattacatcacatagttccccagcttctgacaccccacatctattcactgactatccagtgacactgaatggaaacatggcatgtcttctcatgccttcaggcctctgaacaccttgcttccttttctcttttctcctgtcgctgcctcttttctcctcaccctccacagtttgtttctttctttctttctttttttgagacggagtctcgctctgtcgcccatgctggagtgcagtgacatgatctcggctcactgcaggctccgccttctgggttcacgccattctcctgcctcagcctcccaagtagctgggactacaggggcccgccacctcgcctggctatttttttgtatttttagtagagacgggttttcaccgtgttagccaggatggtcttgatctcgtgacctcgtgatccgccagcctcggcctcccaaagcttgctttcttttttctgagatggagtttcgcgcttgtcattcaggctggagtgcaatggtgccatctcagctcactgcaacctctgcctcccaggttcaagcgattctcccacctcagcctcccaagtagctgggattacaggcgcccgccatcatagccggctaatttttgtatttttgtagggacggggtttcactatgttggccaagctggtcttgaactcctgacctcaggtgatataccctcctcagcctcccaaagtgctgggattacagcctggcccacagtttcttcctctttgacctttccttccccatgccaggcagcctgagtcactccctcctcaatatagcgctgatcacatgtcctgcaattgcctgtctcattatgtgtctcttcccatcagctgccagttcctggaggtagggcctgggtctcacagcctgtcctgagtagtagccactcaatgaacatatgtcaaatgaatgaaagaatgaatgtttttgggaggccaaggtgggtgaatcacctgaggtcaggagtttgagaccagcctggccaacatggcaaaaccctgcctctactaaaaatacaaaaaattagctgggcgtggtggtgggtgcctgtaatcacagctacttgggaggctgaggcaggagaattgcttgaacccagaacggggaggttgcagtgagccgagatcatgccattgcactccagcatgggcaacagagcgagactctgtcaaaagaaaaacaaaacaaaaaaggaatgaacgttaatttttgagacatatccatgtccttctgcttgtgaagtttagtctttcccggtaggttgaaccttgctcaaaggaagaggagcctctgatttccttatttcccactatactgcatttacccttgctgccctgtgcagtactctgcatgtagtaggtactaatgtgctgattacctgttcttctatgttctctgtgtggctttcctctacttattccctccctagaactctctgcagtgtctgagctcctgcagcatgggctgccccagataagcagcaggagccctgaaagccttgccttcctgtctgatcgccagtacatggagggagctgctcgccagagacagtactgcatcctgctcctcttctacttggcctacatccatgaagacaggtttgtctcagaggcagagttatttgaggctgtgcaaagcttcctcctgtcgctgcaggaccagggcgagcgccccccactggtggtcttcaaagcctccatctatctgcttgcaatctgccaggacaaagacaatacactacgtgagactatggtcagtgcaatcagaaaattcctagaaggcatcccagacctgcagctagtctatactcaccatccgctcctgctcaggttctttctgttgtatccagagctcatgagtaggtatgggcaccgtgtcctggaactttggttcttctgggaagagagcagctatgaggaactggatgatgtcacctctgctgggcagcccgcccttcctgccagcttagtagtcctgttccagttgctcagaagcatccccagcatcctgctcatcttgctggacctcatctattccagcccagtggacacagctcacaaggtactgattagcctgaggaccttcctgaggaggaatgaggatatccaagtgggcggtcttatccgaggccacttcctgctgatcctgcagcgtctgctagtggagcatggggcatccccatcaggagtcctccttgttcttcacagcctcggggaacctaccattgctgctgagcctcctctccctgatgcagctcaggaatgtgtcagagcaagaactggacagcgtggccatgaagctccttcaccaagtaagcaagctgtgtgggaagtgcagccccactgacgtggacatcctgcagccctccttcaacttcctgtattggagccttcatcagaccacacccagcagtcagaaaagagctgctgcagtgctcctgagcagcacaggcctgatggagcttctggagaagatgctggccctcaccttggcaaaggcagattctcccaggactgcactcctctgctctgcctggctgctcactgcctccttctctgcccagcagcacaagggcagtttgcaggttcaccagacactctctgtggaaatggaccaagtattgaaggctctcagctttccaaagaaaaaggctgcactactctcagctgccatcttatgcttcctgcggacagccctgcgacaaagcttttcctctgccctggtagccctggtgccctcaggggcccagccactgccagccaccaaggacactgtcctagctccactgcgaatgtcgcaagtccggtccctggtcattgggctgcagaacctcctggtgcagaaggaccctctattgtcccaggcctgtgttggctgcctggaggccttgcttgactacctggatgcccggagcccagacattgctctccacgtggcctcccagccttggaatcggtttttgctgtttaccctcttggatgctggagagaattccttcctcagacctgagattttgaggctcatgaccctgtttatgcggtaccggagtagcagtgtcctctctcatgaagaggtgggtgatgttctgcaaggtgtggctttggctgacctgtctaccctctcgaacaccacactccaggccctgcatggcttcttccagcagctccagagcatgggacacctggctgaccacagcatggcccagaccctgcaggcctccttggagggccttccccctagcacctcctcaggccagccacccctgcaggacatgctctgcctgggaggggtggctgtatccctgtcccacatcagaaactgatcctcaggacttgaaggcccagaagtggagagagaatgagacctggagacaaagggcataattgttggggaaatggatgacagctgaagctattcatatggagccatatactctattgttgaaatagaataaggaaataaaatgatacactcacat

SEQ ID NO: 4872 - DNA, 2326 bp, Homo sapiens
gcctcagctgagggcaagcgaggagatggctgtgaggcaggcggcgacggcgggcactcccgggcccaggagagaggaagaggcggcgcttctattcgagagggcccattaccggcacgacccgcgctggctgctgcccgtgaccccccgcctgtgcctggcctgcgcgctggagctgctgccggaccccggcgtgtcgttagtgcgcaagaagcacatgttgtcctgcttccaagatgcccttgtgaggcatacctccctggtcacgcaactggtgtctcaggatcagagagtctgcatccacttcataagtgtgctttttggactattatgcagcatggaagatgggagtgtgacagacctctgtattgaagtccttattcagatcacaacgcagctgaagctggagcagactatccgttgcctgctggatgagtgccacaaagagctgtgtaacatgccctccatgcgaggcagcctggccaccctgacccttcttggcaagttggtggatgccatccctgctctggcagacgagcttgtaatggagcatggcaacctgatggagcatctgttgagaggcttagtataccccagtgagggcatacaagcttctgtctgttacctttatgggaagctatactcctcaccagtggcagctgagatgctttcaggacacttccgtgagaagctttttcccctcttcctttccatcctggatggtgcccagacaaaggagctgcagattaactgcttgggtttgctgaggcagctgttgaagtatgatctctttgtgtccatgatcatgaaccaggatggactgggagaaagtgctaagaatatcgaagggtcatcaggaaatacctcactgcctttggtgctcaaaaagcttctcctctctagagatgaaaccctgcaggtggccagtgctcactgtataactgcggtgcttgtccactccccagcaaagcatgcgtcagccttcatccacgctgacatcccagagttcctctttgagcatctttcttcttccagtgaagtgctcgtctggtccagctgtaactgcttgacactcctggtagaagagccactctttttttccaagtgccacacggtgtatgggatcgaggcagtggtgaggagcctgcagggaagcctgaagatgaacaacatagagctgcacaagcagggcctgctgcttttcgctgaaatcctgacccggcagccagaggagatcaagctgttcacaagctcagccatgtgcagagatgctggccgtgccctccaagaagcagttagcagccctgtgctggaggtggctgctgaggccttgaaggccacttctgcttttctgaggaaggaccatcagagcactccacctgtgcagtatggggaactgcaggctttgctagaagccatgctaaaccgatgtgcggagttttcccagaccttgctgagcaggaggcccctgggccatgcctccagtagagattcagagaaggccattcttcaaaggggaaagttcctcctcagcactctggagggatttagaagtgcctgcaggttggctatagaattccagagtgagccttcagcccaggagaatccattcacagctcccagcgccaagaaggaagacaccttggaggccttctcagaatttcttctcagtgcctgtgactcgctgtgtatccccatggtgatgagacacttggagcagaccacccacccagctttgatggaagttttcctctcaattctacataacctctttgtcatcgttccccacatgaaggagaagttttccaagaagcttgcttcctcatccttcatacgactgaccctggagctgaaggccaggttttgcagtggtctgagtcactcagccctaaaccaggtgtgttccaatttcctctactatatgtgcctcaaccttctctcagctccagagaagacaggaccaccttccaaagaagaactctctgcagtgtctgagctcctgcagcatgggctgccccagataagcagcaggagccctgaaagccttgccttcctgtctgatcgccagtacatggagggagctgctcgccagagacagtactgcatcctgctcctcttctacttggcctacatccatgaagacaggtttgtctcagaggcagagttatttgaggctgtgcaaagcttcctcctgtcgctgcaggaccagggcgagcgccccccactggtggtcttcaaagcctccatctatctgcttgcaatctgccaggacaaagacaatacactacgtgagcaacttcattgcagtttgatcagcatttcctaa

SEQ ID NO: 4873 - DNA, 1358 bp, Homo sapiens
gataccacccaggcttgggactctctgtgacaagtctggtttaaactgctctctgctttattcccacttctctgaagcttcctcatccttcatacgactgaccctggagctgaaggccaggttttgcagtggtctgagaactctctgcagtgtctgagctcctgcagcatgggctgccccagataagcagcaggagccctgaaagccttgccttcctgtctgatcgccagtacatggagggagctgctcgccagagacagtactgcatcctgctcctcttctacttggcctacatccatgaagacaggtttgtctcagaggcagagttatttgaggctgtgcaaagcttcctcctgtcgctgcaggaccagggcgagcgccccccactggtggtcttcaaagcctccatctatctgcttgcaatctgccaggacaaagacaatacactacgtgagactatggtcagtgcaatcagaaaattcctagaaggcatcccagacctgcagctagtctatactcaccatccgctcctgctcaggttctttctgttgtatccagagctcatgagtaggtatgggcaccgtgtcctggaactttggttcttctgggaagagagcagctatgaggaactggatgatgtcacctctgctgggcagcccgcccttcctgccagcttagtagtcctgttccagttgctcagaagcatccccagcatcctgctcatcttgctggacctcatctattccagcccagtggacacagctcacaaggtactgattagcctgaggaccttcctgaggaggaatgaggatatccaagtgggcggtcttatccgaggccacttcctgctgatcctgcagcgtctgctagtggagcatggggcatccccatcaggagtcctccttgttcttcacagcctcggggaacctaccattgctgctgagcctcctctccctgatgcagctcaggaatgtgtcagagcaagaactggacagcgtggccatgaagctccttcaccaaggtgccctggctgcttgggatagcgcccaagggcccagggctggacgtgcagtgggtgctcactaataagcaagctgtgtgggaagtgcagccccactgacgtggacatcctgcagccctccttcaacttcctgtattggagccttcatcagaccacacccagcagtcagaaaagagctgctgcagtgctcctgagcagcacaggcctgatggagcttctggagaagatgctggccctcaccttggcaaaggcagattctcccaggactgcactcctctgctctgcctggctgctcactgcctccttctctgcccagcagcacaagggcagtttgcag

SEQ ID NO: 4874 - DNA, 1845 bp, Homo sapiens
tgcactctcaccagggcagggagctgtcttgacccccagtggaggctgacaatttttttcctgtgtacactggacccctttcatagaggtgggtgctatgcaagtggagctggtgactgatggctgaccattgatacaggctaggaataccaatgagcaaggtgagcactatgttctcagaggacgacttccagtcaacagaaagagccccatatggtccacaactacagtggtcccaggatctgccaagagtccaggtttttagagaacaggccaacctggaggacaggagtcccaggagaacccagaggatcactggaggagaacaagtgctgtggggccccatcacccagatatttcccacagttcggcctgctgacctaaccagagtcatcatgcctcttgagcaaagaagtcagcactgcaagcctgaggaaggccttcaggcccaagaagaagacctgggcctggtgggtgcacaggctctccaagctgaggagcaggaggctgccttcttctcctctactctgaatgtgggcactctagaggagttgcctgctgctgagtcaccaagtcctccccagagtcctcaggaagagtccttctctcccactgccatggatgccatctttgggagcctatctgatgagggctctggcagccaagaaaaggaggggccaagtacctcgcctgacctgatagaccctgagtccttttcccaagatatactacatgacaagataattgatttggttcatttattgctccgcaagtatcgagtcaaggggctgatcacaaaggcagaaatgctggggagtgtcatcaaaaattatgaggactactttcctgagatatttagggaagcctctgtatgcatgcaactgctctttggcattgatgtgaaggaagtggaccccactagccactcctatgtccttgtcacctccctcaacctctcttatgatggcatacagtgtaatgagcagagcatgcccaagtctggcctcctgataatagtcctgggtgtaatcttcatggaggggaactgcatccctgaagaggttatgtgggaagtcctgagcattatgggggtgtatgctggaagggagcacttcctctttggggagcccaagaggctccttacccaaaattgggtgcaggaaaagtacctggtgtaccggcaggtgcccggcactgatcctgcatgctatgagttcctgtggggtccaagggcccacgctgagaccagcaagatgaaagttcttgagtacatagccaatgccaatgggagggatcccacttcttacccatccctgtatgaagatgctttgagagaggagggagagggagtctgagcatgagatgcaaccagggccagcgggcagggaaatgggccaatgcatgcttcagggccacacccagcagtttccctgtcctgtgtgaaatcaggcccattcttccctctgtgtttgatgagagaagtcagtgttctcagtagtagaaggcacagtgaatggaagggaacacattgtatactgcctttaggtttctcttccatcgggtgacttggagatttctttttgtttccctttggtaattttcaaatattgttcctgtaataaaagttttagttagcttcaacatctaagtgtatggatgatactgaccacacatgttgttttgcttatccatttcaagtgcaagtgtttgccattttgtaaaacattttgggaaatcttccatcttgctgtgatttgcaataggtattttcttggagaatgtaagaacttaacaataaagctgaactggtgttgtgaaacagagaaataaaaggagaaggtcatt

SEQ ID NO: 4875 - DNA, 1778 bp, Homo sapiens
gcggggatcagagagaagcgagggcctggttctgaggggtcggcttgagatcggctgagggaagcgggctcagggtctgtgaggaggcaaggttcgcagagaacaggccagccaggaggtcaggaggccccagagaagcactgaagaagacctgcctgtgggtctcaattgcccagctccggcccacactctcctgctgccctgacctgagtcatcatgcttcttgggcagaagagtcagcgctacaaggctgaggaaggccttcaggcccaaggagaggcaccagggcttatggatgtgcagattcccacagctgaggagcagaaggctgcatcctcctcctctactctgatcatgggaacccttgaggaggtgactgattctgggtcaccaagtcctccccagagtcctgagggtgcctcctcttccctgactgtcaccgacagcactctgtggagccaatccgatgagggttccagcagcaatgaagaggaggggccaagcacctccccggacccagctcacctggagtccctgttccgggaagcacttgatgagaaagtggctgagttagttcgtttcctgctccgcaaatatcaaattaaggagccggtcacaaaggcagaaatgcttgagagtgtcatcaaaaattacaagaaccactttcctgatatcttcagcaaagcctctgagtgcatgcaggtgatctttggcattgatgtgaaggaagtggaccctgccggccactcctacatccttgtcacctgcctgggcctctcctatgatggcctgctgggtgatgatcagagtacgcccaagaccggcctcctgataatcgtcctgggcatgatcttaatggagggcagccgcgccccggaggaggcaatctgggaagcgttgagtgtgatggggctgtatgatgggagggagcacagtgtctattggaagctcaggaagctgctcacccaagagtgggtgcaggagaactacctggagtaccgccaggcgcccggcagtgatcctgtgcgctacgagttcctgtggggtccaagggcccttgctgaaaccagctatgtgaaagtcctggagcatgtggtcagggtcaatgcaagagttcgcatttcctacccatccctgcatgaagaggctttgggagaggagaaaggagtttgagcaggagttgcagctagggccagtggggcaggttgtgggagggcctgggccagtgcacgttccagggccacatccaccactttccctgctctgttacatgaggcccattcttcactctgtgtttgaagagagcagtcacagttctcagtagtggggagcatgttgggtgtgagggaacacagtgtggaccatctctcagttcctgttctattgggcgatttggaggtttatctttgtttccttttggaattgttccaatgttccttctaatggatggtgtaatgaacttcaacattcattttatgtatgacagtagacagacttactgctttttatatagtttaggagtaagagtcttgcttttcatttatactgggaaacccatgttatttcttgaattcagacactacaagagcagaggattaaggtttttttagaaatgtgaaacaacatagcagtaaaatacatgagataaagacataaagaaattaaacaatagttaattcttgccttacctgtacctcttagtgtaccctatgtacctgaatttgcttggcttctttgagaatgaaattgaattaaatatgaataaataagtccccctg

SEQ ID NO: 4876 - DNA, 2084 bp, Homo sapiens
gttgtccacccaggtgagccctgggtggacggatgtgacgccactgacgtggccgcggggatcagagagaagcgagggcctggttctgaggggtcggcttgagatcggctgagggaagcgggctcagggtctgtgaggaggcaaggagctccaggaaccaggctgtgaggtcttggtctgaggcagtatcttcaatcacagagcataagaggcccaggcagtagtagcagtcaagctgaggtggtgtttcccctgtatgtataccagaggcccctctggcatcagaacagcaggaaccccacagttcctggccctaccagcccttttgtcagtcctggagccttggcctttgccaggaggctgcaccctgagatgccctctcaatttctccttcaggttcgcagagaacaggccagccaggaggtcaggaggccccagagaagcactgaagaagacctgcctgtgggtctcaattgcccagctccggcccacactctcctgctgccctgacctgagtcatcatgcttcttgggcagaagagtcagcgctacaaggctgaggaaggccttcaggcccaaggagaggcaccagggcttatggatgtgcagattcccacagctgaggagcagaaggctgcatcctcctcctctactctgatcatgggaacccttgaggaggtgactgattctgggtcaccaagtcctccccagagtcctgagggtgcctcctcttccctgactgtcaccgacagcactctgtggagccaatccgatgagggttccagcagcaatgaagaggaggggccaagcacctccccggacccagctcacctggagtccctgttccgggaagcacttgatgagaaagtggctgagttagttcgtttcctgctccgcaaatatcaaattaaggagccggtcacaaaggcagaaatgcttgagagtgtcatcaaaaattacaagaaccactttcctgatatcttcagcaaagcctctgagtgcatgcaggtgatctttggcattgatgtgaaggaagtggaccctgccggccactcctacatccttgtcacctgcctgggcctctcctatgatggcctgctgggtgatgatcagagtacgcccaagaccggcctcctgataatcgtcctgggcatgatcttaatggagggcagccgcgccccggaggaggcaatctgggaagcgttgagtgtgatggggctgtatgatgggagggagcacagtgtctattggaagctcaggaagctgctcacccaagagtgggtgcaggagaactacctggagtaccgccaggcgcccggcagtgatcctgtgcgctacgagttcctgtggggtccaagggcccttgctgaaaccagctatgtgaaagtcctggagcatgtggtcagggtcaatgcaagagttcgcatttcctacccatccctgcatgaagaggctttgggagaggagaaaggagtttgagcaggagttgcagctagggccagtggggcaggttgtgggagggcctgggccagtgcacgttccagggccacatccaccactttccctgctctgttacatgaggcccattcttcactctgtgtttgaagagagcagtcacagttctcagtagtggggagcatgttgggtgtgagggaacacagtgtggaccatctctcagttcctgttctattgggcgatttggaggtttatctttgtttccttttggaattgttccaatgttccttctaatggatggtgtaatgaacttcaacattcattttatgtatgacagtagacagacttactgctttttatatagtttaggagtaagagtcttgcttttcatttatactgggaaacccatgttatttcttgaattcagacactacaagagcagaggattaaggtttttttagaaatgtgaaacaacatagcagtaaaatacatgagataaagacataaagaaattaaacaatagttaattcttgccttacctgtacctcttagtgtaccctatgtacctgaatttgcttggcttctttgagaatgaaattgaattaaatatgaataaataagtccccctgc

SEQ ID NO: 4877 - DNA, 2112 bp, Homo sapiens
gttgtccacccaggtgagccctgggtggacggatgtgacgccactgacgtggccgcggggatcagagagaagcgagggcctggttctgaggggtcggcttgagatcggctgagggaagcgggctcagggtctgtgaggaggcaagcaggcaaaaaacagatgggggcccaacagaaatctgcccggcctcttttgtcacccctgagagcatgagcaggactatcagctgaggcccctgtgttataccagactcattggtctcagggagaagaaggccttggtctgagggcactgcattcaggtcagcagagcgggggtccaaggccctgccaggagtcagggactcagaggacaccactcaccaaacacacaggaccgaaccccaccctgcaccttctgtcagccatgggaagtgcagggaaaggttcgcagagaacaggccagccaggaggtcaggaggccccagagaagcactgaagaagacctgcctgtgggtctcaattgcccagctccggcccacactctcctgctgccctgacctgagtcatcatgcttcttgggcagaagagtcagcgctacaaggctgaggaaggccttcaggcccaaggagaggcaccagggcttatggatgtgcagattcccacagctgaggagcagaaggctgcatcctcctcctctactctgatcatgggaacccttgaggaggtgactgattctgggtcaccaagtcctccccagagtcctgagggtgcctcctcttccctgactgtcaccgacagcactctgtggagccaatccgatgagggttccagcagcaatgaagaggaggggccaagcacctccccggacccagctcacctggagtccctgttccgggaagcacttgatgagaaagtggctgagttagttcgtttcctgctccgcaaatatcaaattaaggagccggtcacaaaggcagaaatgcttgagagtgtcatcaaaaattacaagaaccactttcctgatatcttcagcaaagcctctgagtgcatgcaggtgatctttggcattgatgtgaaggaagtggaccctgccggccactcctacatccttgtcacctgcctgggcctctcctatgatggcctgctgggtgatgatcagagtacgcccaagaccggcctcctgataatcgtcctgggcatgatcttaatggagggcagccgcgccccggaggaggcaatctgggaagcgttgagtgtgatggggctgtatgatgggagggagcacagtgtctattggaagctcaggaagctgctcacccaagagtgggtgcaggagaactacctggagtaccgccaggcgcccggcagtgatcctgtgcgctacgagttcctgtggggtccaagggcccttgctgaaaccagctatgtgaaagtcctggagcatgtggtcagggtcaatgcaagagttcgcatttcctacccatccctgcatgaagaggctttgggagaggagaaaggagtttgagcaggagttgcagctagggccagtggggcaggttgtgggagggcctgggccagtgcacgttccagggccacatccaccactttccctgctctgttacatgaggcccattcttcactctgtgtttgaagagagcagtcacagttctcagtagtggggagcatgttgggtgtgagggaacacagtgtggaccatctctcagttcctgttctattgggcgatttggaggtttatctttgtttccttttggaattgttccaatgttccttctaatggatggtgtaatgaacttcaacattcattttatgtatgacagtagacagacttactgctttttatatagtttaggagtaagagtcttgcttttcatttatactgggaaacccatgttatttcttgaattcagacactacaagagcagaggattaaggtttttttagaaatgtgaaacaacatagcagtaaaatacatgagataaagacataaagaaattaaacaatagttaattcttgccttacctgtacctcttagtgtaccctatgtacctgaatttgcttggcttctttgagaatgaaattgaattaaatatgaataaataagtccccctgc

SEQ ID NO: 4878 - DNA, 1981 bp, Homo sapiens
aacggcctgacgtcggcggagggaagcaggcgcaggctccgtgaggaggcaagaatccgggctttgcccctgcaatcaacccacggaagctccgggaatggcggccaagcacgcggatcctgacgttcacatatctcagggagttgatgaccttgttttcagaaggtgactcaggtcaacacaggggcccccatctggtcgacagatgcagtggttctaggatctgccaagcatccaggtggagagcctgaggaatcaggagctccaggaaccaggcagtgaggccttggtctgagtcagtgtcctcaggtcacagagcagaggggacgcagacagtgccaacactgaaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattcttcctgttc

SEQ ID NO: 4879 - DNA, 1714 bp, Homo sapiens
cagaggacagcgagattctcgccctgagcaacggcctgacgtcggcggagggaagcaggcgcaggctccgtgaggaggcaaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattcttcctgttca

SEQ ID NO: 4880 - DNA, 445 bp, Homo sapiens
aagacgccgagggaggactgaggcgggcctcaccccagacagagggcccccaataatccagcgctgcctctgctgccgggcctggaccaccctgcaggggaagacttctcaggctgagtcgccaccacctcaccccgccaccccccgccgctttaaccgcagggaactctggcatctcagggagttgatgaccttgttttcagaaggtgactcaggtcaacacaggggcccccatctggtcgacagatgcagtggttctaggatctgccaagcatccaggcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactga

SEQ ID NO: 4881 - DNA, 652 bp, Homo sapiens
tcggcggagggaagcaggcgcaggctccgtgaggaggcaagatctcagggagttgatgaccttgttttcagaaggtgactcaggtcaacacaggggcccccatctggtcgacagatgcagtggttctaggatctgccaagcatccaggtggagagcctgaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctg

SEQ ID NO: 4882 - DNA, 879 bp, Homo sapiens
agcgagattctcgccctgagcaacggcctgacgtcggcggagggaagcaggcgcaggctccgtgaggaggcaagatctcagggagttgatgaccttgttttcagaaggtgactcaggtcaacacaggggcccccatctggtcgacagatgcagtggttctaggatctgccaagcatccaggtggagagcctgaggaatcaggagctccaggaaccaggcagtgaggccttggtctgagtcagtgtcctcaggtcacagagcagaggggacgcagacagtgccaacactgaaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagc

SEQ ID NO: 4883 - DNA, 750 bp, Homo sapiens
gcaacggcctgacgtcggcggagggaagcaggcgcaggctccgtgaggaggcaagaatccgggctttgcccctgcaatcaacccacggaagctccgggaatggcggccaagcacgcggatcctgacgttcacatatctcagggagttgatgaccttgttttcagaaggtgactcaggtcaacacaggggcccccatctggtcgacagatgcagtggttctaggatctgccaagcatccaggtggagagcctgaggaatcaggagctccaggaaccaggcagtgaggccttggtctgagtcagtgtcctcaggtcacagagcagaggggacgcagacagtgccaacactgaaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaac

SEQ ID NO: 4884 - DNA, 753 bp, Homo sapiens
aggtaagacgccgagggaggactgaggcgggcctcaccccagacagagggcccccaataatccagcgctgcctctgctgccgggcctggaccaccctgcaggggaagacttctcaggctgagtcgccaccacctcaccccgccaccccccgccgctttaaccgcagggaactctggcgttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccg

SEQ ID NO: 4885 - DNA, 576 bp, Homo sapiens
aacggcctgacgtcggcggagggaagcaggcgcaggctccgtgaggaggcaagggaactctggcgtaagagctttgtgtgaccagggcagggctggttagaagtgctcagggcccagactcagccaggaatcaagaatccgggctttgcccctgcaatcaacccacggaagctccgggaatggcggccaagcacgcggatcctgacgttcacatatctcagggagttgatgaccttgttttcagaaggtgactcaggtcaacacaggggcccccatctggtcgacagatgcagtggttctaggatctgccaagcatccaggtggagagcctgaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcag

SEQ ID NO: 4886 - DNA, 1811 bp, Homo sapiens
aaagtgggcgtggccggacatgtttctcttgacctatcttccacatcatcaagctgttacgggcgaaaccttggtctgaaacatgcggccagagaaataaatctcaggatccggcaggtgtcaaaggtgccctcttcatcaattcaactgcctgcactattgtctgtagtccctgacaagagtaattatgcctcgaggtcagaagagtaagctccgtgcccgtgagaaacgccaccaggctcgttgtgagaatcaggatctgggagctacgcaggccactgtggcagaaggagagtcaccctcccctgcctatcttctctttggtgacagaccccagaatttgcctgctgctgagacacctagcatccctgaagcgcttcagggagccccatccaccaccaatgctattgcacctgtttcatgcagttcaaatgaaggtgccagcagccaagatgagaaaagtctaggttcctcaagggaagctgagggctggaaagaagatcctttaaacaagaaagtagtgtcgctggtgcatttcttgcttcagaagtatgaaacgaaagagccaattacaaagggagatatgataaagtttgttatcaggaaggataagtgtcacttcaatgagatcctcaagagagcctctgagcacatggagctggcacttggtgttgatttgaaggaagtggatcccatcaggcactactatgcctttttcagcaaattagacctcacctatgatgaaacaaccagtgatgaagaaaaaattcccaagactggcctcctgatgattgcactgggtgtgatctttctgaatggcaaccgtgccccagaagaggcagtctgggaaattatgaatatgatgggtgtatatgccgataggaagcacttcctctatggggatcccaggaaggtcatgaccaaagatttggtgcagctaaagtacctggagtaccagcaagtgcccaacagtgatcctccacgctatgaattcctgtggggtccaagagctcacgctgaaactagcaagatgaaagtcctggagtttgtagccaagatacatgataccgtccctagtgccttcccatcctgctatgaagaggctttgagggatgaggaacagagaacccaagccagagctgcagccagggctcatactgctgccatggcaaatgcacgttccagaaccacgtctagcagcttctcccatgctaagtgaaatctgaggcttgttcttcactttttggtcgaaaaggttacatttcaaatgttcaagtctgaagattgttttctttgtggaagagaagagcagtcaacattctaagtagtgaatggccagagtgcgtctggagggaacacagcatatatcattttgtgttaatagtctatagtaactcggagttgtatctttttctttcttttttttttggtgttatatttcaaatgttgttgcttataatagaagttttagataacttcagaatctatatttattaatgactttggttacacacgtattgctatttaagagtaggagttttattgttctgtaaaacaaattgggaaaccttctttcatatttaatgagccagaacaaggaaacacagtattggaataggtatttccttaaaaaatgtgagatgatttagcagtaaaattttggagatcaaaacataggtgagaaaaagtaaacttttcagttcttggttttctttttccattttagtctgttatataaaaataaaagtcatacctggattggcttagcttactgaagaaggtaggaagaaataaaatgtttatgaaccagc

SEQ ID NO: 4887 - DNA, 2747 bp, Homo sapiens
ggcgaagaggcggggtcgcccaagctgccgcgctggcattttctcctggacaaggagagagtgcggctgctgagagccgagcccagcaatcccgatcctctgagtcgtgaagaagggaggcagcgagggggttggggttggggcctgaggcaagcccccaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaatta

SEQ ID NO: 4888 - DNA, 2701 bp, Homo sapiens
gaagttgcctgaagtgaaggagggggtagcggctgcagaagctaaagcttccgccaaacaaaagaggacagcacttccggtcacgccatcgttgctgccttcttcgtcaagcccccaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaa

SEQ ID NO: 4889 - DNA, 2510 bp, Homo sapiens
gcagtaggcgagggcgcggctgcggggttcctggtgctgaggacggacgccattggagttcccgagaagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaa

SEQ ID NO: 4890 - DNA, 2650 bp, Homo sapiens
gcatgcgcaggctacccagccgcggggggtgcacggagaaaaggggcggggtggtccgggctgctgtgctggcagcagtaggcgagggcgcggctgcggggttcctggtgctgaggacggacgccattggagttcccgagaaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagaacccggagctcagagaggagacgcctctgagcatggctcccagctggtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaa

SEQ ID NO: 4891 - DNA, 4308 bp, Homo sapiens
agtcttcggggaggagctgcattacacacaggcttcggaggcttccgtggagaagcttggaggtaatggctgtcgtaaatgctagttattttcagagagttctcgaagatttggaataaagccgagccccagaaagacaggtcaaccacagaagtgctgagccaggtaaagaccctgctggacaagcagctggagtgagaatcaagacagctggaccacaggaccagacccagcagtatccatgtaacaggaaaggtccccttgctattcccatcactgggagggggcggagcctcgtcggagccgctcggaagggagctgtacccggccagtattgggggaggggcagcatttcaagaggctgcagctgacaagaagcttcaagcataggttaatatcagagaagcacatgacctgggcaatctgcatgtgatgccaaccaagccttggaaagacagtgcaaccacagaagtgccgagctgggtaaaggccctgctggacaagcagttggagtgagaatcaagacagccggaccacaggaccagacccaccaggatccacatgacagtggtatcttccggtatcatcctattcaaacaacgtgttcaagcatccttggaaaattgaggtggagaacaggccacacaagctgtaaaccctttgtagtcataagacgaaagaggatttgttaagagtattgttttgggtagaacttgcattagcagtgacaaagatagccacctcaacctttggtaataacccttggcacacaaatataaaccataatggagtctgagtatgtcctatgcaactggaaagaccagttgtggccagcaaaagttttgtccagatctgaaacttcatcaaacagtaagaggaaaaaggcattttctctagaagttcaaatactctcactagatgaaaaaattaaattggacagcacagaaacaaagatcctaaataaatctcaaattgaagccattgctgcctcattaggactacagtcagaggacagtgctccacctacagaggaaactgcctatggaagatcactaaaagtggcactgggtattctgaatgagagaacaaatttgagtcaagcaagcacttcagatgaagaggagatcactatgctgtctcaaaatgtaccacaaaaacagtccgattcaccccctcataaaaaataccggaaggatgaaggtgacttaccagggtgtcttgaggaaagggaaaactcagcatgcttgttagcatcttcagagagtgatgattccctgtatgatgataaatcacaagcacccacaatggtcgatactattccaagtgaagtggaaacaaagtcattacaaaactctagctggtgcgagactttcccttcactttcggaagataatgatgaaaaagagaacaagaataagattgatatctcagcagttatgtctgtgcattctgcagtcaaagaggaaagtgcatgtgttaaagatgaaaagtttgctccacctttgtcacctttgtcatcagatatgctcattatgcccaaagctttgaaagaagagagcgaggatacctgcctagagaccctggctgttccctctgaatgctctgctttctcagagaatattgaggatcctggagagggtccctcaaatccatgcttagataccagccagaatcaaccttccatggaatcagagatgggggctgcagcatgccctgggagttgttcaagggaatgcgaggtttcatttagtgcctctaaccctgtctgggattattcacatcttatgagtagtgaaagaaattttcagagactggattttgaagaacttgaggaagaaggtcaagcctctgacaagtcattgcttccaagtcgcattaatctttctctattagatgatgatgaggaagacgaagaacttccacgcttcattttacattatgagacacatccgtttgaaacaggaatgatagtctggtttaaatatcagaaatatccattttggccagcagtgataaaaagtatcagacgaaaagagaggaaagcaagtgtgctttttgttgaggcaaacatgaattctgaaaagaagggcattagagtaaattttagaagattaaagaaatttgattgtaaagagaaacaaatgctagtggacaaagccagggaggattatagtgagagtattgactggtgcatctcactaatttgtgactacagagttagaataggttgtggttctttcacgggctctttgcttgagtattatgctgctgatattagttacccagttaggaaagaaacaaaacaggatactttcaggaacaaatttccaaagctgcataatgaagatgccagggaaccgatggctgtaacttcccagaccaagaaaatgtccttccaaaaaattctccctgaccggatgaaggctgctcgggaccgagccaacaagaacctggtggacttcattgtgaatgcaaagggaacagagaaccatcttctggccattgtaaatggcacaaaaggatccagatggctgaaatcatttttgaatgcaaataggttcacaccctgtattgaaacatactttgaggatgaagatcagttggatgaagtggtgaaatatttacaagaagtctgcaatcaaatagatcaaataatgccaacttggataaaagatgataaaattaaatttatcctagaagttcttctgccagaagcaattatttgttcaatttctgctgttgatgggttagattacgaggcagctgaagcaaagtatctaaaaggaccatgtctaggctacagggaaagagaattatttgatgcaaaaataatatatgaaaagagacgaaaagcaccaacaaatgaagctcactaaatgtgctgaaagttgaaaccatgacagggagctctcatagatactagttgaaaaaagtctctgaacaattctctctaatacatattttctgcaaatgggagcatggataatgtgttcacttttttttgagatctctaggatctgtggttataattacatctttatttccttttcttgcgcttcttcaaagttaattttgtcaacatatttcagcagttctactttcccgtacattttttagaaagcataattcctaaatgattttgaagggaaagtactattttgttttatgacacttttgagtctatgctgtattgttaaatatattgtgcacaattattttaatgttaaaattgcactggtgttagatattaacgaagatgattggaaaaaagtctgaaagatacatcatttctatattccttgcttaatttttataaaatattgggttttcccttaagatagttgaagtatttttcttgccatgcctatttatttttgcaaaaaaattatctgctatatagaaccaaagatagattcgctttgctatatattataactatacttgcttttgcaataaaacaacttgtaattcaaaaatgaagattatctgcatatagtatttatgtgtgtgaataacatcttggcatgcagaaaataattttggctgctttgaacaggattgttcattctacacttccctgaaattccatttttgggagtgtctatccttcaatggctgaatagttccttaaatcagacaagctcctggctatcttcataaccagcagtgagtagatcttcttaatatagctgtctgaccacatgtggaaggcagctagacttattgtatttacagcctggccactctagacatatgaatccaggctgactgcttaagtgcccatctcgtttgatataaactgtagaaaaggcaagcactttgttctgagtcttttatctccaaatacatagttgtctcaaaccaagcaagctttatcaaaatggcttatttgcagaatagttccaatgatataaatgccaactggcaagtcattccaaactgcttgaaggagtagatgaaccagaatctgagaatttggaaataggtcacagaaaaagcctccatttggctaaatatgacaattatctgagtatggttaaatacatacaattaaatgtctgaagccaatgagttgtttattctaacttgaaatatatttttgtgagaataaatgttagaaaagttagtttattttggaaacctgccgtgaaaggaaattctaaaggcttaacatgaaactgtctgcatttctacctgttagacaatggttgctcttgggctcttgttatacagtcatatggctacacgtttatgtaaagtttgcaaaagtttggtgttttgatttataataaaactgttatattattc

SEQ ID NO: 4892 - DNA, 4173 bp, Homo sapiens
agtcttcggggaggagctgcattacacacaggcttcggaggcttccgtggagaagcttggaggtaatggctgtcgtaaatgctagttattttcagagagttctcgaagatttggaataaagccgagccccagaaagacaggtcaaccacagaagtgctgagccaggtaaagaccctgctggacaagcagctggagtgagaatcaagacagctggaccacaggaccagacccagcagtatccatgtaacacataggttaatatcagagaagcacatgacctgggcaatctgcatgtgatgccaaccaagccttggaaagacagtgcaaccacagaagtgccgagctgggtaaaggccctgctggacaagcagttggagtgagaatcaagacagccggaccacaggaccagacccaccaggatccacatgacagtggtatcttccggtatcatcctattcaaacaacgtgttcaagcatccttggaaaattgaggtggagaacaggccacacaagctgtaaaccctttgtagtcataagacgaaagaggatttgttaagagtattgttttgggtagaacttgcattagcagtgacaaagatagccacctcaacctttggtaataacccttggcacacaaatataaaccataatggagtctgagtatgtcctatgcaactggaaagaccagttgtggccagcaaaagttttgtccagatctgaaacttcatcaaacagtaagaggaaaaaggcattttctctagaagttcaaatactctcactagatgaaaaaattaaattggacagcacagaaacaaagatcctaaataaatctcaaattgaagccattgctgcctcattaggactacagtcagaggacagtgctccacctacagaggaaactgcctatggaagatcactaaaagtggcactgggtattctgaatgagagaacaaatttgagtcaagcaagcacttcagatgaagaggagatcactatgctgtctcaaaatgtaccacaaaaacagtccgattcaccccctcataaaaaataccggaaggatgaaggtgacttaccagggtgtcttgaggaaagggaaaactcagcatgcttgttagcatcttcagagagtgatgattccctgtatgatgataaatcacaagcacccacaatggtcgatactattccaagtgaagtggaaacaaagtcattacaaaactctagctggtgcgagactttcccttcactttcggaagataatgatgaaaaagagaacaagaataagattgatatctcagcagttatgtctgtgcattctgcagtcaaagaggaaagtgcatgtgttaaagatgaaaagtttgctccacctttgtcacctttgtcatcagatatgctcattatgcccaaagctttgaaagaagagagcgaggatacctgcctagagaccctggctgttccctctgaatgctctgctttctcagagaatattgaggatcctggagagggtccctcaaatccatgcttagataccagccagaatcaaccttccatggaatcagagatgggggctgcagcatgccctgggagttgttcaagggaatgcgaggtttcatttagtgcctctaaccctgtctgggattattcacatcttatgagtagtgaaagaaattttcagagactggattttgaagaacttgaggaagaaggtcaagcctctgacaagtcattgcttccaagtcgcattaatctttctctattagatgatgatgaggaagacgaagaacttccacgcttcattttacattatgagacacatccgtttgaaacaggaatgatagtctggtttaaatatcagaaatatccattttggccagcagtgataaaaagtatcagacgaaaagagaggaaagcaagtgtgctttttgttgaggcaaacatgaattctgaaaagaagggcattagagtaaattttagaagattaaagaaatttgattgtaaagagaaacaaatgctagtggacaaagccagggaggattatagtgagagtattgactggtgcatctcactaatttgtgactacagagttagaataggttgtggttctttcacgggctctttgcttgagtattatgctgctgatattagttacccagttaggaaagaaacaaaacaggatactttcaggaacaaatttccaaagctgcataatgaagatgccagggaaccgatggctgtaacttcccagaccaagaaaatgtccttccaaaaaattctccctgaccggatgaaggctgctcgggaccgagccaacaagaacctggtggacttcattgtgaatgcaaagggaacagagaaccatcttctggccattgtaaatggcacaaaaggatccagatggctgaaatcatttttgaatgcaaataggttcacaccctgtattgaaacatactttgaggatgaagatcagttggatgaagtggtgaaatatttacaagaagtctgcaatcaaatagatcaaataatgccaacttggataaaagatgataaaattaaatttatcctagaagttcttctgccagaagcaattatttgttcaatttctgctgttgatgggttagattacgaggcagctgaagcaaagtatctaaaaggaccatgtctaggctacagggaaagagaattatttgatgcaaaaataatatatgaaaagagacgaaaagcaccaacaaatgaagctcactaaatgtgctgaaagttgaaaccatgacagggagctctcatagatactagttgaaaaaagtctctgaacaattctctctaatacatattttctgcaaatgggagcatggataatgtgttcacttttttttgagatctctaggatctgtggttataattacatctttatttccttttcttgcgcttcttcaaagttaattttgtcaacatatttcagcagttctactttcccgtacattttttagaaagcataattcctaaatgattttgaagggaaagtactattttgttttatgacacttttgagtctatgctgtattgttaaatatattgtgcacaattattttaatgttaaaattgcactggtgttagatattaacgaagatgattggaaaaaagtctgaaagatacatcatttctatattccttgcttaatttttataaaatattgggttttcccttaagatagttgaagtatttttcttgccatgcctatttatttttgcaaaaaaattatctgctatatagaaccaaagatagattcgctttgctatatattataactatacttgcttttgcaataaaacaacttgtaattcaaaaatgaagattatctgcatatagtatttatgtgtgtgaataacatcttggcatgcagaaaataattttggctgctttgaacaggattgttcattctacacttccctgaaattccatttttgggagtgtctatccttcaatggctgaatagttccttaaatcagacaagctcctggctatcttcataaccagcagtgagtagatcttcttaatatagctgtctgaccacatgtggaaggcagctagacttattgtatttacagcctggccactctagacatatgaatccaggctgactgcttaagtgcccatctcgtttgatataaactgtagaaaaggcaagcactttgttctgagtcttttatctccaaatacatagttgtctcaaaccaagcaagctttatcaaaatggcttatttgcagaatagttccaatgatataaatgccaactggcaagtcattccaaactgcttgaaggagtagatgaaccagaatctgagaatttggaaataggtcacagaaaaagcctccatttggctaaatatgacaattatctgagtatggttaaatacatacaattaaatgtctgaagccaatgagttgtttattctaacttgaaatatatttttgtgagaataaatgttagaaaagttagtttattttggaaacctgccgtgaaaggaaattctaaaggcttaacatgaaactgtctgcatttctacctgttagacaatggttgctcttgggctcttgttatacagtcatatggctacacgtttatgtaaagtttgcaaaagtttggtgttttgatttataataaaactgttatattattca

SEQ ID NO: 4893 - DNA, 3957 bp, Homo sapiens
tttcaccaggctgcagctgacaagaagcttcaagcataggttaatatcagagaagcacatgacctgggcaatctgcatgtgatgccaaccaagccttggaaagacagtgcaaccacagaagtgccgagctgggtaaaggccctgctggacaagcagttggagtgagaatcaagacagccggaccacaggaccagacccaccaggatccacatgacagtggtatcttccggtatcatcctattcaaacaacgtgttcaagcatccttggaaaattgaggtggagaacaggccacacaagctgtaaaccctttgtagtcataagacgaaagaggatttgttaagagtattgttttgggtagaacttgcattagcagtgacaaagatagccacctcaacctttggtaataacccttggcacacaaatataaaccataatggagtctgagtatgtcctatgcaactggaaagaccagttgtggccagcaaaagttttgtccagatctgaaacttcatcaaacagtaagaggaaaaaggcattttctctagaagttcaaatactctcactagatgaaaaaattaaattggacagcacagaaacaaagatcctaaataaatctcaaattgaagccattgctgcctcattaggactacagtcagaggacagtgctccacctacagaggaaactgcctatggaagatcactaaaagtggcactgggtattctgaatgagagaacaaatttgagtcaagcaagcacttcagatgaagaggagatcactatgctgtctcaaaatgtaccacaaaaacagtccgattcaccccctcataaaaaataccggaaggatgaaggtgacttaccagggtgtcttgaggaaagggaaaactcagcatgcttgttagcatcttcagagagtgatgattccctgtatgatgataaatcacaagcacccacaatggtcgatactattccaagtgaagtggaaacaaagtcattacaaaactctagctggtgcgagactttcccttcactttcggaagataatgatgaaaaagagaacaagaataagattgatatctcagcagttatgtctgtgcattctgcagtcaaagaggaaagtgcatgtgttaaagatgaaaagtttgctccacctttgtcacctttgtcatcagatatgctcattatgcccaaagctttgaaagaagagagcgaggatacctgcctagagaccctggctgttccctctgaatgctctgctttctcagagaatattgaggatcctggagagggtccctcaaatccatgcttagataccagccagaatcaaccttccatggaatcagagatgggggctgcagcatgccctgggagttgttcaagggaatgcgaggtttcatttagtgcctctaaccctgtctgggattattcacatcttatgagtagtgaaagaaattttcagagactggattttgaagaacttgaggaagaaggtcaagcctctgacaagtcattgcttccaagtcgcattaatctttctctattagatgatgatgaggaagacgaagaacttccacgcttcattttacattatgagacacatccgtttgaaacaggaatgatagtctggtttaaatatcagaaatatccattttggccagcagtgataaaaagtatcagacgaaaagagaggaaagcaagtgtgctttttgttgaggcaaacatgaattctgaaaagaagggcattagagtaaattttagaagattaaagaaatttgattgtaaagagaaacaaatgctagtggacaaagccagggaggattatagtgagagtattgactggtgcatctcactaatttgtgactacagagttagaataggttgtggttctttcacgggctctttgcttgagtattatgctgctgatattagttacccagttaggaaagaaacaaaacaggatactttcaggaacaaatttccaaagctgcataatgaagatgccagggaaccgatggctgtaacttcccagaccaagaaaatgtccttccaaaaaattctccctgaccggatgaaggctgctcgggaccgagccaacaagaacctggtggacttcattgtgaatgcaaagggaacagagaaccatcttctggccattgtaaatggcacaaaaggatccagatggctgaaatcatttttgaatgcaaataggttcacaccctgtattgaaacatactttgaggatgaagatcagttggatgaagtggtgaaatatttacaagaagtctgcaatcaaatagatcaaataatgccaacttggataaaagatgataaaattaaatttatcctagaagttcttctgccagaagcaattatttgttcaatttctgctgttgatgggttagattacgaggcagctgaagcaaagtatctaaaaggaccatgtctaggctacagggaaagagaattatttgatgcaaaaataatatatgaaaagagacgaaaagcaccaacaaatgaagctcactaaatgtgctgaaagttgaaaccatgacagggagctctcatagatactagttgaaaaaagtctctgaacaattctctctaatacatattttctgcaaatgggagcatggataatgtgttcacttttttttgagatctctaggatctgtggttataattacatctttatttccttttcttgcgcttcttcaaagttaattttgtcaacatatttcagcagttctactttcccgtacattttttagaaagcataattcctaaatgattttgaagggaaagtactattttgttttatgacacttttgagtctatgctgtattgttaaatatattgtgcacaattattttaatgttaaaattgcactggtgttagatattaacgaagatgattggaaaaaagtctgaaagatacatcatttctatattccttgcttaatttttataaaatattgggttttcccttaagatagttgaagtatttttcttgccatgcctatttatttttgcaaaaaaattatctgctatatagaaccaaagatagattcgctttgctatatattataactatacttgcttttgcaataaaacaacttgtaattcaaaaatgaagattatctgcatatagtatttatgtgtgtgaataacatcttggcatgcagaaaataattttggctgctttgaacaggattgttcattctacacttccctgaaattccatttttgggagtgtctatccttcaatggctgaatagttccttaaatcagacaagctcctggctatcttcataaccagcagtgagtagatcttcttaatatagctgtctgaccacatgtggaaggcagctagacttattgtatttacagcctggccactctagacatatgaatccaggctgactgcttaagtgcccatctcgtttgatataaactgtagaaaaggcaagcactttgttctgagtcttttatctccaaatacatagttgtctcaaaccaagcaagctttatcaaaatggcttatttgcagaatagttccaatgatataaatgccaactggcaagtcattccaaactgcttgaaggagtagatgaaccagaatctgagaatttggaaataggtcacagaaaaagcctccatttggctaaatatgacaattatctgagtatggttaaatacatacaattaaatgtctgaagccaatgagttgtttattctaacttgaaatatatttttgtgagaataaatgttagaaaagttagtttattttggaaacctgccgtgaaaggaaattctaaaggcttaacatgaaactgtctgcatttctacctgttagacaatggttgctcttgggctcttgttatacagtcatatggctacacgtttatgtaaagtttgcaaaagtttggtgttttgatttataataaaactgttatattattc

SEQ ID NO: 4894 - DNA, 507 bp, Homo sapiens
cttctgtggccagaggggacagcggaggagcccagtccacgatggcccggtccctggtgtgccttggtgtcatcatcttgctgtctgccttctccggacctggtgtcaggggtggtcctatgcccaagctggctgaccggaagctgtgtgcggaccaggagtgcagccaccctatctccatggctgtggcccttcaggactacatggcccccgactgccgattcctgaccattcaccggggccaagtggtgtatgtcttctccaagctgaagggccgtgggcggctcttctggggaggcagcgttcagggagattactatggagatctggctgctcgcctgggctatttccccagtagcattgtccgagaggaccagaccctgaaacctggcaaagtcgatgtgaagacagacaaatgggatttctactgccagtgagctcagcctaccgctggccctgccgtttcccctccttggctttatgcaaatacaatcagcccagtgcaaa

SEQ ID NO: 4895 - DNA, 2600 bp, Homo sapiens
gcatgcgcaggctacccagccgcggggggtgcacggagaaaaggggcggggtggtccgggctgctgtgctggcagcagtaggcgagggcgcggctgcggggttcctggtgctgaggacggacgccattggagttcccgagaaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaatt

SEQ ID NO: 4896 - DNA, 6430 bp, Homo sapiens
ccgggctgagacggggccggagcggcgccccggccgcccgcgcggggtctcccccatggtgcagcggggttcgggatgtcgaagacgctgaagaagaagaagcactggctcagcaaggtgcaggagtgcgccgtgtcctgggccgggcccccgggcgacttcggcgcggagatccgcggtggcgcggagcgtggcgagttcccctacctggggcggctccgcgaggagcccggcgggggcacctgctgcgtcgtctcgggcaaggcgcccagcccaggcgatgtgctgctggaggtaaacgggacgcctgtcagcgggctcaccaaccgggacaccctggctgtcatccgccacttccgcgagcccatccgtctcaagactgtgaaaccaggcaaagtcattaataaagatttgcggcattacctaagtcttcagtttcaaaaaggatcaattgaccacaaactgcagcaagtgatcagagataatctctacttgagaaccattccatgcactacaagggcccccagggatggagaagtaccaggagtggattataatttcatttccgttgaacagttcaaagcactggaagagagtggagcattgttagaaagtgggacatatgatggaaacttctatggaactcccaagcctccagcagaacccagcccttttcagccagatccagttgatcaagtcctctttgataatgagtttgatgcagaatctcaaagaaaacgaacgacatctgtcagcaagatggaaagaatggatagctctcttcctgaagaggaagaagatgaggacaaggaagctattaatggcagtggaaacgcagaaaacagagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgaccacaataccaagacaaccacctggttggatcctcgtctttgtaagaaagccaaagcccctgaagactgtgaagatggagagcttccttatggctgggagaaaatagaggaccctcagtatgggacatactatgttgatcaccttaaccagaaaacccagtttgaaaatccagtggaggaagccaaaaggaaaaagcagttaggacaggttgaaattgggtcttcaaaaccagatatggaaaaatcacacttcacaagagatccatcccagcttaaaggtgtccttgttcgagcatcactgaaaaaaagcacaatgggatttggttttactattattggtggagatagacctgatgagttcctacaagtgaaaaatgtgctgaaagatggtcccgcagctcaggatgggaaaattgcaccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaagggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtcctccttcaccaaccaaaactgccaaaatgaaaacagataaaaaggaaaatgcaggaagtttggaggccataaatgagcctattcctcagcctatgccttttccaccgagcattatcaggtcaggatccccaaaattggatccttctgaggtctacctgaaatctaagactttatatgaagataaaccaccaaacaccaaagatttggatgtttttcttcgaaaacaagagtcagggtttggcttcagggtgctaggaggagatggacctgaccagtctatatatattggggctattattcccctgggagcagctgagaaagatggtcggctccgcgcagctgatgaactaatgtgcattgatggaattcctgttaaagggaaatcacacaaacaagtcttggacctcatgacaactgctgctcgaaatggccatgtgttactaactgtcagacggaagatcttctatggagaaaaacaacccgaggacgacagctctcaggccttcatttcaacacagaatggatctccccgcctgaaccgggcagaggtcccagccaggcctgcaccccaggagccctatgatgttgtcttgcaacgaaaagaaaatgaaggatttggctttgtcatcctcacctccaaaaacaaaccacctccaggagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaagagcatcatggtccaccatcaggaacaaactcagccaggcaaagcccagccctgcagcacaggcccatgggacagtcacaggccaaccacatacctggggacagaagtgccctagaaggtgaaattggaaaagatgtctccacttcttacagacattcttggtcagaccacaagcaccttgcacagcctgacaccgcagtaatttcagttgtaggcagtcggcacaatcagaaccttggttgttatccagtagagctggagagaggcccccggggctttggattcagcctccgaggggggaaggagtacaacatggggctgttcatccttcgtcttgctgaagatggtcctgccatcaaagatggcagaattcatgttggtgaccagattgttgaaatcaatggggaacctacacaaggaatcacacatactcgagcaattgagctcattcaggctggtggaaataaagttcttcttcttttgaggccaggaactggcttgatacctgaccatggtgattgggatattaataatccttcgtcttcaaatgtgatttatgatgaacagtcaccattacccccatcttcacattttgcttccatatttgaagagtctcacgtgccagtaattgaagaatctttgagagttcagatatgtgaaaaggcagaagaattaaaggacattgtgcctgaaaagaaaagcactttaaatgaaaatcagcctgagataaagcatcagtctcttctccagaaaaatgtgagtaagagggatccacccagcagtcatgggcacagtaacaagaaaaatctattaaaagtagaaaatggtgttacacgaagaggtagatcggttagtcccaaaaagccagccagtcaacattcagaggaacatttggataagattcctagtcctctaaaaaataaccccaaaagaagacccagagatcaatccctcagccccagcaaaggggaaaataaaagttgtcaggtcagcaccagggcaggctctggacaagatcagtgcagaaaaagcagaggtcggtcggccagcccaaaaaagcagcaaaaaattgaaggaagcaaagctccatcaaatgctgaggccaaattattagagggtaagagtcgaagaatagcaggctatacgggcagtaatgctgagcagatcccagatgggaaggaaaaatcagacgtcatcaggaaagatgcaaagcagaatcagttggaaaaaagcagaacaaggtctccagagaaaaaaatcaaaagaatggttgagaaatctcttccatccaaaatgactaataagactacaagtaaagaagtatctgaaaatgaaaaaggaaagaaagtaaccacaggagaaacaagttctagtaacgataaaataggagaaaatgtccagctatcagaaaagaggctgaagcaagaacctgaagagaaggtagtttcaaacaaaacagaagatcacaaagggaaagaactagaggcagctgacaaaaacaaagagactggaaggttcaaaccggaaagcagttctccagttaagaaaacactgataactccagggccctggaaggttccaagtggaaataaagtcacaggcactattggtatggctgagaaacggcagtaacctttagtataaaacaaagaaaaacaagttgtaatcttttcttacagcagcatttttccagaaaaagcctttttttttttttcagatattctgaaacagataagtacatgttaatgtgagcctcaagttacctaggctgcatgaagggcctttaggattgctaagaaccaactgtccccctggccggctgccctccctcgctctcaggaaggagctgcatccacatgctcatctgacccgccctgctcaggctgcccagctcgtcttcatgagtgtctgaacaaatgacatatgttgatattaacaatgtggtcacaactcactttgtatttgtgccaagttatctactgtatcatgtctgtttttatcctttttgttcagctgtttccacagtaatgaaaaagttaggtttggcttggaagttgatgatctcaatagcatgttgcatgtttacagagagaaatatgtgagtccttgcagaagaagagactgttaactcatcgttaaagatggccgttgtctcttctaacagctactgatgatgtcccactttaaaaataaaacccccaaacatcactactttaaggaaaaaaaaaatgtagtccaatattgatgctttcttatggctttttattttaatttggctggataagttgtttcaaataactgttaaagatattacttacaattgaatgtttgaaataagaaagtactttaagcaatagagttcatctcctgctgtgttatccaacctcgatgtatacttacagcatctcaggtcaccctttttatttcagttatttaattatgaaaccataaagaagcatgtggaaatagtgtttattgctctttgaagaaaaaccaccaactatttctggatattttggctgtacctactactaaagtcattagtctttaatacataatacatatttgaaaagtaaacatattatatagattatgtgagggacttaatcatgaaaccagtttcacagtccaagtaccaactcttctggtagcaggtgcacaagcttgggtgtttaaaaacaacctgtgtagggtatgcccagcaaatgaggacaaatgtgtagacagtacttactggatcttatttaacttttagctacattaactaactttcttatttaaaaacaagaaagggagactaaacatctgcttaacttgtacacattttcagaattctttttaaaagtctagttaaagatgtttcttagaagttggagactgttaacaacttccataaaatagatccaggtttttcagttccctgaagcagcattcagtagcatctatataaataaaggcaccttctgagaataaaactattttatggagtgtgtgaacacacttgttctgtcacctgggttcatcttgttgtgaagcacattaggtccaggtccttccctctgggagtctgactgtgaaactctttaacccaacaactcaattagcccctgtagataagacatgcttcccagagtgagatttttgaaatccccttttcatccagaactatatttacccacctattgtaactattcaaatagagcaaaattaggaggcttgataaatactaagaatttagtaccacagaaattatttattattttccctgtagtccacaattagtgataacgaatcctatttttgttaactgtgacataactttgatgtcatatgttgtcctatgtggttcttcctaagtaaactctgtactgattatatactgacttagcaatgtggccttggaatgctgagcaaaatgtggatgtactggttgtaaatgtttatatattgtacagtacctttatatatacacttgaggttctgattagagaaagatctgtaaattgctcattattttttatatagatatttaaaaaaaaca

SEQ ID NO: 4897 - DNA, 3596 bp, Homo sapiens
cggccgcccgcgcggggtctcccccatggtgcagcggggttcgggatgtcgaagacgctgaagaagaagaagcactggctcagcaaggtgcaggagtgcgccgtgtcctgggccgggcccccgggcgacttcggcgcggagatccgcggtggcgcggagcgtggcgagttcccctacctggggcggctccgcgaggagcccggcgggggcacctgctgcgtcgtctcgggcaaggcgcccagcccaggcgatgtgctgctggaggtaaacgggacgcctgtcagcgggctcaccaaccgggacaccctggctgtcatccgccacttccgcgagcccatccgtctcaagactgtgaaaccaggcaaagtcattaataaagatttgcggcattacctaagtcttcagtttcaaaaaggatcaattgaccacaaactgcagcaagtgatcagagataatctctacttgagaaccattccatgcactacaagggcccccagggatggagaagtaccaggagtggattataatttcatttccgttgaacagttcaaagcactggaagagagtggagcattgttagaaagtgggacatatgatggaaacttctatggaactcccaagcctccagcagaacccagcccttttcagccagatccagttgatcaagtcctctttgataatgagtttgatgcagaatctcaaagaaaacgaacgacatctgtcagcaagatggaaagaatggatagctctcttcctgaagaggaagaagatgaggacaaggaagctattaatggcagtggaaacgcagaaaacagagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgaccacaataccaagacaaccacctggttggatcctcgtctttgtaagaaagccaaagcccctgaagactgtgaagatggagagcttccttatggctgggagaaaatagaggaccctcagtatgggacatactatgttgatcaccttaaccagaaaacccagtttgaaaatccagtggaggaagccaaaaggaaaaagcagttaggacaggttgaaattgggtcttcaaaaccagatatggaaaaatcacacttcacaagagatccatcccagcttaaaggtgtccttgttcgagcatcactgaaaaaaagcacaatgggatttggttttactattattggtggagatagacctgatgagttcctacaagtgaaaaatgtgctgaaagatggtcccgcagctcaggatgggaaaattgcaccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaagggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtcctccttcaccaaccaaaactgccaaaatgaaaacagataaaaaggaaaatgcaggaagtttggaggccataaatgagcctattcctcagcctatgccttttccaccgagcattatcaggtcaggatccccaaaattggatccttctgaggtctacctgaaatctaagactttatatgaagataaaccaccaaacaccaaagatttggatgtttttcttcgaaaacaagagtcagggtttggcttcagggtgctaggaggagatggacctgaccagtctatatatattggggctattattcccctgggagcagctgagaaagatggtcggctccgcgcagctgatgaactaatgtgcattgatggaattcctgttaaagggaaatcacacaaacaagtcttggacctcatgacaactgctgctcgaaatggccatgtgttactaactgtcagacggaagatcttctatggagaaaaacaacccgaggacgacagctctcaggccttcatttcaacacagaatggatctccccgcctgaaccgggcagaggtcccagccaggcctgcaccccaggagccctatgatgttgtcttgcaacgaaaagaaaatgaaggatttggctttgtcatcctcacctccaaaaacaaaccacctccaggagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaagagcatcatggtccaccatcaggaacaaactcagccaggcaaagcccagccctgcagcacaggcccatgggacagtcacaggccaaccacatacctggggacagaagtgccctagaaggtgaaattggaaaagatgtctccacttcttacagacattcttggtcagaccacaagcaccttgcacagcctgacaccgcagtaatttcagttgtaggcagtcggcacaatcagaaccttggttgttatccagtagagctggagagaggcccccggggctttggattcagcctccgaggggggaaggagtacaacatggggctgttcatccttcgtcttgctgaagatggtcctgccatcaaagatggcagaattcatgttggtgaccagattgttgaaatcaatggggaacctacacaaggaatcacacatactcgagcaattgagctcattcaggctggtggaaataaagttcttcttcttttgaggccaggaactggcttgatacctgaccatggtttggctccttccggtctgtgctcctacgtgaaacccgagcaacattaaggctttcagggcttttcttggtctttccttaaaaagacttggtaaatttgcatgtcttgtaaatcactttcttcttttgttttcttttaaattaaaaatgatgctattaaatacatctatttctatcttctgcacttttcagtcttcttttgacattaaatttgacagcttaa

SEQ ID NO: 4898 - DNA, 6508 bp, Homo sapiens
gggccggagcggcgccccggccgcccgcgcggggtctcccccatggtgcagcggggttcgggatgtcgaagacgctgaagaagaagaagcactggctcagcaaggtgcaggagtgcgccgtgtcctgggccgggcccccgggcgacttcggcgcggagatccgcggtggcgcggagcgtggcgagttcccctacctggggcggctccgcgaggagcccggcgggggcacctgctgcgtcgtctcgggcaaggcgcccagcccaggcgatgtgctgctggaggtaaacgggacgcctgtcagcgggctcaccaaccgggacaccctggctgtcatccgccacttccgcgagcccatccgtctcaagactgtgaaaccaggcaaagtcattaataaagatttgcggcattacctaagtcttcagtttcaaaaaggatcaattgaccacaaactgcagcaagtgatcagagataatctctacttgagaaccattccatgcactacaagggcccccagggatggagaagtaccaggagtggattataatttcatttccgttgaacagttcaaagcactggaagagagtggagcattgttagaaagtgggacatatgatggaaacttctatggaactcccaagcctccagcagaacccagcccttttcagccagatccagttgatcaagtcctctttgataatgagtttgatgcagaatctcaaagaaaacgaacgacatctgtcagcaagatggaaagaatggatagctctcttcctgaagaggaagaagatgaggacaaggaagctattaatggcagtggaaacgcagaaaacagagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgaccacaataccaagacaaccacctggttggatcctcgtctttgtaagaaagccaaagcccctgaagactgtgaagatggagagcttccttatggctgggagaaaatagaggaccctcagtatgggacatactatgttgatcaccttaaccagaaaacccagtttgaaaatccagtggaggaagccaaaaggaaaaagcagttaggacaggttgaaattgggtcttcaaaaccagatatggaaaaatcacacttcacaagagatccatcccagcttaaaggtgtccttgttcgagcatcactgaaaaaaagcacaatgggatttggttttactattattggtggagatagacctgatgagttcctacaagtgaaaaatgtgctgaaagatggtcccgcagctcaggatgggaaaattgcaccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaagggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtcctccttcaccaaccaaaactgccaaaatgaaaacagataaaaaggaaaatgcaggaagtttggaggccataaatgagcctattcctcagcctatgccttttccaccgagcattatcaggtcaggatccccaaaattggatccttctgaggtctacctgaaatctaagactttatatgaagataaaccaccaaacaccaaagatttggatgtttttcttcgaaaacaagagtcagggtttggcttcagggtgctaggaggagatggacctgaccagtctatatatattggggctattattcccctgggagcagctgagaaagatggtcggctccgcgcagctgatgaactaatgtgcattgatggaattcctgttaaagggaaatcacacaaacaagtcttggacctcatgacaactgctgctcgaaatggccatgtgttactaactgtcagacggaagatcttctatggagaaaaacaacccgaggacgacagctctcaggccttcatttcaacacagaatggatctccccgcctgaaccgggcagaggtcccagccaggcctgcaccccaggagccctatgatgttgtcttgcaacgaaaagaaaatgaaggatttggctttgtcatcctcacctccaaaaacaaaccacctccaggagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaagagcatcatggtccaccatcaggaacaaactcagccaggcaaagcccagccctgcagcacaggcccatgggacagtcacaggccaaccacatacctggggacagaagtgccctagaaggtgaaattggaaaagatgtctccacttcttacagacattcttggtcagaccacaagcaccttgcacagcctgacaccgcagtaatttcagttgtaggcagtcggcacaatcagaaccttggttgttatccagtagagctggagagaggcccccggggctttggattcagcctccgaggggggaaggagtacaacatggggctgttcatccttcgtcttgctgaagatggtcctgccatcaaagatggcagaattcatgttggtgaccagattgttgaaatcaatggggaacctacacaaggaatcacacatactcgagcaattgagctcattcaggctggtggaaataaagttcttcttcttttgaggccaggaactggcttgatacctgaccatggtttggctccttccggtctgtgctcctacgtgaaacccgagcaacattaaggctttcagggcttttcttggtctttccttaaaaagacttggtgattgggatattaataatccttcgtcttcaaatgtgatttatgatgaacagtcaccattacccccatcttcacattttgcttccatatttgaagagtctcacgtgccagtaattgaagaatctttgagagttcagatatgtgaaaaggcagaagaattaaaggacattgtgcctgaaaagaaaagcactttaaatgaaaatcagcctgagataaagcatcagtctcttctccagaaaaatgtgagtaagagggatccacccagcagtcatgggcacagtaacaagaaaaatctattaaaagtagaaaatggtgttacacgaagaggtagatcggttagtcccaaaaagccagccagtcaacattcagaggaacatttggataagattcctagtcctctaaaaaataaccccaaaagaagacccagagatcaatccctcagccccagcaaaggggaaaataaaagttgtcaggtcagcaccagggcaggctctggacaagatcagtgcagaaaaagcagaggtcggtcggccagcccaaaaaagcagcaaaaaattgaaggaagcaaagctccatcaaatgctgaggccaaattattagagggtaagagtcgaagaatagcaggctatacgggcagtaatgctgagcagatcccagatgggaaggaaaaatcagacgtcatcaggaaagatgcaaagcagaatcagttggaaaaaagcagaacaaggtctccagagaaaaaaatcaaaagaatggttgagaaatctcttccatccaaaatgactaataagactacaagtaaagaagtatctgaaaatgaaaaaggaaagaaagtaaccacaggagaaacaagttctagtaacgataaaataggagaaaatgtccagctatcagaaaagaggctgaagcaagaacctgaagagaaggtagtttcaaacaaaacagaagatcacaaagggaaagaactagaggcagctgacaaaaacaaagagactggaaggttcaaaccggaaagcagttctccagttaagaaaacactgataactccagggccctggaaggttccaagtggaaataaagtcacaggcactattggtatggctgagaaacggcagtaacctttagtataaaacaaagaaaaacaagttgtaatcttttcttacagcagcatttttccagaaaaagcctttttttttttttcagatattctgaaacagataagtacatgttaatgtgagcctcaagttacctaggctgcatgaagggcctttaggattgctaagaaccaactgtccccctggccggctgccctccctcgctctcaggaaggagctgcatccacatgctcatctgacccgccctgctcaggctgcccagctcgtcttcatgagtgtctgaacaaatgacatatgttgatattaacaatgtggtcacaactcactttgtatttgtgccaagttatctactgtatcatgtctgtttttatcctttttgttcagctgtttccacagtaatgaaaaagttaggtttggcttggaagttgatgatctcaatagcatgttgcatgtttacagagagaaatatgtgagtccttgcagaagaagagactgttaactcatcgttaaagatggccgttgtctcttctaacagctactgatgatgtcccactttaaaaataaaacccccaaacatcactactttaaggaaaaaaaaaatgtagtccaatattgatgctttcttatggctttttattttaatttggctggataagttgtttcaaataactgttaaagatattacttacaattgaatgtttgaaataagaaagtactttaagcaatagagttcatctcctgctgtgttatccaacctcgatgtatacttacagcatctcaggtcaccctttttatttcagttatttaattatgaaaccataaagaagcatgtggaaatagtgtttattgctctttgaagaaaaaccaccaactatttctggatattttggctgtacctactactaaagtcattagtctttaatacataatacatatttgaaaagtaaacatattatatagattatgtgagggacttaatcatgaaaccagtttcacagtccaagtaccaactcttctggtagcaggtgcacaagcttgggtgtttaaaaacaacctgtgtagggtatgcccagcaaatgaggacaaatgtgtagacagtacttactggatcttatttaacttttagctacattaactaactttcttatttaaaaacaagaaagggagactaaacatctgcttaacttgtacacattttcagaattctttttaaaagtctagttaaagatgtttcttagaagttggagactgttaacaacttccataaaatagatccaggtttttcagttccctgaagcagcattcagtagcatctatataaataaaggcaccttctgagaataaaactattttatggagtgtgtgaacacacttgttctgtcacctgggttcatcttgttgtgaagcacattaggtccaggtccttccctctgggagtctgactgtgaaactctttaacccaacaactcaattagcccctgtagataagacatgcttcccagagtgagatttttgaaatccccttttcatccagaactatatttacccacctattgtaactattcaaatagagcaaaattaggaggcttgataaatactaagaatttagtaccacagaaattatttattattttccctgtagtccacaattagtgataacgaatcctatttttgttaactgtgacataactttgatgtcatatgttgtcctatgtggttcttcctaagtaaactctgtactgattatatactgacttagcaatgtggccttggaatgctgagcaaaatgtggatgtactggttgtaaatgtttatatattgtacagtacctttatatatacacttgaggttctgattagagaaagatctgtaaattgctcattattttttatatagatatttaaaaaaaaca

SEQ ID NO: 4899 - DNA, 2267 bp, Homo sapiens
gatcaaagatgctggtgtcaccgtcacactaacggtcattgctgaagaagagcatcatggtccaccatcaggaacaaactcagccaggcaaagcccagccctgcagcacaggcccatgggacagtcacaggccaaccacatacctggggacagaagtgccctagaaggtgaaattggaaaagatgtctccacttcttacagacattcttggtcagaccacaagcaccttgcacagcctgacaccgcagtaatttcagttgtaggcagtcggcacaatcagaaccttggttgttatccagtagagctggagagaggcccccggggctttggattcagcctccgaggggggaaggagtacaacatggggctgttcatccttcgtcttgctgaagatggtcctgccatcaaagatggcagaattcatgttggtgaccagattgttgaaatcaatggggaacctacacaaggaatcacacatactcgagcaattgagctcattcaggctggtggaaataaagttcttcttcttttgaggccaggaactggcttgatacctgaccatggtgattgggatattaataatccttcgtcttcaaatgtgatttatgatgaacagtcaccattacccccatcttcacattttgcttccatatttgaagagtctcacgtgccagtaattgaagaatctttgagagttcagatatgtgaaaaggcagaagaattaaaggacattgtgcctgaaaagaaaagcactttaaatgaaaatcagcctgagataaagcatcagtctcttctccagaaaaatgtgagtaagagggatccacccagcagtcatgggcacagtaacaagaaaaatctattaaaagtagaaaatggtgttacacgaagaggtagatcggttagtcccaaaaagccagccagtcaacattcagaggaacatttggataagattcctagtcctctaaaaaataaccccaaaagaagacccagagatcaatccctcagccccagcaaaggggaaaataaaagttgtcaggtcagcaccagggcaggctctggacaagatcagtgcagaaaaagcagaggtcggtcggccagcccaaaaaagcagcaaaaaattgaaggaagcaaagctccatcaaatgctgaggccaaattattagagggtaagagtcgaagaatagcaggctatacgggcagtaatgctgagcagatcccagatgggaaggaaaaatcagacgtcatcaggaaagatgcaaagcagaatcagttggaaaaagcagaacaaggtctccagagaaaaaaatcaaaagaatggttgagaaatctcttccatccaaaatgactaataagactacaagtaaagaagtatctgaaaatgaaaaaggaaagaaagtaaccacaggagaaacaagttctagtaacgataaaataggagaaaatgtccagctatcagaaaagaggctgaagcaagaacctgaagagaaggtagtttcaaacaaaacagaagatcacaaagggaaagaactagaggcagctgacaaaaacaaagagactggaaggttcaaaccggaaagcagttctccagttaagaaaacactgataactccagggccctggaaggttccaagtggaaataaagtcacaggcactattggtatggctgagaaacggcagtaacctttagtataaaacaaagaaaaacaagttgtaatcttttcttacagcagcatttttccagaaaaagcctttttttttttttcagatattctgaaacagataagtacatgttaatgtgagcctcaagttacctaggctgcatgaagggcctttaggattgctaagaaccaactgtccccctggccggctgccctccctcgctctcaggaaggagctgcatccacatgctcatctgacccgccctgctcaggctgcccagctcgtcttcatgagtgtctgaacaaatgacatatgttgatattaacaatgtggtcacaactcactttgtatttgtgccaagttatctactgtatcatgtctgtttttatcctttttgttcagctgtttccacagtaatgaaaaagttaggtttggcttggaagttgatgatctcaatagcatgttgcatgtttacagagagaaatatgtgagtccttgcagaagaagagactgttaactcatcgttaaagatggccgttgtctcttctaacagctactgatgatgtcccactttaaaaataaaacccccaaacatcactactttaagg

SEQ ID NO: 4900 - DNA, 2392 bp, Homo sapiens
taaggactcgactacctccgaagaaagccgaaacatgtggctccgcccacactggcctcagctctccgttctcgactattgccgaagtgagccgaagtttgtggccccgcttccggagaactcaagctcccgattgtgcccgaaggaacccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcaggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccagagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaaggc

SEQ ID NO: 4901 - DNA, 2471 bp, Homo sapiens
taaggactcgactacctccgaagaaagccgaaacatgtggctccgcccacactggcctcagctctccgttctcgactattgccgaagtgagccgaagtttgtggccccgcttccggagaactcaagctcccgattgtgcccgaaggaacccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccagagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaaggc

SEQ ID NO: 4902 - DNA, 2392 bp, Homo sapiens; identical to SEQ ID NO: 4900

SEQ ID NO: 4903 - DNA, 2392 bp, Homo sapiens; identical to SEQ ID NO: 4900

SEQ ID NO: 4904 - DNA, 2471 bp, Homo sapiens; identical to SEQ ID NO: 4901

SEQ ID NO: 4905 - DNA, 2471 bp, Homo sapiens; identical to SEQ ID NO: 4901

SEQ ID NO: 4906 - DNA, 2392 bp, Homo sapiens; identical to SEQ ID NO: 4900

SEQ ID NO: 4907 - DNA, 2471 bp, Homo sapiens; identical to SEQ ID NO: 4901

SEQ ID NO: 4908 - DNA, 2392 bp, Homo sapiens; identical to SEQ ID NO: 4900

SEQ ID NO: 4909 - DNA, 2471 bp, Homo sapiens; identical to SEQ ID NO: 4901

SEQ ID NO: 4910 - DNA, 2392 bp, Homo sapiens; identical to SEQ ID NO: 4900

SEQ ID NO: 4911 - DNA, 2471 bp, Homo sapiens; identical to SEQ ID NO: 4901

SEQ ID NO: 4912 - DNA, 1848 bp, Homo sapiens
atggtaggtatagggctgtggatatcgtcagtttgaccaagtattccaagaggccccatggagtttgtcatctgtaatagaggacgttagtgcattagtgatgaaaaaactgcttaccactgactattgtgatctcccagggagtataaggcagctccgcacttgaaatccatggcccaaaatgactctaccagtggagactctcttctgtgaagaagacgaccagataagaggttgggatgagcatgccactgcatcagatctctgccattccatcccaggatgccatctctgctagagtctacagaagtaagaccaaagaaaaggagagggaagaacagaatgagaagactttgggacatttcatgagtcattcaagcaacatttctaaggctgggagtcctccgtcagcatcagctccggctccggtgtcctccttctctcgcacttctatcacgccatccagccaggacatctgcaggatctgccactgtgaaggagatgatgagagccccctgatcaccccctgccactgcacaggaagcctccacttcgtgcaccaggcctgcctgcagcagtggatcaagagctccgacacgcgctgctgcgagctctgcaagtatgagttcatcatggagaccaagctgaagccactgagaaaatgggagaagttgcagatgacgtccagcgagcgcaggaagatcatgtgctcagtgacattccacgtcattgccatcacatgtgtggtctggtccttgtatgtgctcattgaccgtactgctgaggagatcaagcaggggcaggcaacaggaatcctagaatggcccttttggactaaattggtggttgtggccatcggcttcaccggaggacttctttttatgtatgttcagtgtaaagtgtatgtgcaattgtggaagagactcaaggcctataatagagtgatctatgttcaaaactgtccagaaacaagcaaaaagaatatttttgaaaaatctccactaacagagcccaactttgaaaataaacatggatatggaatctgtcattccgacacaaactcttcttgttgcacagagcctgaagacactggagcagaaatcattcacgtctgattgtgtgcgggttgtcattttcctggacatccatgaagagctgaaggaaattgtttactgccaattgtatacctttcttatgtcctttaatagcatagactggacaggtgactatttatagtggcttctctttttctaaaccctccttagtctcctagaaaaccttcctgtgggccaggcatgcctgggtcctgcctctgcctggcagctctgtgggaaagtggaagaccccatgatgacatcatggggagccagcagagttcctgcccatggtcttgagctgaatgagagaataaaatgccaatcccaagggaagaggaggagcaggggtgcccaggccctgatacccagccgcctccagcttgcagtggtccccagcctggagcagagcattggggagtgtctagccatgacgagaagattccctctgcatcacggcgaaccccaggagatggtattgaaacagacccccaaacacagactcctgcctgccctctgccgatgctgcctcctccatgctcttgagcaggtggagccatggtgctctgtggtggcgcatgattcactgagcaaacagcactttacagaagaaaatctttattttgtaatatgtgtgtccagcgggattgacactcaaaaaaagtctcacttagaaatcttcccttccttacctttgtatctcctttacatcatgagagatcaaaaatccattttgccttacatatgctaagaa

SEQ ID NO: 4913 - DNA, 3048 bp, Homo sapiens
ggccgaggcggcggcggcggcgagcccgggggcgaggcgcggacgggaacaggaaaagcctccggcagcccctgcgggcggcggcgcagccacggccgcgctccgaggtgaagccgcgcgcggagaggaagcgggtgttttcccctctgcctttcggcccccgcccttcctttcagtttctgcccgctcgctcggaagttggcggttgacaaaaatggcaggagccggggcccgggccggttgccgcagcgccgcggggaccttctgagttggcccggtggcagggagactcgtgcaggggcgtccgatgcgcggggcccggggcctcgggagagctcagctgctgcgggccccagacgaggcgacagggatggacttgcgtagacagccagcgccgggccgccgggcgcgcggtctgggagggcgtgccgccgcggcgccgggccgcgctctgtgaaccggcgaggcgggaaggggccgccgtggtgctcggcacgcccgggcgtgtggcgggcgggcgagagcttgagcgcgatccgggcggccgctgtgcgcaatcagtgcaggctcccgcccgactctgactcggcgcggccgcgacagtgccggccacaccctctgccccgctgccgccggcgccgcttcccaagagctggaggcaggagatgcgcccggggcggccgcgcgtcccagagagccagccccggccgccgtcgcggggaagtgccgcctggtggggtcacggcgcctgaagcccacgtgcgccgccgagcccgaggtggcctcgagcgcggcggctgacagcacagcccgcctgagctgcctcccgcgctcctccccgaggaaaggattttgatttcaaagaaaggaaggaaggaaggacaactcccagcttccccgtcccgccctccccgctccgagggccgcgccaggccatgcccaagaaggcggcggcggcggcgaaccagcagaagggactttcctggcagcccggcgacgaggagcgcggacagtgagtttgctctgccccggttcatggttcctgcaagccctctaggaggccgaaagctgcagcccctccccttgccccgaagagccttccgcgttctctcgccctcgggcccaccccgcgccgcccgggctcccgccgccgcagcccagtgccctctgcccgcggcggtggatggcatgatggtgcggggaaggcaccgcggccttggccagctgagtcgcgacggccgccggggcggcggcagtggccgcggcagcggcggtggtagcgggctccccagcggcatgccagtgccccccgggcgcgatggctagcggcagcgccgggaagcccactggcgaggcggcttctccggctcctgcgagcgccatcggcggggccagctcgcagccgcggaagaggctggtatccgtctgcgaccactgcaagggcaagatgcagctggtggctgacctgctgctgctgtcgagcgaggcgcggcccgtgctcttcgagggccccgcctcctctggtgccggcgccgagtccttcgagcagtgccgggacaccatcatcgcgcgcaccaaggggctctccatcctcacccacgacgtgcagagccagctcaacatgggccgcttcggggaggcgggggacagcctggtggagctgggcgacctggtggtgtcgctgaccgagtgctcggcccacgcggcctatctggccgctgtggccacgccgggcgcccagcccgcgcagccgggcctggtggaccgctaccgcgtgacgcgatgccgccacgaggtggagcagggttgcgccgtgctgcgcgccacgccgctggccgacatgacgccgcagctgctgctggaggtgtcgcagggcctgtcgcgcaacctcaagttcctgacggacgcgtgcgccctggccagtgacaagtcacgggaccgcttttcgcgggagcagttcaagctgggcgtcaagtgcatgagcaccagcgcgtcggcgctgctggcctgcgtgcgcgaggtgaaggtggcgcccagtgagctggcgcgcagccgctgtgcgctcttcagcgggcccctggtgcaggcagtgagcgccctggtaggcttcgccaccgagccgcagttcctgggtcgcgcggcagctgtgagcgccgagggcaaggcggtgcagaccgccatcctgggcggcgccatgagcgtggtgtcggcctgcgtgctcctgacccagtgcctcagggatctggcgcagcaccccgacgggggcgccaagatgtcggaccacagggagaggctgaggaactcggcctgcgccgtgtctgaaggctgcaccctgctatctcaggctttaagggagaggtcttcgcccaggactttaccgccagtgaattccaattctgtgaattagcaccccacccccataccccttcttccacccccagactaaaggaagatacttactctctgcccctctccatttataccaaagaaatcataggtgaaaccccctaccctccccaacgttaaatgctcgagaggaatcttccacaaggcagggccatgcacgcaacctgcacacgcacttggagggcccaggtgtctctccaccagcccccatgcagtagggactggaagatatgtcatctgctggttgtgttatcactcccaccccctaccccagcccgtcttccggaatttctcaactaaatttcattattgggcaggaaggaggtcatgggttcatttcatttttgttttttgtgtttttaattaaaagaaaggttacctcagttttcactccttagacatggatgtagctacctttttttgtatgtcttttttttttttaagcaatcgtgttgaattaggagtatacttggtgtggaaagagtatgaatttgccatgtgatttgcaaatggggggaagctactgtgagcgtgtgtttttttaatttacactatagagtgatttttttttcccccaacgtcaagtttttaccttgcatgtactggagtatttatttcatctattaaaatgttatgtttctc

SEQ ID NO: 4914 - DNA, 2158 bp, Homo sapiens
ccgaaacatggagtcctgtaggcaaggtcttacctgaatcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatgtgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagacttttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacatttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 4915 - DNA, 2367 bp, Homo sapiens
cgctgctgtggccaggcgtctggcatgctgaccacgtcgcgctgctgtaaaggaaacctgccccgcgcagcggcggtggctggagcgggagaaaccggactttgtgcaactttggccatagtggccatcccatgaatctgtttactagcttggtggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatgtgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagacttttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacatttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtg

SEQ ID NO: 4916 - DNA, 2180 bp, Homo sapiens
ccgaaacatggagtcctgtaggcaaggtcttacctgaatcagtgggtctctgcttttcctacaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatgtgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagacttttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacatttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 4917 - DNA, 2409 bp, Homo sapiens
agcacatgctgggctcgggggcgatgggcttgtgcgcggacctggcgacgctctagccccgagccgcgtattcgtggccgggtcctccctgggaacagggtgaaggccgagaacctctggcctcaggaagcgcatgcgcaaccggttctccgaaacatggagtcctgtaggcaaggtcttacctgaatcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatgtgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagacttttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacatttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 4918 - DNA, 1499 bp, Homo sapiens
agatactcgggacgctgaggcgggaggatcacatgagcccaggaggttgaggctgcagtgaggtatgatcgcgccactgcactcctgcctgggcaactgagcatgaaccctcctcaaagctaatggcgcttcaaaattctgcagtgcaaagaagttgctggggttgcggagcggagaaccgccaggaggctggagcccagccaggcagcctcctcgggcacacggtgaaggcgccggaactacagctacctccgcggcgccgcttcggccgccatatctgggtacacgggaaccgcagaggacaaactctcacccgcgttttcgatttctgcgctttcttcgagtgaggcaagacctagcagaggcccaagcccgtccctccctgccaggagcagcctcatgcggaccgagccgctgtgcggggcatcccctctgctggtgcccggcgacccctactctgtggtggttctgctgcagggctacgcggagccagagggtgtgggcgatgccgtgcgcgccgacggctccgtgaccctggtcctaccccagacccggggcccggcctccagccaccgagagtccccgcgcgggagtggcggcgcagaggccgccctggaggaggcggcccgtggccccatcctggtggacaccgggggcccctgggctcgggaggcgctgctgggggcgctggcggggcagggcgtggccccgggagacgtgacgctagtggtggggacccacgggcactcggatcacatcgggaacttggggctgttcccaggcgcggctctgctggtctcgcacgacttctgccttcccggaggccgctacctgccccacgggctgggtgaggggcagcccctgcgcctgggcccggggctcgaggtgtgggccacgccgggccacgggggccagcgcgacgtgagcgtggtggtggccggcacggctctgggcaccgtggtggtggcgggagatgtgtttgagcgagatggggacgaggattcgtggcaggcactgagtgaagaccccgcagcccaggagcggagccggaagagggtcctggtcgttgccgacgtggtcgtacctggtcacgggcccccctttcgagtgttaagggaagcctcgcagcccgagacggagggtggagggaacagccagcaggagccggtggtcggagacgaggagcccgccctgcactaatcagcctcgagagggactgcactcttgtcagggaagccctaacagcgaagagctgctggagacagagtcagagcagtcaagggtgggagcttccagcccttccaggaggccagttttctagtgaagacagagtgcacctgacactgccatcacatcgtcagtatcactgcctgtctctgccaccaaactaagatcaaaggaggggctcagctccctgtgcattctccctgggcctcagtaaaatgggagaaggttcgtgggaggggcctccaaaataaaaatggaaactgcattgaaaa

SEQ ID NO: 4919 - DNA, 718 bp, Homo sapiens
ggcaactgagcatgaaccctcctcaaagctaatggcgcttcaaaattctgcagtgcaaagaagttgctggggttgcggagcggagaaccgccaggaggctggagcccagccaggcagcctcctcgggcacacggtgaaggcgccggaactacagctacctccgcggcgccgcttcggccgccatatctgggtacacgggaaccgcagaggacaaactctcacccgcgttttcgatttctgcgctttcttcgagtgaggcaagacctagcagaggcccaaggtagagcgcggctaggattcgatggagggaaacataaaggatagcctttggagggtgacgggcaaggaccccgtccctccctgccaggagcagcctcatgcggaccgagccgctgtgcggggcatcccctctgctggtgcccggcgacccctactctgtggtggttctgctgcagggctacgcggagccagagggtgtgggcgatgccgtgcgcgccgacggctccgtgaccctggtcctaccccagacccggggcccggcctccagccaccgagagtccccgcgcgggagtggcggcgcagaggccgccctggaggaggcggcccgtggccccatcctggtggacaccgggggcccctgggctcgggaggcgctgctgggggcgctggcggggcagggcgtggccccgggagacgtgacgctagtggtggggaccca

SEQ ID NO: 4920 - DNA, 4280 bp, Homo sapiens
caacccgcgaggccccacactttctgcgccagctgggagtgcgcgccctgcagagccagtgggtgggcggttctagctcttcccaccctcactgcgggcctctgctgtcacacgcccggggtggcgaaacggtcgccacctgagtctccattctgctgcagtggcccctgcgttaaagctctctcgtggtgcggctgccgaggctgcggtagctcctgcgcccccgtgctggtggcgcagcctctgcttgctgccgacctggcggaagggtgcgggagcgcacgctacgggcagcgtcggtctgcgtccttcctcctcctattccgacccccgcatcccacgcccccgcctcgctctacgcctcctccctggctgcaggcagaccgcttcacacagccgcagtgccctgtgtgtggacagcctgtgggagactcgcacgcccacactcaccccgcctggctgcacccctgcccagcatgtcggcgctcgagtggtacgcccacaagtctctaggcgatggtatcttctggattcaagaacgtttctacgagtcgggcaaccgtgccaacatctggctggtgcgcggctccgagcaggacgtggtgatcgatacaggcctggggctgcgcagcctcccggagtacctgtactcctccggcctcttgcaggaccgagaggccaaagaggacgcggcgcgccggccactgcttgccgtggccacccacgtgcacttcgaccactccggcggcctctaccagttcgaccgcgtggcagtgcaccacgccgaggccgaggcgctggctcgcggggacaactttgagaccgtgacctggctttccgatagcgaggtggtgcggacgcccagccccggctggagggccagacagttccgggtacaggcggtgcagcccaccctcatcctgcaggatggggatgtgatcaaccttggtgacagacagctcactgttatgcacatgccaggtcactccaggggcagtatttgcttacatgacaaagaccgaaagattctcttcagtggagacgtcgtgtatgatggatcactgattgactggctcccatacagcaggataagtgactatgttggaacttgtgaacgtctaatagaattagtggacagaggtctggtagagaaggtgcttcctgggcacttcaatacctttggtgctgaaaggctttttcgattggcttctaactatatttcaaaagctgggatatgtcacaaagtttctacttttgccatgcgatctcttgcaagtttagctctacgtgtaacaaattctaggacctcgccctagtatctatactgataatatattttgattaattatatacattaattcattctgtgctatttaactgattaatagtgagcatttcatgaagtgcttttataccactattatatatcagagaaagattgagaatgaataagccaaaaagaaaattgttagtttaaattgttttctttcttccaagaaagaagccacttaaataagcttatactttgccaaagctgtcatcttgtaatatatgctctagaaatgacataaaggtttatggggaagcaaagagagattttgtggcaagagaactgcccttgcctctgtttttcttgttttattcccttgatgacctagggaaaaaaaggcatgtagagtattatgtttatactttaaacttgatatttttagtgtattatttaaagataaaggttcttgggtttaaaatacattagaacttaatgcagacatataaagtaacattgagaatgacaactaaaacattccattgttatggtcctgaattttttatgcttcatttcatgtatttattctttgtataattatagcatacatgttatgtaatataacttatgaaaagtacagtgaattttgctttattgcaaagctttaaatataaatttcagagtgcttcagtaaaaagctactatatattgttgtttgttattgtgtaggtaatattttcaattatgaaagtgaaatgcaaatgtctgttatctaactacaaattgtcagatttcttaaaaggacactgtcaggcaaatttgaaaatatacacattgagaataattttttattattatatcctattttaatattaacagctattatgaacaaaatttttcctgttaaatagcgacttcagtattgtgttatgttttacagcgttaaaacaactatgaagatctgcagctattcttttacttaacatgcatatgtactacagagggatttttaaattaattgcaaaatgtgcattagctattgacttagagtgaattgccttttgtatcctgattcacaacacctattcctgttcagtattctttgtcttgaatagagaagtctatgttcgtaaagtcatataaaaggttataccactatttagtaaaaagttttagtttggtgctgttaataataatttgctaaaaggccttttagaatatttcataaagggttttaaacagttttttcccactgcctttttattattgacatatctaaaaccaaactgaaatcgctttggaaatcagattttttaatgttaggaagatccagcaattttggtttctgaaaaattacaaaacttttctaccctacagatgcccaggttctttagttttttattcattcaactcacacacacataaacatatacatacacaaacacaatcccacatgcaaacacacacagccacatatatacatgtgtagcacagcgctaaacactgtggaggctaaaaaaagtcaaagacaacattataactaaaagtcgaaagcacacaaaatataaataatagtgtatgcaagttaatgtacattatacatgcgtgtaagggacataaatggaggggtgtgaactttggttaggcaaagtttactggaggaggggtttttgagtcaaatttggaaggatgaacttgttagatagtcagagttggaaacaaaacaatccaagaatagggatataagcattgctagtctagaatagtctattccttgtgaaaatataaatttaattttcaggaatccagtatattccaaacatcacatatttagcatgagaaaaattgatttgtgattgtgtatatgagtcattgttaatgggagacaagctgaactgccacatgccaccaaatgaacctttacttcaatcaaaaaggagggtatgattggttcaattatattaacagaatatcatgggcatttctctatgatggtcattcaaggtagtaggtctctttcaactgagtgcaacattgagaataatgatttggttcagggcaactacaaataatcacttactaagccttaaataaagccattatttttatatcaatagcacaaaggaaaaccaaaagtccttaaccactgaccatttttatcatattttaggcctttttttaaaaaatcagggtatagtaggcactaagttttattaggaaatatttaaacctgctgaaggatttatttataaaaagtgcaatttttcaaaacacattattattttttaatttcccaattttttcagtttttcaaattgtaccacaacatagaactgtgatattttgctattacttcaatgtgaataaataaggtaaagtatatcatttattgagtgcccatgctgtacatttaaaatatgcattatttaatttaatcttactcccagcaccaaaaggtaattgaccagcctcaacacaattttggacaaagctagtaactgaacacaggtctgtctgccccacacttctctttctcttgtaactgcacaatagcagaaaattggcaagatgtatttttactttccaagatgccgtgtgtgccaagaataaatgaaatgatgttaaagcataataataacatatctttaaaaagcttttcaaaatatattttcaccctgacagtgacccttgtaacttaaatgatttttggaaatattagtatgtaagtataattcaaagttgtcaaaatgtaagacatttagaagtaatttttattatttatattgttaatacttaatcactggaaattcattttccttactcgatgttttctttcaactgagaagcctaaaacaaacaaaaaccttgtgtgttatcctgatatagttgactaaatgtatttgttcttatatggatagtaatatgaatgtgacatgcaccaattgtcctattataattttcagataagtgtaactaagcacttgtgtaataaatattagtcattttatttcaa

SEQ ID NO: 4921 - DNA, 1936 bp, Homo sapiens
acacagccgcagtgccctgtgtgtggacagcctgtgggagactcgcacgcccacactcaccccgcctggctgcacccctgcccagcatgtcggcgctcgagtggtacgcccacaagtctctaggcgatggtatcttctggattcaagaacgtttctacgagtcgggcaaccgtgccaacatctggctggtgcgcggctccgagcaggacgtggtgatcgatacaggcctggggctgcgcagcctcccggagtacctgtactcctccggcctcttgcaggaccgagaggccaaagaggacgcggcgcgccggccactgcttgccgtggccacccacgtgcacttcgaccactccggcggcctctaccagttcgaccgcgtggcagtgcaccacgccgaggccgaggcgctggctcgcggggacaactttgagaccgtgacctggctttccgatagcgaggtggtgcggacgcccagccccggctggagggccagacagttccgggtacaggcggtgcagcccaccctcatcctgcaggatggtaatgggcccccgcgggcgcgcgctctcgttaagggagggtattgggaagagactgtccgagtgccgcatgttgcagacttgcgtggccataaaggggattattttggcacctcgcagagccacttctgtttcacccttccctgagtaaaaacccacttgaccagagtcaaggccatcacagccttccctgccagagaccagctctggcatcgtgtagagattctgagtactcctttgaaagccggcaccaccccctccctagccactttcctgcatcggctgtagcagtaacactacaaagacttgtgactgactagggatttctcattctttccctaagcacctgcccgacatttccaggagctttcgtagtgagcagacttttaaggaatgacccctcacggagagtgcatgtcatgatctgtgcttttgagaattgcagacttcatcagcttggtccccaccgggtatgggcagttcccacctgtagccttagagagtcatcagaccagtgattccaatccgctaatgcgattggaaacctttcagataggtttctgttcttgatgttgcctcacgattgcaaaagcttaatagtaatcataaacgtagaatatgtctgagtcttactttatgacagatatttggtccggttgaaagcaaagcctgagaaagatcaataaggaagtaattttcggtagaggtaaattatgtggactaatgcataggtagccatggtcctctttggctctgtgaaagacaagtatggaattcagagagaaattcatggaatgaaaataaatagggcctcagcccattctccctacgtagggacttaaataattgagctaattcgccacatcagcaatatttggtatattagttttctattttctttttaaaatacttttgatttcattttatcttcacaacacatttaaagtgaggccactgaccccccagttaaatggcttgcctgagccagatcatgataaaagctaggatatgaatctaggcacaatagatcaaggcatgcagaacatacataaatcctgcctcataaatatatgatgattttgagtagaatgtgaaaggccccttctttcctttagcgtgagatcattttaattaccaatgtggtatattaaaacgtgcctctatatggtagaaaaattcagttgctgcagtataatgaagctcactttatgaccaaacaatatggcaaataatgaaatattttacaaaaatcagtttatctcacagatgacatcttcatttgagatattttaaaaattgcaatattgtactgcttatcggtgctaaaaaaaaaattgcaagattctgtacctcacacccaccgaacaagtcttcattaaagttttaaatctaaattt

SEQ ID NO: 4922 - DNA, 3683 bp, Homo sapiens
agaccgcttcacacagccgcagtgccctgtgtgtggacagcctgtgggagactcgcacgcccacactcaccccgcctggctgcacccctgcccagcatggcggcgcgccggccactgcttgccgtggccacccacgtgcacttcgaccactccggcggcctctaccagttcgaccgcgtggcagtgcaccacgccgaggccgaggcgctggctcgcggggacaactttgagaccgtgacctggctttccgatagcgaggtggtgcggacgcccagccccggctggagggccagacagttccgggtacaggcggtgcagcccaccctcatcctgcaggatggggatgtgatcaaccttggtgacagacagctcactgttatgcacatgccaggtcactccaggggcagtatttgcttacatgacaaagaccgaaagattctcttcagtggagacgtcgtgtatgatggatcactgattgactggctcccatacagcaggataagtgactatgttggaacttgtgaacgtctaatagaattagtggacagaggtctggtagagaaggtgcttcctgggcacttcaatacctttggtgctgaaaggctttttcgattggcttctaactatatttcaaaagctgggatatgtcacaaagtttctacttttgccatgcgatctcttgcaagtttagctctacgtgtaacaaattctaggacctcgccctagtatctatactgataatatattttgattaattatatacattaattcattctgtgctatttaactgattaatagtgagcatttcatgaagtgcttttataccactattatatatcagagaaagattgagaatgaataagccaaaaagaaaattgttagtttaaattgttttctttcttccaagaaagaagccacttaaataagcttatactttgccaaagctgtcatcttgtaatatatgctctagaaatgacataaaggtttatggggaagcaaagagagattttgtggcaagagaactgcccttgcctctgtttttcttgttttattcccttgatgacctagggaaaaaaaggcatgtagagtattatgtttatactttaaacttgatatttttagtgtattatttaaagataaaggttcttgggtttaaaatacattagaacttaatgcagacatataaagtaacattgagaatgacaactaaaacattccattgttatggtcctgaattttttatgcttcatttcatgtatttattctttgtataattatagcatacatgttatgtaatataacttatgaaaagtacagtgaattttgctttattgcaaagctttaaatataaatttcagagtgcttcagtaaaaagctactatatattgttgtttgttattgtgtaggtaatattttcaattatgaaagtgaaatgcaaatgtctgttatctaactacaaattgtcagatttcttaaaaggacactgtcaggcaaatttgaaaatatacacattgagaataattttttattattatatcctattttaatattaacagctattatgaacaaaatttttcctgttaaatagcgacttcagtattgtgttatgttttacagcgttaaaacaactatgaagatctgcagctattcttttacttaacatgcatatgtactacagagggatttttaaattaattgcaaaatgtgcattagctattgacttagagtgaattgccttttgtatcctgattcacaacacctattcctgttcagtattctttgtcttgaatagagaagtctatgttcgtaaagtcatataaaaggttataccactatttagtaaaaagttttagtttggtgctgttaataataatttgctaaaaggccttttagaatatttcataaagggttttaaacagttttttcccactgcctttttattattgacatatctaaaaccaaactgaaatcgctttggaaatcagattttttaatgttaggaagatccagcaattttggtttctgaaaaattacaaaacttttctaccctacagatgcccaggttctttagttttttattcattcaactcacacacacataaacatatacatacacaaacacaatcccacatgcaaacacacacagccacatatatacatgtgtagcacagcgctaaacactgtggaggctaaaaaaagtcaaagacaacattataactaaaagtcgaaagcacacaaaatataaataatagtgtatgcaagttaatgtacattatacatgcgtgtaagggacataaatggaggggtgtgaactttggttaggcaaagtttactggaggaggggtttttgagtcaaatttggaaggatgaacttgttagatagtcagagttggaaacaaaacaatccaagaatagggatataagcattgctagtctagaatagtctattccttgtgaaaatataaatttaattttcaggaatccagtatattccaaacatcacatatttagcatgagaaaaattgatttgtgattgtgtatatgagtcattgttaatgggagacaagctgaactgccacatgccaccaaatgaacctttacttcaatcaaaaaggagggtatgattggttcaattatattaacagaatatcatgggcatttctctatgatggtcattcaaggtagtaggtctctttcaactgagtgcaacattgagaataatgatttggttcagggcaactacaaataatcacttactaagccttaaataaagccattatttttatatcaatagcacaaaggaaaaccaaaagtccttaaccactgaccatttttatcatattttaggcctttttttaaaaaatcagggtatagtaggcactaagttttattaggaaatatttaaacctgctgaaggatttatttataaaaagtgcaatttttcaaaacacattattattttttaatttcccaattttttcagtttttcaaattgtaccacaacatagaactgtgatattttgctattacttcaatgtgaataaataaggtaaagtatatcatttattgagtgcccatgctgtacatttaaaatatgcattatttaatttaatcttactcccagcaccaaaaggtaattgaccagcctcaacacaattttggacaaagctagtaactgaacacaggtctgtctgccccacacttctctttctcttgtaactgcacaatagcagaaaattggcaagatgtatttttactttccaagatgccgtgtgtgccaagaataaatgaaatgatgttaaagcataataataacatatctttaaaaagcttttcaaaatatattttcaccctgacagtgacccttgtaacttaaatgatttttggaaatattagtatgtaagtataattcaaagttgtcaaaatgtaagacatttagaagtaatttttattatttatattgttaatacttaatcactggaaattcattttccttactcgatgttttctttcaactgagaagcctaaaacaaacaaaaaccttgtgtgttatcctgatatagttgactaaatgtatttgttcttatatggatagtaatatgaatgtgacatgcaccaattgtcctattataattttcagataagtgtaactaagcacttgtgtaataaatattagtcatttt

SEQ ID NO: 4923 - DNA, 4278 bp, Homo sapiens
caacccgcgaggccccacactttctgcgccagctgggagtgcgcgccctgcagagccagtgggtgggcggttctagctcttcccaccctcactgcgggcctctgctgtcacacgcccggggtggcgaaacggtcgccacctgagtctccattctgctgcagtggcccctgcgttaaagctctctcgtggtgcggctgccgaggctgcggtagctcctgcgcccccgtgctggtggcgcagcctctgcttgctgccgacctggcggaagggtgcgggagcgcacgctacgggcagcgtcggtctgcgtccttcctcctcctattccgacccccgcatcccacgcccccgcctcgctctacgcctcctccctggctgcaggcagaccgcttcacacagccgcagtgccctgtgtgtggacagcctgtgggagactcgcacgcccacactcaccccgcctggctgcacccctgcccagcatgtcggcgctcgagtggtacgcccacaagtctctaggcgatggtatcttctggattcaagaacgtttctacgagtcgggcaaccgtgccaacatctggctggtgcgcggctccgagcaggacgtggtgatcgatacaggcctggggctgcgcagcctcccggagtacctgtactcctccggcctcttgcaggaccgagaggccaaagaggacgcggcgcgccggccactgcttgccgtggccacccacgtgcacttcgaccactccggcggcctctaccagttcgaccgcgtggcagtgcaccacgccgaggccgaggcgctggctcgcggggacaactttgagaccgtgacctggctttccgatagcgaggtggtgcggacgcccagccccggctggagggccagacagttccgggtacaggcggtgcagcccaccctcatcctgcaggatggggatgtgatcaaccttggtgacagacagctcactgttatgcacatgccaggtcactccaggggcagtatttgcttacatgacaaagaccgaaagattctcttcagtggagacgtcgtgtatgatggatcactgattgactggctcccatacagcaggataagtgactatgttggaacttgtgaacgtctaatagaattagtggacagaggtctggtagagaaggtgcttcctgggcacttcaatacctttggtgctgaaaggctttttcgattggcttctaactatatttcaaaagctgggatatgtcacaaagtttctacttttgccatgcgatctcttgcaagtttagctctacgtgtaacaaattctaggacctcgccctagtatctatactgataatatattttgattaattatatacattaattcattctgtgctatttaactgattaatagtgagcatttcatgaagtgcttttataccactattatatatcagagaaagattgagaatgaataagccaaaaagaaaattgttagtttaaattgttttctttcttccaagaaagaagccacttaaataagcttatactttgccaaagctgtcatcttgtaatatatgctctagaaatgacataaaggtttatggggaagcaaagagagattttgtggcaagagaactgcccttgcctctgtttttcttgttttattcccttgatgacctagggaaaaaaaggcatgtagagtattatgtttatactttaaacttgatatttttagtgtattatttaaagataaaggttcttgggtttaaaatacattagaacttaatgcagacatataaagtaacattgagaatgacaactaaaacattccattgttatggtcctgaattttttatgcttcatttcatgtatttattctttgtataattatagcatacatgttatgtaatataacttatgaaaagtacagtgaattttgctttattgcaaagctttaaatataaatttcagagtgcttcagtaaaaagctactatatattgttgtttgttattgtgtaggtaatattttcaattatgaaagtgaaatgcaaatgtctgttatctaactacaaattgtcagatttcttaaaaggacactgtcaggcaaatttgaaaatatacacattgagaataattttttattattatatcctattttaatattaacagctattatgaacaaaatttttcctgttaaatagcgacttcagtattgtgttatgttttacagcgttaaaacaactatgaagatctgcagctattcttttacttaacatgcatatgtactacagagggatttttaaattaattgcaaaatgtgcattagctattgacttagagtgaattgccttttgtatcctgattcacaacacctattcctgttcagtattctttgtcttgaatagagaagtctatgttcgtaaagtcatataaaaggttataccactatttagtaaaaagttttagtttggtgctgttaataataatttgctaaaaggccttttagaatatttcataaagggttttaaacagttttttcccactgcctttttattattgacatatctaaaaccaaactgaaatcgctttggaaatcagattttttaatgttaggaagatccagcaattttggtttctgaaaaattacaaaacttttctaccctacagatgcccaggttctttagttttttattcattcaactcacacacacataaacatatacatacacaaacacaatcccacatgcaaacacacacagccacatatatacatgtgtagcacagcgctaaacactgtggaggctaaaaaaagtcaaagacaacattataactaaaagtcgaaagcacacaaaatataaataatagtgtatgcaagttaatgtacattatacatgcgtgtaagggacataaatggaggggtgtgaactttggttaggcaaagtttactggaggaggggtttttgagtcaaatttggaaggatgaacttgttagatagtcagagttggaaacaaaacaatccaagaatagggatataagcattgctagtctagaatagtctattccttgtgaaaatataaatttaattttcaggaatccagtatattccaaacatcacatatttagcatgagaaaaattgatttgtgattgtgtatatgagtcattgttaatgggagacaagctgaactgccacatgccaccaaatgaacctttacttcaatcaaaaaggagggtatgattggttcaattatattaacagaatatcatgggcatttctctatgatggtcattcaaggtagtaggtctctttcaactgagtgcaacattgagaataatgatttggttcagggcaactacaaataatcacttactaagccttaaataaagccattatttttatatcaatagcacaaaggaaaaccaaaagtccttaaccactgaccatttttatcatattttaggcctttttttaaaaaatcagggtatagtaggcactaagttttattaggaaatatttaaacctgctgaaggatttatttataaaaagtgcaatttttcaaaacacattattattttttaatttcccaattttttcagtttttcaaattgtaccacaacatagaactgtgatattttgctattacttcaatgtgaataaataaggtaaagtatatcatttattgagtgcccatgctgtacatttaaaatatgcattatttaatttaatcttactcccagcaccaaaaggtaattgaccagcctcaacacaattttggacaaagctagtaactgaacacaggtctgtctgccccacacttctctttctcttgtaactgcacaatagcagaaaattggcaagatgtatttttactttccaagatgccgtgtgtgccaagaataaatgaaatgatgttaaagcataataataacatatctttaaaaagcttttcaaaatatattttcaccctgacagtgacccttgtaacttaaatgatttttggaaatattagtatgtaagtataattcaaagttgtcaaaatgtaagacatttagaagtaatttttattatttatattgttaatacttaatcactggaaattcattttccttactcgatgttttctttcaactgagaagcctaaaacaaacaaaaaccttgtgtgttatcctgatatagttgactaaatgtatttgttcttatatggatagtaatatgaatgtgacatgcaccaattgtcctattataattttcagataagtgtaactaagcacttgtgtaataaatattagtcattttatttc

SEQ ID NO: 4924 - DNA, 153 bp, Homo sapiens
tcctgcacttatgccagcttctgcaaatgcaaagagtacaaatgcacctcttgcaagaagaactgctgctcctgctaccctgtgggctgtgccaagtgtgcccaaggctgcatttgcaaaggggcatcagataagtgcagctgctgtgcctga

SEQ ID NO: 4925 - DNA, 408 bp, Homo sapiens
cgctccaccacgccgtccacgtgcgccttgcggtctctccatttatcgcttgagatctccagccttaccgcggctcgaaatggaccccaactactcctgcaccactggtggctcctgcacgtgcgccggctcctgcaagtgcaaagagtgcaaatgcacctcctgcaagaagagctgctgcttctgctgccccatgggctgagccaagtgtgcccacggctgcatctgcaaagggacgtcggagaagtgcagctgctgtgcctgatgtgggaacagctcttctcccagatgttaatagaacaacctgcacaacctggattttttttttatacaatactgagccatttgctgcatttctttttatattaaatatgtgagtgacaataaaacaattttgacttgaatctt

SEQ ID NO: 4926 - DNA, 439 bp, Homo sapiens
ccctgagtagaaaagcagccgcaggctgtggcgctccaccacgccgtccgggtgggcctagcagtcgctccatttatcgcttgagatctccagccttaccgcggctcgaaatggaccccaactgctcctgcaccactggtgtctcctgcgcctgcaccggctcctgcacgtgcaaagagtgcaaatgcacctcctgcaagaagagctgctgctcctgctgccccgtgggctgtgccaagtgtgcccacggctgtgtctgcaaagggacgttggagaactgcagctgctgtgcctgatgtgggaacagctcttctcccagatgttaatagaacaagctgcacaacctggattttttttcaatacgatactgagccatttgctgcatttctttttatattaaatatgtgagtgacaataaaacaattttgacttgaatctt

SEQ ID NO: 4927 - DNA, 1139 bp, Homo sapiens
tccccgcgccgaggctgcgccgcgagctgcccgcgccgcgccccccgcgccgcccgccagccccgctgcgacatggcccgcgccgcccgccggaggcccgcgaccccggagcgcggcgcggccggccgctgagcgcagcctggaggcgggaggcccggcccggcctcggagcgagcgcccgcgcggcctggccccctcccttgcgctgctccccgcgctccgtgcgcctagccgccgccgcggcccggcccagccagagcatggagacggcggagaaggagtgcggcgccctgggcgggctcttccaggccatagtcaacgacatgaagagctcctaccctatctgggaggacttcaactccaaggccacgaagctgcattcccagctgaggaccaccgtgctggctgctgtggccttcctggatgccttccagaaagtggctgacatggctaccaacacccgaggggccacgagggacatcggctcggcgctcacacgcatgtgcatgcgccaccgcagcatcgagaccaagctgcggcagttcaccaacgcactgctggagagcctcatcaacccgctgcaggagcgcatcgaggactggaagaaggcggccaaccagctggacaaggaccacgcgaaagagtacaaacgagcccggcatgagatcaaaaagaagtcgtcggacacgctgaagctgcagaagaaggcgcgcaaagggaaaggagacctgcagccccagctggacagtgccctgcaggacgtcaacgacatgtacctgctgctggaggagacggagaagcaggccgtgcgccgggcgctgatcgaggagcggggccgcttctgcaccttcatcaccttcctgcagcctgtggtgaatggagagctgaccatgctgggagagatcacccacctgcagggcatcatcgacgacttggtggtgctgacagcagaaccccacaaactgcctcccgccagcgagcaggtaatcaaagacctaaagggctcggactacagctggtcctaccagaccccaccaccctccgtcccatctgaaccatttgtttcttttctttccgtcagattttggaaaaattctcctctcctccccgccccctccacaccatcctccccgatttaa

SEQ ID NO: 4928 - DNA, 2244 bp, Homo sapiens
atggagacggcggagaaggagtgcggcgccctgggcgggctcttccaggccatagtcaacgacatgaagagctcctaccctatctgggaggacttcaactccaaggccacgaagctgcattcccagctgaggaccaccgtgctggctgctgtggccttcctggatgccttccagaaagtggctgacatggctaccaacacccgaggggccacgagggacatcggctcggcgctcacacgcatgtgcatgcgccaccgcagcatcgagaccaagctgcggcagttcaccaacgcactgctggagagcctcatcaacccgctgcaggagcgcatcgaggactggaagaaggcggccaaccagctggacaaggaccacgcgaaagagtacaaacgagcccggcatgagatcaaaaagaagtcgtcggacacgctgaagctgcagaagaaggcgcgcaaagagctacttgggaaaggagacctgcagccccagctggacagtgccctgcaggacgtcaacgacatgtacctgctgctggaggagacggagaagcaggccgtgcgccgggcgctgatcgaggagcggggccgcttctgcaccttcatcaccttcctgcagcctgtggtgaatggagagctgaccatgctgggagagatcacccacctgcagggcatcatcgacgacttggtggtgctgacagcagaaccccacaaactgcctcccgccagcgagcaggtaatcaaagacctaaagggctcggactacagctggtcctaccagaccccaccctcatcacccagcagctccagctcccggaagtccagcatgtgcagtgcccccagcagcagtagcagtgccaagggtggcggagccccatggcctgggggtgcccaaacatactcacccagttccacctgtcgctaccgcagcctggcgcagccagccaccaccaccgctcgcctctccagcgtttcctcccatgactctggcttcgtctcccaggacgccacctactccaagcccccctcgcctatgccttcagacatcaccagccagaagtcctccagctctgcatcttccgaggcctcggaaacctgccagtccgttagcgagtgcagctcccccacctcggactggtccaaggtcggctcccatgagcagccctcaggcgccactctgcagcggaggaaggaccgagtggagctcctgcgagacacagagccaggccctgccagtgggggcaccctgggccccagcggggaagaggcaccgcgaccccggatgtcccctgccaccatcgcagccaagcacggtgaggaggtgtcccccgccgccagtgacctggccatggtgctgacgcggggcctgagcctggagcaccagaagagcagccgggactcgctgcagtactccagcggctacagcacgcagaccaccacgccctcctgctctgaggacaccatcccctcccaaggctccgactacgactgctactccgtgaatggggatgcggacagcgagggcccgcccgagtttgacaagtcatccaccatcccgcgcaacagcaacatcgcccagaactaccgccgcctgatccagaccaagcgcccagcctccactgctgggctgcccaccgcggggctgcccacggccactggcctgccctcgggcgcaccccccggcgtggccaccatccgccgcacaccctccaccaagcccaccgtgcgccgcgccctgtccagcgctggccccatccccatccggccgcccatcgtccctgtgaagacgcccacggtgcctgactcccccggctacatggggcccacacgggcgggcagtgaggagtgcgtcttctataccgacgagaccgcctcacccctggcaccggacctcgccaaggcctccccaaagaggctcagcctgcccaacacagcctggggcagcccatccccagaggcagccgggtaccccggggcaggggccgaggacgagcagcagcagctggcggccaaccggcacagcctggtggagaagctgggggagctggtggcgggtgcccacgcactgggtgagggccagttccccttccccactgctctgtcggccacccccacggaggagacgcccaccccacccccagccgccaccagcgaccccccggccgaagacatgctggtggccatccggcgtggggtccggctccgcaggaccgtcaccaacgacaggtcggcgccccgcatcttatga

SEQ ID NO: 4929 - DNA, 3034 bp, Homo sapiens
actacgcgccagaacctgcgccgggaagcgtcgcacagcgactgcatcaccatggagccgagggcaggtgtctccaaacaggacatacgtgaacaaatttggggctacatggaatcacaaaatttagctgactttccccgacctgttcatcacaggatacccaactttaaggggtcttatctggcttgccaaaacatcaaagacctagacgtttttgccagaacacaggaagttaaagtggaccctgataaaccactggaaggcgttcggctgctggtgctgcagagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctccccggggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccatccccgtcccctgccgctccggttccgatggcactcgagaggcctgcgtggcaagacgtgtcggagccaccgcctgagctgctcgggtctcaattcttctcagaagtcaccgctcagtgaacgcccaggccctcctgtgagtggggaagccgccctgcggttcatctcacagcgcgcagagactgcagcctcccaatcgtgcaggctcgggccttgagtcggtttctgtttctctggagggacagagcagaggggccagggactgagtgagtggctaagcaggggagggtgatgtgaaggtgatctcgagtttgccaggggtgggctgaacaggagaagatgaacaaaggatccggctctcaaaaggccctggcagggactggatgctgggtacagaagcgcgcccttgggcttcaggctcctgagctggcagcacggcagggagagctccatccatgtcgcaggagcccaggaagctcagcccctgggtaaaaagtgctcactgcagctcagatcagtcctcaggtcacatttcggggagccagcctcccctcttcccctccccagccccgctcctccctctgtggacacactccgggccctcagccagctggctgcatgaggagcagctttgtgctgtgggagagaccggctctgggagaatgggtttcatcccagcctacgtcacatttgcccagtgccttatgttttctgggtttttttcctccagttctgtttctaaaaaccagcttgagtttggctgaactgtcctttctcaacagaagcgcttttgcaattgatcccgggcaacaagtcaaaataagcttttaagtggagattttgtttttttcaaatgtatatgctttggaaattttgattttttagccagagggttttaccaagtgttctttgaagcacattacgatgcctcgagagggcggcccgtgcacgcgctttcaagaaaatgttctcgggacactcggtcttctctttgaaaggacattttctcattggttttgccgtgaaaatcctgtggagacttcgcaaagaaaacgcagccttacatttgctcattaaagacagatttccttcccaagtcgccatgaataaaatgagagagtagaaacgtctggaagcgccacacctggccctgggccctcggccctctgtgtccttggccttgcccccgcccgcacggctggtcacgtttgtcattgggcattcagctcagcgtcagaggctgactcagtccccagttcagagtagtcacctggttacactgaactcctcaccttcttttctctctttttttaaaaaatacttctttttctgaaagattcttatttttttttttttgtttacctttttcctgtggatttgctgccgttagaatagcaactccaggagaagagcaagtgagtcagccccccttctccactccctgccccaccggcagtgggcacagccctgcagacaggagcaaggacttcggggaatagacccactggggccgggagagggagaagctggattctgaccccaccactggcactcctgtgtccagccatgcctgacgcccaccccaccctcagacggcgggattaaaccaggcagtacagggttactcggggaagccagactgctgggatttcctgtcgctttagccagaataatccaggtatatggatatacagataatctgaaagagtttctcatttttatatttgtggaacatcgtgtaagaaaaactgaagagcaagtgcctgaaataaaatcccccacatgtatcagcctgc

SEQ ID NO: 4930 - DNA, 3038 bp, Homo sapiens
actacgcgccagaacctgcgccgggaagcgtcgcacagcgactgcatcaccatggagccgagggcagtaggtgtctccaaacaggacatacgtgaacaaatttggggctacatggaatcacaaaatttagctgactttccccgacctgttcatcacaggatacccaactttaaggggtcttatctggcttgccaaaacatcaaagacctagacgtttttgccagaacacaggaagttaaagtggaccctgataaaccactggaaggcgttcggctgctggtgctgcagagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctccccggggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccatccccgtcccctgccgctccggttccgatggcactcgagaggcctgcgtggcaagacgtgtcggagccaccgcctgagctgctcgggtctcaattcttctcagaagtcaccgctcagtgaacgcccaggccctcctgtgagtggggaagccgccctgcggttcatctcacagcgcgcagagactgcagcctcccaatcgtgcaggctcgggccttgagtcggtttctgtttctctggagggacagagcagaggggccagggactgagtgagtggctaagcaggggagggtgatgtgaaggtgatctcgagtttgccaggggtgggctgaacaggagaagatgaacaaaggatccggctctcaaaaggccctggcagggactggatgctgggtacagaagcgcgcccttgggcttcaggctcctgagctggcagcacggcagggagagctccatccatgtcgcaggagcccaggaagctcagcccctgggtaaaaagtgctcactgcagctcagatcagtcctcaggtcacatttcggggagccagcctcccctcttcccctccccagccccgctcctccctctgtggacacactccgggccctcagccagctggctgcatgaggagcagctttgtgctgtgggagagaccggctctgggagaatgggtttcatcccagcctacgtcacatttgcccagtgccttatgttttctgggtttttttcctccagttctgtttctaaaaaccagcttgagtttggctgaactgtcctttctcaacagaagcgcttttgcaattgatcccgggcaacaagtcaaaataagcttttaagtggagattttgtttttttcaaatgtatatgctttggaaattttgattttttagccagagggttttaccaagtgttctttgaagcacattacgatgcctcgagagggcggcccgtgcacgcgctttcaagaaaatgttctcgggacactcggtcttctctttgaaaggacattttctcattggttttgccgtgaaaatcctgtggagacttcgcaaagaaaacgcagccttacatttgctcattaaagacagatttccttcccaagtcgccatgaataaaatgagagagtagaaacgtctggaagcgccacacctggccctgggccctcggccctctgtgtccttggccttgcccccgcccgcacggctggtcacgtttgtcattgggcattcagctcagcgtcagaggctgactcagtccccagttcagagtagtcacctggttacactgaactcctcaccttcttttctctctttttttaaaaaatacttctttttctgaaagattcttatttttttttttttgtttacctttttcctgtggatttgctgccgttagaatagcaactccaggagaagagcaagtgagtcagccccccttctccactccctgccccaccggcagtgggcacagccctgcagacaggagcaaggacttcggggaatagacccactggggccgggagagggagaagctggattctgaccccaccactggcactcctgtgtccagccatgcctgacgcccaccccaccctcagacggcgggattaaaccaggcagtacagggttactcggggaagccagactgctgggatttcctgtcgctttagccagaataatccaggtatatggatatacagataatctgaaagagtttctcatttttatatttgtggaacatcgtgtaagaaaaactgaagagcaagtgcctgaaataaaatcccccacatgtatcagcctgca

SEQ ID NO: 4931 - DNA, 3038 bp, Homo sapiens
actacgcgccagaacctgcgccgggaagcgtcgcacagcgactgcatcaccatggagccgagggcagtaggtgtctccaaacaggacatacgtgaacaaatttggggctacatggaatcacaaaatttagctgactttccccgacctgttcatcacaggatacccaactttaagggcgcttctcatgctgccgagcaactcccacgcttgcaggcgttcaaaacggccaggaccattaaagtaaatcctgatgccccccagaaaagtgctcgcttcttcgtccttgaaagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctccccggggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccatccccgtcccctgccgctccggttccgatggcactcgagaggcctgcgtggcaagacgtgtcggagccaccgcctgagctgctcgggtctcaattcttctcagaagtcaccgctcagtgaacgcccaggccctcctgtgagtggggaagccgccctgcggttcatctcacagcgcgcagagactgcagcctcccaatcgtgcaggctcgggccttgagtcggtttctgtttctctggagggacagagcagaggggccagggactgagtgagtggctaagcaggggagggtgatgtgaaggtgatctcgagtttgccaggggtgggctgaacaggagaagatgaacaaaggatccggctctcaaaaggccctggcagggactggatgctgggtacagaagcgcgcccttgggcttcaggctcctgagctggcagcacggcagggagagctccatccatgtcgcaggagcccaggaagctcagcccctgggtaaaaagtgctcactgcagctcagatcagtcctcaggtcacatttcggggagccagcctcccctcttcccctccccagccccgctcctccctctgtggacacactccgggccctcagccagctggctgcatgaggagcagctttgtgctgtgggagagaccggctctgggagaatgggtttcatcccagcctacgtcacatttgcccagtgccttatgttttctgggtttttttcctccagttctgtttctaaaaaccagcttgagtttggctgaactgtcctttctcaacagaagcgcttttgcaattgatcccgggcaacaagtcaaaataagcttttaagtggagattttgtttttttcaaatgtatatgctttggaaattttgattttttagccagagggttttaccaagtgttctttgaagcacattacgatgcctcgagagggcggcccgtgcacgcgctttcaagaaaatgttctcgggacactcggtcttctctttgaaaggacattttctcattggttttgccgtgaaaatcctgtggagacttcgcaaagaaaacgcagccttacatttgctcattaaagacagatttccttcccaagtcgccatgaataaaatgagagagtagaaacgtctggaagcgccacacctggccctgggccctcggccctctgtgtccttggccttgcccccgcccgcacggctggtcacgtttgtcattgggcattcagctcagcgtcagaggctgactcagtccccagttcagagtagtcacctggttacactgaactcctcaccttcttttctctctttttttaaaaaatacttctttttctgaaagattcttatttttttttttttgtttacctttttcctgtggatttgctgccgttagaatagcaactccaggagaagagcaagtgagtcagccccccttctccactccctgccccaccggcagtgggcacagccctgcagacaggagcaaggacttcggggaatagacccactggggccgggagagggagaagctggattctgaccccaccactggcactcctgtgtccagccatgcctgacgcccaccccaccctcagacggcgggattaaaccaggcagtacagggttactcggggaagccagactgctgggatttcctgtcgctttagccagaataatccaggtatatggatatacagataatctgaaagagtttctcatttttatatttgtggaacatcgtgtaagaaaaactgaagagcaagtgcctgaaataaaatcccccacatgtatcagcctgca

SEQ ID NO: 4932 - DNA, 2981 bp, Homo sapiens
gggcccaggttaggtgtctccaaacaggacatacgtgaacaaatttggggctacatggaatcacaaaatttagctgactttccccgacctgttcatcacaggatacccaactttaaggggtcttatctggcttgccaaaacatcaaagacctagacgtttttgccagaacacaggaagttaaagtggaccctgataaaccactggaaggcgttcggctgctggtgctgcagagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctccccggggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccatccccgtcccctgccgctccggttccgatggcactcgagaggcctgcgtggcaagacgtgtcggagccaccgcctgagctgctcgggtctcaattcttctcagaagtcaccgctcagtgaacgcccaggccctcctgtgagtggggaagccgccctgcggttcatctcacagcgcgcagagactgcagcctcccaatcgtgcaggctcgggccttgagtcggtttctgtttctctggagggacagagcagaggggccagggactgagtgagtggctaagcaggggagggtgatgtgaaggtgatctcgagtttgccaggggtgggctgaacaggagaagatgaacaaaggatccggctctcaaaaggccctggcagggactggatgctgggtacagaagcgcgcccttgggcttcaggctcctgagctggcagcacggcagggagagctccatccatgtcgcaggagcccaggaagctcagcccctgggtaaaaagtgctcactgcagctcagatcagtcctcaggtcacatttcggggagccagcctcccctcttcccctccccagccccgctcctccctctgtggacacactccgggccctcagccagctggctgcatgaggagcagctttgtgctgtgggagagaccggctctgggagaatgggtttcatcccagcctacgtcacatttgcccagtgccttatgttttctgggtttttttcctccagttctgtttctaaaaaccagcttgagtttggctgaactgtcctttctcaacagaagcgcttttgcaattgatcccgggcaacaagtcaaaataagcttttaagtggagattttgtttttttcaaatgtatatgctttggaaattttgattttttagccagagggttttaccaagtgttctttgaagcacattacgatgcctcgagagggcggcccgtgcacgcgctttcaagaaaatgttctcgggacactcggtcttctctttgaaaggacattttctcattggttttgccgtgaaaatcctgtggagacttcgcaaagaaaacgcagccttacatttgctcattaaagacagatttccttcccaagtcgccatgaataaaatgagagagtagaaacgtctggaagcgccacacctggccctgggccctcggccctctgtgtccttggccttgcccccgcccgcacggctggtcacgtttgtcattgggcattcagctcagcgtcagaggctgactcagtccccagttcagagtagtcacctggttacactgaactcctcaccttcttttctctctttttttaaaaaatacttctttttctgaaagattcttatttttttttttttgtttacctttttcctgtggatttgctgccgttagaatagcaactccaggagaagagcaagtgagtcagccccccttctccactccctgccccaccggcagtgggcacagccctgcagacaggagcaaggacttcggggaatagacccactggggccgggagagggagaagctggattctgaccccaccactggcactcctgtgtccagccatgcctgacgcccaccccaccctcagacggcgggattaaaccaggcagtacagggttactcggggaagccagactgctgggatttcctgtcgctttagccagaataatccaggtatatggatatacagataatctgaaagagtttctcatttttatatttgtggaacatcgtgtaagaaaaactgaagagcaagtgcctgaaataaaatcccccacatgtatcagcctgca

SEQ ID NO: 4933 - DNA, 2451 bp, Homo sapiens
actacgcgccagaacctgcgccgggaagcgtcgcacagcgactgcatcaccatggagccgagggtgtctccaaacaggacatacgtgaacaaatttggggctacatggaatcacaaaatttagctgactttccccgacctgttcatcacaggatacccaactttaagggcgcttctcatgctgccgagcaactcccacgcttgcaggcgttcaaaacggccaggaccattaaagtaaatcctgatgccccccagaaaagtgctcgcttcttcgtccttgaaagcaaaaaaacattgttggttccaacaccacgactgagaacgggattgtttaataagatcacaccaccccctggggcaactaaagacatcttgagaaaatgtgccacctctcaggtgccaccagagcgactggggagacaggatagaatttccaaaacatgctccattggaaattgcctcaccagttctaaggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctccccggggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccatccccgtcccctgccgctccggttccgatggcactcgagaggcctgcgtggcaagacgtgtcggagccaccgcctgagctgctcgggtctcaattcttctcagaagtcaccgctcagtgaacgcccaggccctcctgtgagtggggaagccgccctgcggttcatctcacagcgcgcagagactgcagcctcccaatcgtgcaggctcgggccttgagtcggtttctgtttctctggagggacagagcagaggggccagggactgagtgagtggctaagcaggggagggtgatgtgaaggtgatctcgagtttgccaggggtgggctgaacaggagaagatgaacaaaggatccggctctcaaaaggccctggcagggactggatgctgggtacagaagcgcgcccttgggcttcaggctcctgagctggcagcacggcagggagagctccatccatgtcgcaggagcccaggaagctcagcccctgggtaaaaagtgctcactgcagctcagatcagtcctcaggtcacatttcggggagccagcctcccctcttcccctccccagccccgctcctccctctgtggacacactccgggccctcagccagctggctgcatgaggagcagctttgtgctgtgggagagaccggctctgggagaatgggtttcatcccagcctacgtcacatttgcccagtgccttatgttttctgggtttttttcctccagttctgtttctaaaaaccagcttgagtttggctgaactgtcctttctcaacagaagcgcttttgcaattgatcccgggcaacaagtcaaaataagcttttaagtggagattttgtttttttcaaatgtatatgctttggaaattttgattttttagccagagggttttaccaagtgttctttgaagcacattacgatgcctcgagagggcggcccgtgcacgcgctttcaagaaaatgttctcgggacactcggtcttctctttgaaaggacattttctcattggttttgccgtgaaaatcctgtggagacttcgcaaagaaaacgcagccttacatttgctcattaaagacagatttccttcccaagtcgccatgaataaaatgagagagtagaaacgtctggaagcgcc

SEQ ID NO: 4934 - DNA, 1460 bp, Homo sapiens
aaacttagaaggctttttaagtctcttgggctatttgaaagtgttggtacatacaatgacgtttagtcaccagtattaagggaaataaaagcctttttcaaaacgaagcttccatagtgtccatgcatttgggaaatactatatttgattttttgcatgtatgattataccatgagagacaggattaatatagaagatggcaaggcaaatttctaattagagggaatattaattttctacaaaataaagtttgttcatcaatacaaacctgctttcaaatcaaatcagaaagacatccttcggaatgtgttcagaacccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataatttctccccacatggtgggcctttgaggttccagtaaaaatgctttcaacaaattgggcaatgcttgtgtgattcacaatcgtggcatttaaagtgcacaaagtacaaaggaatttatacagattgggtttaccgaagtataatctataggaggcgcgatggcaagttgataaaatgtgacttatctcctaataagttatggtgggagtggagctgtgcagtttcctgtgtcttctggggtctgagtgaagatagcagggatgctgtgttcacccttcttggtagaagctaaggtgtgagctgggaggttgctggacaggatgggggaccccagaagtcctttatctgtgctctctgcccgccagtgccttacaatttgcaaacgtgtatagcctcagtgactcattcgctgaaatccttcgctttaccaaatctagacatacataaggggctttctctcccttttcagccctctctgtgcagagaaaagatgtgagtccgcttgatgaattctaatgctttgcttagagctatgagaaatgtttgttttaataaaaacctacagtccaataatgcc

SEQ ID NO: 4935 - DNA, 788 bp, Homo sapiens
gccccgccagcagcgccccgcgcccgcccgcccgcgcccctgccgccccccggttccggccgcggaccccactctctgccgttccggctgcggctccgctgccggtagcgccgtcccccgggaccacccttcggctggcgccctcccatgctctcggccacccggagggcttgccagctcctcctcctccacagcctctttcccgtcccgaggatgggcaactcggcctcgaacatcgtcagcccccaggaggccttgccgggccggaaggaacagacccctgtagcggccaaacatcatgtcaatggcaacagaacagtcgaacctttcccagagggaacacagatggctgtatttgaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataatttctccccacatggtgggcctttgaggttccagtaaaaatgctttcaacaaa

SEQ ID NO: 4936 - DNA, 1706 bp, Homo sapiens
gagtgagagagagaaagagggagagagagaggcagagggagagctgaggaaagaaaaaaaggcaagacttggcacagctcagtcaaatcagcttcttttgtctgctttctcggcttgagcttcaggaaagaaaaccgtcctggggtacagaaaaactcagaactttttggttttcaaacttagaaggctttttaagtctcttgggctatttgaaagtgttggtacatacaatgacgtttagtcaccagtattaagggaaataaaagcctttttcaaaacgaagcttccatagtgtccatgcatttgggaaatactatatttgattttttgcatgtatgattataccatgagagacaggattaatatagaagatggcaaggcaaatttctaattagagggaatattaattttctacaaaataaagtttgttcatcaatacaaacctgctttcaaatcaaatcagaaagacatccttcggaatgtgttcagaaccaattagtgacaacactgaagaccagaaaggcaagctgaagacaccagacttcgcttgaagggcaaacaagaaatccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataatttctccccacatggtgggcctttgaggttccagtaaaaatgctttcaacaaattgggcaatgcttgtgtgattcacaatcgtggcatttaaagtgcacaaagtacaaaggaatttatacagattgggtttaccgaagtataatctataggaggcgcgatggcaagttgataaaatgtgacttatctcctaataagttatggtgggagtggagctgtgcagtttcctgtgtcttctggggtctgagtgaagatagcagggatgctgtgttcacccttcttggtagaagctaaggtgtgagctgggaggttgctggacaggatgggggaccccagaagtcctttatctgtgctctctgcccgccagtgccttacaatttgcaaacgtgtatagcctcagtgactcattcgctgaaatccttcgctttaccaaatctagacatacataaggggctttctctcccttttcagccctctctgtgcagagaaaagatgtgagtccgcttgatgaattctaatgctttgcttagagctatgagaaatgtttgttttaataaaaacctacagtccaataa

SEQ ID NO: 4937 - DNA, 775 bp, Homo sapiens
tcaggagtggggtcagcaggaggaactctacagctatgggagaacctgcgttcacctcttttccaagcctgcctgttctggggaagctcaaaaggaacatgatgccctgggctttacagaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccggtgaatctctggacagagctggtgctgagcgtgtgcgcagcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcgggcagaaatgctgacaggtggatgaagctcagtcttgggctttcggtccctttcttttaatgcccatcctcattcctactctgaattgtcacacttttcccttccccaccagttctttaataaaagtatttgaaaggc

SEQ ID NO: 4938 - DNA, 659 bp, Homo sapiens
tcaggagtggggtcagcaggaggaactctacagctatgggagaacctgcgttcacctcttttccaagcctgcctgttctggggaagctcaaaaggaacatgatgccctgggctttacagaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccggtgaatctctggacagagctggtgctgagcgtgtgcgcagcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcgggcagaaatgctgacagtgaga

SEQ ID NO: 4939 - DNA, 775 bp, Homo sapiens
tcaagagtggggtcagcaagagaaactctacggctatgggagagcctgcgttcacctcttttccgagcccacctgttctggggaagctcaaaagaaacatgatgccctgggctttacagaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccggtgaatctctggacagggctggtgctgagcgtgtgcgcagcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcaggcagaaatgctgacatgtagatgaagcgcagtcctgggctttcggtccctttcttttaatgcccatcctcattcctactctgaattgtcacacttttcccttccccaccagttctttaataaaagtatttgaaaggc

SEQ ID NO: 4940 - DNA, 775 bp, Homo sapiens
tcaagagtggggtcagcaagagaaactctacggctatgggagagcctgcgttcacctcttttccgagcccacctgttctggggaagctcaaaagaaacatgatgccctgggctttacagaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccggtgaatctctggacagagctggtgctgagcgtgtgcgcatcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcaggcagaaatgctgacatgtagatgaagcgcagtcctgggctttcggtccctttcttttaatgcccatcctcattcctactctgaattgtcacacttttcccttccccaccagttctttaataaaagtatttgaaaggc

SEQ ID NO: 4941 - DNA, 774 bp, Homo sapiens
caagagtggggtcagcaagagaaactctacggctatgggagagcctgcgttcacctcttttccgagcccacctgttctggggaagctcaaaagaaacatgatgccctgggctttacagaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccggtgaatctctggacagagctggtgctgagcgtgtgcgcatcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcaggcagaaatgctgacaggtgggtgaagctcagtcctgggctttcggtccctttcttttaatgcccatcctcattcctactctgaattgtcacacttttcccttccccaccagttctttaataaaagtatttgaaaggc

SEQ ID NO: 4942 - DNA, 658 bp, Homo sapiens
caagagtggggtcagcaagagaaactctacggctatgggagagcctgcgttcacctcttttccgagcccacctgttctggggaagctcaaaagaaacatgatgccctgggctttacagaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccggtgaatctctggacagagctggtgctgagcgtgtgcgcatcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcaggcagaaatgctgacagtgaga

SEQ ID NO: 4943 - DNA, 649 bp, Homo sapiens
caggagtggggtcagcaggaggaactctacagctatgggagaacctgcgttcacctcttttccaagcctgcctgttctggggaagctcaaaaggaacatgatgccctgggctttacagaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccggtgaatctctggacagagctggtgctgagcgtgtgcgcagcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcgggcagaaatgtga

SEQ ID NO: 4944 - DNA, 3245 bp, Homo sapiens
cgggtccttccgaactgcgcatgcgccaccgcgtctgcagggggagaagcgggcaggggcgcaggcgcagtagtgtgatcccctggccagtccctaagcacgtgggttgggttgtcctgcttggctgcggagggagtggaacctcgatattggtggtgtccatcgtgggcagcggactaataaaggccatggcgccagcagaaatcctgaacgggaaggagatctccgcgcaaataagggcgagactgaaaaatcaagtcactcagttgaaggagcaagtacctggtttcacaccacgcctggcaatattacaggttggcaacagagatgattccaatctttatataaatgtgaagctgaaggctgctgaagagattgggatcaaagccactcacattaagttaccaagaacaaccacagaatctgaggtgatgaagtacattacatctttgaatgaagactctactgtacatgggttcttagtgcagctacctttagattcagagaattccattaacactgaagaagtgatcaatgctattgcacccgagaaggatgtggatggattgactagcatcaatgctgggaaacttgctagaggtgacctcaatgactgtttcattccttgtacgcctaagggatgcttggaactcatcaaagagacaggggtgccgattgccggaaggcatgctgtggtggttgggcgcagtaaaatagttggggccccgatgcatgacttgcttctgtggaacaatgccacagtgaccacctgccactccaagactgcccatctggatgaggaggtaaataaaggtgacatcctggtggttgcaactggtcagcctgaaatggttaaaggggagtggatcaaacctggggcaatagtcatcgactgtggaatcaattatgtcccagatgataaaaaaccaaatgggagaaaagttgtgggtgatgtggcatacgacgaggccaaagagagggcgagcttcatcactcctgttcctggcggcgtagggcccatgacagttgcaatgctcatgcagagcacagtagagagtgccaagcgtttcctggagaaatttaagccaggaaagtggatgattcagtataacaaccttaacctcaagacacctgttccaagtgacattgatatatcacgatcttgtaaaccgaagcccattggtaagctggctcgagaaattggtctgctgtctgaagaggtagaattatatggtgaaacaaaggccaaagttctgctgtcagcactagaacgcctgaagcaccggcctgatgggaaatacgtggtggtgactggaataactccaacacccctgggagaagggaaaagcacaactacaatcgggctagtgcaagcccttggtgcccatctctaccagaatgtctttgcgtgtgtgcgacagccttctcagggccccacctttggaataaaaggtggcgctgcaggaggcggctactcccaggtcattcctatggaagagtttaatctccacctcacaggtgacatccatgccatcactgcagctaataacctcgttgctgcggccattgatgctcggatatttcatgaactgacccagacagacaaggctctctttaatcgtttggtgccatcagtaaatggagtgagaaggttctctgacatccaaatccgaaggttaaagagactaggcattgaaaagactgaccctaccacactgacagatgaagagataaacagatttgcaagattggacattgatccagaaaccataacttggcaaagagtgttggataccaatgatagattcctgaggaagatcacgattggacaggctccaacggagaagggtcacacacggacggcccagtttgatatctctgtggccagtgaaattatggctgtcctggctctcaccacttctctagaagacatgagagagagactgggcaaaatggtggtggcatccagtaagaaaggagagcccgtcagtgccgaagatctgggggtgagtggtgcactgacagtgcttatgaaggacgcaatcaagcccaatctcatgcagacactggagggcactccagtgtttgtccatgctggcccgtttgccaacatcgcacatggcaattcctccatcattgcagaccggatcgcactcaagcttgttggcccagaagggtttgtagtgacggaagcaggatttggagcagacattggaatggaaaagttttttaacatcaaatgccggtattccggcctctgcccccacgtggtggtgcttgttgccactgtcagggctctcaagatgcacgggggcggccccacggtcactgctggactgcctcttcccaaggcttacatacaggagaacctggagctggttgaaaaaggcttcagtaacttgaagaaacaaattgaaaatgccagaatgtttggaattccagtagtagtggccgtgaatgcattcaagacggatacagagtctgagctggacctcatcagccgcctttccagagaacatggggcttttgatgccgtgaagtgcactcactgggcagaagggggcaagggtgccttagccctggctcaggccgtccagagagcagcacaagcacccagcagcttccagctcctttatgacctcaagctcccagttgaggataaaatcaggatcattgcacagaagatctatggagcagatgacattgaattacttcccgaagctcaacacaaagctgaagtctacacgaagcagggctttgggaatctccccatctgcatggctaaaacacacttgtctttgtctcacaacccagagcaaaaaggtgtccctacaggcttcattctgcccattcgcgacatccgcgccagcgttggggctggttttctgtaccccttagtaggaacgatgagcacaatgcctggactccccacccggccctgtttttatgatattgatttggaccctgaaacagaacaggtgaatggattattctaaacagatcaccatccatcttcaagaagctactttgaaagtctggccagtgtctattcaggcccactgggagttaggaagtataagtaagccaagagaagtcagcccctgcccagaagatctgaaactaatagtaggagtttccccagaagtcattttcagccttaattctcatcatgtataaattaacataaatcatgcatgtctgtttactttagtgacgttccacagaataaaaggaaacaagtttgc

SEQ ID NO: 4945 - DNA, 3448 bp, Homo sapiens
aattacggccggattccggagtcctttccagctccctcttcggccgggtttcccgccgaatacaaaggcgcactgtgaactggctctttctttccgccaatcatttccgccagccattcatcaccgattttcttcatcttcccctccctcttccgtcccgcagtccccgacctgttagctctcggttagttaagggactcgggtccttccgaactgcgcatgcgccaccgcgtctgcagggggagaagcgggcaggggcgcaggcgcagtagtgtgatcccctggccagtccctaagcacgtgggttgggttgtcctgcttggctgcggagggagtggaacctcgatattggtggtgtccatcgtgggcagcggactaataaaggccatggcgccagcagaaatcctgaacgggaaggagatctccgcgcaaataagggcgagactgaaaaatcaagtcactcagttgaaggagcaagtacctggtttcacaccacgcctggcaatattacaggttggcaacagagatgattccaatctttatataaatgtgaagctgaaggctgctgaagagattgggatcaaagccactcacattaagttaccaagaacaaccacagaatctgaggtgatgaagtacattacatctttgaatgaagactctactgtacatgggttcttagtgcagctacctttagattcagagaattccattaacactgaagaagtgatcaatgctattgcacccgagaaggatgtggatggattgactagcatcaatgctgggaaacttgctagaggtgacctcaatgactgtttcattccttgtacgcctaagggatgcttggaactcatcaaagagacaggggtgccgattgccggaaggcatgctgtggtggttgggcgcagtaaaatagttggggccccgatgcatgacttgcttctgtggaacaatgccacagtgaccacctgccactccaagactgcccatctggatgaggaggtaaataaaggtgacatcctggtggttgcaactggtcagcctgaaatggttaaaggggagtggatcaaacctggggcaatagtcatcgactgtggaatcaattatgtcccagatgataaaaaaccaaatgggagaaaagttgtgggtgatgtggcatacgacgaggccaaagagagggcgagcttcatcactcctgttcctggcggcgtagggcccatgacagttgcaatgctcatgcagagcacagtagagagtgccaagcgtttcctggagaaatttaagccaggaaagtggatgattcagtataacaaccttaacctcaagacacctgttccaagtgacattgatatatcacgatcttgtaaaccgaagcccattggtaagctggctcgagaaattggtctgctgtctgaagaggtagaattatatggtgaaacaaaggccaaagttctgctgtcagcactagaacgcctgaagcaccggcctgatgggaaatacgtggtggtgactggaataactccaacacccctgggagaagggaaaagcacaactacaatcgggctagtgcaagcccttggtgcccatctctaccagaatgtctttgcgtgtgtgcgacagccttctcagggccccacctttggaataaaaggtggcgctgcaggaggcggctactcccaggtcattcctatggaagagtttaatctccacctcacaggtgacatccatgccatcactgcagctaataacctcgttgctgcggccattgatgctcggatatttcatgaactgacccagacagacaaggctctctttaatcgtttggtgccatcagtaaatggagtgagaaggttctctgacatccaaatccgaaggttaaagagactaggcattgaaaagactgaccctaccacactgacagatgaagagataaacagatttgcaagattggacattgatccagaaaccataacttggcaaagagtgttggataccaatgatagattcctgaggaagatcacgattggacaggctccaacggagaagggtcacacacggacggcccagtttgatatctctgtggccagtgaaattatggctgtcctggctctcaccacttctctagaagacatgagagagagactgggcaaaatggtggtggcatccagtaagaaaggagagcccgtcagtgccgaagatctgggggtgagtggtgcactgacagtgcttatgaaggacgcaatcaagcccaatctcatgcagacactggagggcactccagtgtttgtccatgctggcccgtttgccaacatcgcacatggcaattcctccatcattgcagaccggatcgcactcaagcttgttggcccagaagggtttgtagtgacggaagcaggatttggagcagacattggaatggaaaagttttttaacatcaaatgccggtattccggcctctgcccccacgtggtggtgcttgttgccactgtcagggctctcaagatgcacgggggcggccccacggtcactgctggactgcctcttcccaaggcttacatacaggagaacctggagctggttgaaaaaggcttcagtaacttgaagaaacaaattgaaaatgccagaatgtttggaattccagtagtagtggccgtgaatgcattcaagacggatacagagtctgagctggacctcatcagccgcctttccagagaacatggggcttttgatgccgtgaagtgcactcactgggcagaagggggcaagggtgccttagccctggctcaggccgtccagagagcagcacaagcacccagcagcttccagctcctttatgacctcaagctcccagttgaggataaaatcaggatcattgcacagaagatctatggagcagatgacattgaattacttcccgaagctcaacacaaagctgaagtctacacgaagcagggctttgggaatctccccatctgcatggctaaaacacacttgtctttgtctcacaacccagagcaaaaaggtgtccctacaggcttcattctgcccattcgcgacatccgcgccagcgttggggctggttttctgtaccccttagtaggaacgatgagcacaatgcctggactccccacccggccctgtttttatgatattgatttggaccctgaaacagaacaggtgaatggattattctaaacagatcaccatccatcttcaagaagctactttgaaagtctggccagtgtctattcaggcccactgggagttaggaagtataagtaagccaagagaagtcagcccctgcccagaagatctgaaactaatagtaggagtttccccagaagtcattttcagccttaattctcatcatgtataaattaacataaatcatgcatgtctgtttactttagtgacgttccacagaataaaaggaaacaagtttgccatc

SEQ ID NO: 4946 - DNA, 992 bp, Homo sapiens
ggtttaaaatgacagtctcaagttcatttagaaagagaaggctaattcaaagaaacagcaaggcaagcttcctttctctgtaggaatcattattatccccctttgtcatggcccaccggggagcccattttgcctttagatcccgctggcagaagaccgacgatgaactctgtagacatagcatgtcttttatccttcacaaagccattcgcaatgacttctttcagagctatctctacctgctggaaaaaattcccctggtgaaattgtacgctttaacaagccaagtcatcaatggtgagatgcagttctatgccagagctaaacttttctaccaagaagtaccagccacagaagagggtatgatgggaaatttcattgaactgtccagcccagacatccaggcctctcagaaatttcttaggaaatttgttggggggcctgggagagctggaacagactgcgccttggactgcggctccgggataggaagggtcagcaaacacgtcttattgcctgttttcaacagtgtggagctggtggatatgatggaatcctttctccttgaagcccagaactacctgcaggtcaaaggtgacaaagtagaaagctaccactgctacagcctgcaggaattcacaccccccttcaggagatatgatgtcatctggattcagtgggtctctgggcacctgactgataaggaccttcttgcatttctttcccggtgccgagatggcctgaaagaaaatggcatcatcatattgaaggacaatgtggcccgggagggctgtatccttgatctctctgacagcagtgtgactcgggacatggacatcctccggagcctaataaggaagagtgggctggtggtgctgggccaggagaagcaggatggcttcccagagcagtgcatccccgtgtggatgttcgcactgcacagcgacagacactcctgaaaaagcagtgggaatgaacgactggactgggca

SEQ ID NO: 4947 - DNA, 2147 bp, Homo sapiens
atgaaggaatgtaatgccacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcaggtgggcggtcgctatctctgcatctccctggctcaggctcacatcctgaagaaagcagtgggccacttctcccgggaggggtggatggtgagggtgcaccaagtggccaacagccaggaccaggtgttggaagcagagcctcagttctccttgcctgtctttgccttcatcatgaccaagttcaggccagtccctggctctgcccttcagatctttgagctgtgtgctcaggagcagcgcaagcctgtgcggctggagagtgccgagcggctggccgaggcggtgcaggagcgacagcagtatgcctggctgtgcagccagctgcgccgcaaggccaggctggggagtgtgtctctggacttgtgcgatggggacacgggggagccacgctacaccctccacgtggtggacagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaattgagggtgaagtgaatgagatcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttcccatcttgtcctcttcagtaccacttgggttggtttgtctttgcttcctacaccacgtccttgagtggagttccctgctgaagcccctagcacacactgcatgccttaacaagtgtgtgcaagcccctcagaactcaagacatccaaattttattgcgtctctacttatactggtttgcttttgatttattcctctattagttctataggagtgatctcaagtgagatagcagagcaagatgccaaaagaccataaatagagtaaggtttctatagatgtgagacagatttgagagagcatttactctgtctccctgtggatgaaactgctgctgaaatggttccaatttttaggaatctgcttacccacttcattatttgacagctttccttggtgacccaaaccttgtagcctaagccatttgtctttttctcagtggagggagtgtatggacctggccccatggctttgcatgttagagacctggcagactaaagtctctagtgtttgtttgctcacatttgctgagtgacagctatgtgccagactgcataaagggtggtggcagaagtgaaaatgtttaagaatgaccaaaaacattagtaatgaaagttaatgtgttccaggcattcttctaagtggtttacatgcactgtctcatttaatctgagataaaggatacttaagcccaaactatatctaaacccaaatctcacttggctggaaacatcaatcttaaccatttattcagaaccattaaaccaatgattcc

SEQ ID NO: 4948 - DNA, 3327 bp, Homo sapiens
gtgtgaggggctcttcacgtggggaaggaacagcaggcgcggaggagggggcaagcgtgtgtgagattcagtggtccatgcgtgcgtttgtcgtgtaagggtcattcctggggtttggagtgggggaacaaatcaatgtggctgtttttccgtggaaagaattcccactgcagtgtcccggagcctgcgtgtggtgggcaagctcctcaaatggtatctcacagggaataggggagtcttgaaaacgcagcttcggcagtaggaacatgaacctcttacctaaaagttccagggagtttggctccgttgactattgggagaagttcttccagcagcgaggaaagaaagctttcgagtggtatggaacctacctggaactgtgcggggtgctacataaatatatcaagcccagggaaaaggtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcaggtgggcggtcgctatctctgcatctccctggctcaggctcacatcctgaagaaagcagtgggccacttctcccgggaggggtggatggtgagggtgcaccaagtggccaacagccaggaccaggtgttggaagcagagcctcagttctccttgcctgtctttgccttcatcatgaccaagttcaggccagtccctggctctgcccttcagatctttgagctgtgtgctcaggagcagcgcaagcctgtgcggctggagagtgccgagcggctggccgaggcggtgcaggagcgacagcagtatgcctggctgtgcagccagctgcgccgcaaggccaggctggggagtgtgtctctggacttgtgcgatggggacacgggggagccacgctacaccctccacgtggtggacagccccactgtgaaaccatcgcgggacaatcattttgcgattttcatcatccctcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcggctagagtcatggagctggccccagctgggatgcccacccagcagcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaattgagggtgaagtgaatgagatcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttcccatcttgtcctcttcagtaccacttgggttggtttgtctttgcttcctacaccacgtccttgagtggagttccctgctgaagcccctagcacacactgcatgccttaacaagtgtgtgcaagcccctcagaactcaagacatccaaattttattgcgtctctacttatactggtttgcttttgatttattcctctattagttctataggagtgatctcaagtgagatagcagagcaagatgccaaaagaccataaatagagtaaggtttctatagatgtgagacagatttgagagagcatttactctgtctccctgtggatgaaactgctgctgaaatggttccaatttttaggaatctgcttacccacttcattatttgacagctttccttggtgacccaaaccttgtagcctaagccatttgtctttttctcagtggagggagtgtatggacctggccccatggctttgcatgttagagacctggcagactaaagtctctagtgtttgtttgctcacatttgctgagtgacagctatgtgccagactgcataaagggtggtggcagaagtgaaaatgtttaagaatgaccaaaaacattagtaatgaaagttaatgtgttccaggcattcttctaagtggtttacatgcactgtctcatttaatctgagataaaggatacttaagcccaaactatatctaaacccaaatctcacttggctggaaacatcaatcttaaccatttattcagaaccattaaaccaatgattccaagac

SEQ ID NO: 4949 - DNA, 3022 bp, Homo sapiens
ggaaatctagttcgggaaaagtgtgaggggctcttcacgtggggaaggaacagcaggcgcggaggagggggcaagcgtgtgtgagattcagtggtccatgcgtgcgtttgtcgtgtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcaggtgggcggtcgctatctctgcatctccctggctcaggctcacatcctgaagaaagcagtgggccacttctcccgggaggggtggatggtgagggtgcaccaagtggccaacagccaggaccaggtgttggaagcagagcctcagttctccttgcctgtctttgccttcatcatgaccaagttcaggccagtccctggctctgcccttcagatctttgagctgtgtgctcaggagcagcgcaagcctgtgcggctggagagtgccgagcggctggccgaggcggtgcaggagcgacagcagtatgcctggctgtgcagccagctgcgccgcaaggccaggctggggagtgtgtctctggacttgtgcgatggggacacgggggagccacgctacaccctccacgtggtggacagccccactgtgaaaccatcgcgggacaatcattttgcgattttcatcatccctcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcggctagagtcatggagctggccccagctgggatgcccacccagcagcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaattgagggtgaagtgaatgagatcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttcccatcttgtcctcttcagtaccacttgggttggtttgtctttgcttcctacaccacgtccttgagtggagttccctgctgaagcccctagcacacactgcatgccttaacaagtgtgtgcaagcccctcagaactcaagacatccaaattttattgcgtctctacttatactggtttgcttttgatttattcctctattagttctataggagtgatctcaagtgagatagcagagcaagatgccaaaagaccataaatagagtaaggtttctatagatgtgagacagatttgagagagcatttactctgtctccctgtggatgaaactgctgctgaaatggttccaatttttaggaatctgcttacccacttcattatttgacagctttccttggtgacccaaaccttgtagcctaagccatttgtctttttctcagtggagggagtgtatggacctggccccatggctttgcatgttagagacctggcagactaaagtctctagtgtttgtttgctcacatttgctgagtgacagctatgtgccagactgcataaagggtggtggcagaagtgaaaatgtttaagaatgaccaaaaacattagtaatgaaagttaatgtgttccaggcattcttctaagtggtttacatgcactgtctcatttaatctgagataaaggatacttaagcccaaactatatctaaacccaaatctcacttggctggaaacatcaatcttaaccatttattcagaaccattaaaccaatgattccaagac

SEQ ID NO: 4950 - DNA, 2865 bp, Homo sapiens
ggaaaagtgtgaggggctcttcacgtggggaaggaacagcaggcgcggaggagggggcaagcgtgtgtgagattcagtggtccatgcgtgcgtttgtcgtgtaagggtcattcctggggtttggagtgggggaacaaatcaatgtggctgtttttccgtggaaagaattcccactgcagtgtcccggagcctgcgtgtggtgggcaagctcctcaaatggtatctcacagggaataggggagtcttgaaaacgcagcttcggcagtaggaacatgaacctcttacctaaaagttccagggagtttggctccgttgactattgggagaagttcttccagcagcgaggaaagaaagctttcgagtggtatggaacctacctggaactgtgcggggtgctacataaatatatcaagcccagggaaaaggtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcggctagagtcatggagctggccccagctgggatgcccacccagcagcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaattgagggtgaagtgaatgagatcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttcccatcttgtcctcttcagtaccacttgggttggtttgtctttgcttcctacaccacgtccttgagtggagttccctgctgaagcccctagcacacactgcatgccttaacaagtgtgtgcaagcccctcagaactcaagacatccaaattttattgcgtctctacttatactggtttgcttttgatttattcctctattagttctataggagtgatctcaagtgagatagcagagcaagatgccaaaagaccataaatagagtaaggtttctatagatgtgagacagatttgagagagcatttactctgtctccctgtggatgaaactgctgctgaaatggttccaatttttaggaatctgcttacccacttcattatttgacagctttccttggtgacccaaaccttgtagcctaagccatttgtctttttctcagtggagggagtgtatggacctggccccatggctttgcatgttagagacctggcagactaaagtctctagtgtttgtttgctcacatttgctgagtgacagctatgtgccagactgcataaagggtggtggcagaagtgaaaatgtttaagaatgaccaaaaacattagtaatgaaagttaatgtgttccaggcattcttctaagtggtttacatgcactgtctcatttaatctgagataaaggatacttaagcccaaactatatctaaacccaaatctcacttggctggaaacatcaatcttaaccatttattcagaaccattaaaccaatgattccaagac

SEQ ID NO: 4951 - DNA, 2433 bp, Homo sapiens
acgaggcttcgcacccggatatggttatgggctcggaaatctagttcgggaaaagtgtgaggggctcttcacgtggggaaggaacagcaggcgcggaggagggggcaagcgtgtgtgagattcagtggtccatgcgtgcgtttgtcgtttccagggagtttggctccgttgactattgggagaagttcttccagcagcgaggaaagaaagctttcgagtggtatggaacctacctggaactgtgcggggtgctacataaatatatcaagcccagggaaaaggtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcaggtgggcggtcgctatctctgcatctccctggctcaggctcacatcctgaagaaagcagtgggccacttctcccgggaggggtggatggtgagggtgcaccaagtggccaacagccaggaccaggtgttggaagcagagcctcagttctccttgcctgtctttgccttcatcatgaccaagttcaggccagtccctggctctgcccttcagatctttgagctgtgtgctcaggagcagcgcaagcctgtgcggctggagagtgccgagcggctggccgaggcggtgcaggagcgacagcagtatgcctggctgtgcagccagctgcgccgcaaggccaggctggggagtgtgtctctggacttgtgcgatggggacacgggggagccacgctacaccctccacgtggtggacagccccactgtgaaaccatcgcgggacaatcattttgcgattttcatcatccctcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcggctagagtcatggagctggccccagctgggatgcccacccagcagcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaattgagggtgaagtgaatgagatcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttcccatcttgtcctcttcagtacc

SEQ ID NO: 4952 - DNA, 4068 bp, Homo sapiens
ctagacgcgcggcgcattcaggttctcctggaccgtagtggtagtcgctggcccgagttagaggccagctgagaagtcttcgtgcttcagatttgtttacctacaaaatgcttcggtatccatatttttgtagaatgtataaagaatgcctttcatgttggttggaatctggcatacctaatttaggtgtctggccaaacagaatacatactacagcagaaaaatatagagaatatgaagcccgggagcaaacagatcaaactcaagcccaggagttacacagatctcaagatagagattttgaaactatggctaaattacatattccagtaatggtggatgaagttgttcattgtttgtcaccacaaaaaggacagatttttctagatatgacatttggttcgggagggcacacaaaagccattctgcagaaggagtcagatattgttctctatgccttggacagagacccaacagcttatgcattagctgaacatctttcagagttgtatcctaaacaaatccgagctatgctgggccagttcagccaggcagaagccttattaatgaaagctggagtgcagccaggaacttttgatggagttcttatggatcttgggtgttcctccatgcaacttgatactcctgaaagaggtttttcccttcggaaagatggccctttggacatgagaatggatggtggcaggtaccctgacatgcccactgctgctgatgttgtgaatgctttagatcaacaggcacttgcatctatcctaagaacatacggggaggagaagcatgccaagaaaatcgcttcagcaattgttcaggcacgcagcatctaccccatcaccagaacccagcagcttgccagcatcgttgcagaatactctgaaacatatttcccagtggcccaaactctttattaggaaaatggacgaattgaatagcaaatggagcatttcctccctctgctatttatacacggaaagacttactacagcgatctacccatattgccaccaagactttccaggctcttcgcatatttgtgaacaatgagctcaatgaactctacacgggactgaagacagctcagaagtttctgagacctggtggtcgtcttgttgccctctccttccattcactagaggatcgcatcgtcaaaagatttttgcttggaataagcatgacagaaagatttaacctaagtgttagacaacaagtgatgaaaacatctcaattgggttcagatcacgaaaacacggaagaagtctctatgagaagagctcctttaatgtgggaattgatacacaagaaggtacttagtccacaagatcaggatgtacaagataaccccagagggcgctcagccaagcttagagcagctatcaaattataagttatcatcatcttattcttcaaatttttttctcacaatttctctaatctttactcatgttatgtccctgaatgtcttggtataggtttaagtgtgggacagtctgaaaattgatagcatttagcatttcttttttctcaaaaagaaactgtaggaaatacatgacagagaaagttacactcagggagcagcagcacctccagactggaaaaatatgttaatctttgcatcatattggactcttgaaggcaatccttcctctggccaggaaattttttaaaaaataatactgtgttgtgtttatctaaatacgtaaactcaagctaccaaagagaaagatgttgtaatcatatctgcatgtcctaaattttgaatttagatattccaatttgcatcagtctttctgtggctcaaataatgatgattatggaatgaattttaatgtccctacttgtgaataattagctttctcaaatgtaggctttttacaaattttaaattttaaaatattagtttaaatgtgtgttatactgataaaatttcatctttcaaattatagtctattattttaaagggatttttcagtatgatatgggccattttgttcatctatcgcaaagtaaaaatgtaaaatccttacagagaattgtttcacaaaacttatatttcatgtcaattgtatttattttaataatagctcacaatgcctttagtaagtaataaagtctcttattagaatcttgtattttttaattgagctaatcaaaataattcagccaagtctatttgaaatagaaaactgtctatttaatatagtaaaatcaatgctcccttaatgttgttacaaagatatggtaactgtaatatgggtaaaagtttattcaagaaaagagtacttggtagaagattctttaacaaattgaggagattgattcataattcacatgtcaattttttatagtaatatgtacttctaatttattatttatacttaaattgtgacctgaaagatgagttggagataattagtcaaagggcacatggagtatggaagggggcatgttgattaaccatacatagaaataaatattctcttagttatccttgaaatcatatttatactattaatttgctcagtgcacttttttcaaatacagaaaaaagattctccattatagttacaaattttaggttggtgaatccaagtgaatgaaatatcagcataactatgtgggcaaaatagatagaattaaatgcatgaattttcctcagacttattttatctgcctctgtaatatttaactttagtacccaggcttgttcactacttctgctttacaggctttatttaaatctgaacaatcctacagggaaatcagaattaggaaaaaaatctggagaacaatatggttgaaatagaaacaagagaatgcacctaggttaattccctgaatcctacttgaacattgtataaatttctctttgcatataatacatatttgtgaatgagacatattcccaaaaaattcttatctctgtatgtgattggaaaagaaaagatcacatttgtatattcaacaatctttcacctatttcataagtcattttttcaccctgtatagtatgggaattattttttatgttaaatagaaactgaatgtactgggttgaatggtgtcctctccaaaattcatgtacttcctggagcctcagtatgtgaccttatttggaaatactgtggttgtggttgtaagtagctaagatgaggtcatactggagcagggcaggcccttaatccaatatgactggtgttccttataagagaagatagggcgggcatggtggctcacgcctgtaatcccagcactgtgggaggccaagccaggcaaatcgcttgaggctgaggagttcaagaccagcctggccaacatggcgaaaacccatctctactaaaaataaaattagccatgcgtggtgcttgtaatgtcagctacccaggagtctgaggcacaagaatcactcgaacctgggaggtggaggttgcgagatcacaccactgcactccagtgtgagcaacagaacgagactctgtctcaaaaaaaaaaaaaaaaaggaagaaagagaagatagagacacaggggagaatgccacatgaagctggaggcagagattggagtgatacattgtgggaaccctcagaagataggaaaaaagcatggaatagattctccctcagagttccagtagttgccaaccctgctaacatggttttgcacatctagcatccagaacagtgagaatgtatttctgctgttttaaggtacccagttcatggtaatttgttacagcaatcctaggaagctaatactctgacagaaaaaaatcttggataatatgcatgagaaaaatccttcaataaacacaaaattggtttcaaaatgttttcatgtaaaaataaattaacttttctgtaattagattgtgttttatagtaattcttgcctgcttcttagtctttgttgtaggatgcataataaaatacatgaatgagttttaaatggttagctttggagaatggttttgggaagttcctacagtacacagaaataaaagctaatgttactatgaatgcgcattacttttctaataaaatgtttctgaatctc

SEQ ID NO: 4953 - DNA, 4416 bp, Homo sapiens
agcttggcgccaagaagctcagcctggctgcgcaggggaagctctttgcttgctcgtcaccgtggcaacgcgcgcggccgtttccggaggcggtggccaaagtgggcggggctaggccggagctgctggtgggaggcagccacttgagatcaccaggcctcctgtagaccggcgggtgcagggcccggtcccagagttaagggaaagtcgtttggaaaccccaggccaacaggaccctttggcagctgaggctggaaacagcggaaccaaaggcagacggtcctcagttgcttgggcggacgtggacccaatctgtccgtccttacaagtttcccccaggggcaggacctagacgcgcggcgcattcaggttctcctggaccgtagtggtagtcgctggcccgagttagaggccagctgagaagtcttcgtgcttcagatttgtttacctacaaaatgcttcggtatccatatttttgtagaatgtataaagaatgcctttcatgttggttggaatctggcatacctaatttaggtgtctggccaaacagaatacatactacagcagaaaaatatagagaatatgaagcccgggagcaaacagatcaaactcaagcccaggagttacacagatctcaagatagagattttgaaactatggctaaattacatattccagtaatggtggatgaagttgttcattgtttgtcaccacaaaaaggacagatttttctagatatgacatttggttcgggagggcacacaaaagccattctgcagaaggagtcagatattgttctctatgccttggacagagacccaacagcttatgcattagctgaacatctttcagagttgtatcctaaacaaatccgagctatgctgggccagttcagccaggcagaagccttattaatgaaagctggagtgcagccaggaacttttgatggagttcttatggatcttgggtgttcctccatgcaacttgatactcctgaaagaggtttttcccttcggaaagatggccctttggacatgagaatggatggtggcaggtaccctgacatgcccactgctgctgatgttgtgaatgctttagatcaacaggcacttgcatctatcctaagaacatacggggaggagaagcatgccaagaaaatcgcttcagcaattgttcaggcacgcagcatctaccccatcaccagaacccagcagcttgccagcatcgttgcagaatactctgaaacatatttcccagtggcccaaactctttattaggaaaatggacgaattgaatagcaaatggagcatttcctccctctgctatttatacacggaaagacttactacagcgatctacccatattgccaccaagactttccaggctcttcgcatatttgtgaacaatgagctcaatgaactctacacgggactgaagacagctcagaagtttctgagacctggtggtcgtcttgttgccctctccttccattcactagaggatcgcatcgtcaaaagatttttgcttggaataagcatgacagaaagatttaacctaagtgttagacaacaagtgatgaaaacatctcaattgggttcagatcacgaaaacacggaagaagtctctatgagaagagctcctttaatgtgggaattgatacacaagaaggtacttagtccacaagatcaggatgtacaagataaccccagagggcgctcagccaagcttagagcagctatcaaattataagttatcatcatcttattcttcaaatttttttctcacaatttctctaatctttactcatgttatgtccctgaatgtcttggtataggtttaagtgtgggacagtctgaaaattgatagcatttagcatttcttttttctcaaaaagaaactgtaggaaatacatgacagagaaagttacactcagggagcagcagcacctccagactggaaaaatatgttaatctttgcatcatattggactcttgaaggcaatccttcctctggccaggaaattttttaaaaaataatactgtgttgtgtttatctaaatacgtaaactcaagctaccaaagagaaagatgttgtaatcatatctgcatgtcctaaattttgaatttagatattccaatttgcatcagtctttctgtggctcaaataatgatgattatggaatgaattttaatgtccctacttgtgaataattagctttctcaaatgtaggctttttacaaattttaaattttaaaatattagtttaaatgtgtgttatactgataaaatttcatctttcaaattatagtctattattttaaagggatttttcagtatgatatgggccattttgttcatctatcgcaaagtaaaaatgtaaaatccttacagagaattgtttcacaaaacttatatttcatgtcaattgtatttattttaataatagctcacaatgcctttagtaagtaataaagtctcttattagaatcttgtattttttaattgagctaatcaaaataattcagccaagtctatttgaaatagaaaactgtctatttaatatagtaaaatcaatgctcccttaatgttgttacaaagatatggtaactgtaatatgggtaaaagtttattcaagaaaagagtacttggtagaagattctttaacaaattgaggagattgattcataattcacatgtcaattttttatagtaatatgtacttctaatttattatttatacttaaattgtgacctgaaagatgagttggagataattagtcaaagggcacatggagtatggaagggggcatgttgattaaccatacatagaaataaatattctcttagttatccttgaaatcatatttatactattaatttgctcagtgcacttttttcaaatacagaaaaaagattctccattatagttacaaattttaggttggtgaatccaagtgaatgaaatatcagcataactatgtgggcaaaatagatagaattaaatgcatgaattttcctcagacttattttatctgcctctgtaatatttaactttagtacccaggcttgttcactacttctgctttacaggctttatttaaatctgaacaatcctacagggaaatcagaattaggaaaaaaatctggagaacaatatggttgaaatagaaacaagagaatgcacctaggttaattccctgaatcctacttgaacattgtataaatttctctttgcatataatacatatttgtgaatgagacatattcccaaaaaattcttatctctgtatgtgattggaaaagaaaagatcacatttgtatattcaacaatctttcacctatttcataagtcattttttcaccctgtatagtatgggaattattttttatgttaaatagaaactgaatgtactgggttgaatggtgtcctctccaaaattcatgtacttcctggagcctcagtatgtgaccttatttggaaatactgtggttgtggttgtaagtagctaagatgaggtcatactggagcagggcaggcccttaatccaatatgactggtgttccttataagagaagatagggcgggcatggtggctcacgcctgtaatcccagcactgtgggaggccaagccaggcaaatcgcttgaggctgaggagttcaagaccagcctggccaacatggcgaaaacccatctctactaaaaataaaattagccatgcgtggtgcttgtaatgtcagctacccaggagtctgaggcacaagaatcactcgaacctgggaggtggaggttgcgagatcacaccactgcactccagtgtgagcaacagaacgagactctgtctcaaaaaaaaaaaaaaaaaggaagaaagagaagatagagacacaggggagaatgccacatgaagctggaggcagagattggagtgatacattgtgggaaccctcagaagataggaaaaaagcatggaatagattctccctcagagttccagtagttgccaaccctgctaacatggttttgcacatctagcatccagaacagtgagaatgtatttctgctgttttaaggtacccagttcatggtaatttgttacagcaatcctaggaagctaatactctgacagaaaaaaatcttggataatatgcatgagaaaaatccttcaataaacacaaaattggtttcaaaatgttttcatgtaaaaataaattaacttttctgtaattagattgtgttttatagtaattcttgcctgcttcttagtctttgttgtaggatgcataataaaatacatgaatgagttttaaatggttagctttggagaatggttttgggaagttcctacagtacacagaaataaaagctaatgttactatgaatgcgcattacttttctaataaaatgtttctgaatctc

SEQ ID NO: 4954 - DNA, 428 bp, Homo sapiens
agtttcccccaggggcaggacctagacgcgcggcgcattcaggttctcctggaccgtagtggtagtcgctggcccgagttagaggccagctgagaagtcttcgtgcttcagatttgtttacctacaaaatgcttcggtatccatatttttgtagaatgtataaagaatgcctttcatgttggttggaatctggcatacctaatttaggtgtctggccaaacagaatacatactacagcagaaaaatatagagaatatgaagcccgggagcaaacagatcaaactcaagcccaggagttacacagatctcaagatagagattttgaaactatggctaaattacatattccagtaatggtggatgaagttgttcattgtttgtcaccacaaaaaggacagagtcttggtgtgaggagtgtgggaatatga

SEQ ID NO: 4955 - DNA, 4242 bp, Homo sapiens
gggcggggctaggccggagctgctggtgggaggcagccacttgagatcaccaggcctcctgtagaccggcgggtgcagggcccggtcccagagttaagggaaagtcgtttggaaaccccaggccaacaggaccctttggcagctgaggctggaaacagcggaaccaaaggcagacggtcctcagttgcttgggcggacgtggacccaatctgtccgtccttacaagtttcccccaggggcaggacctagacgcgcggcgcattcaggttctcctggaccgtagtggtagtcgctggcccgagttagaggccagctgagaagtcttcgtgcttcagatttgtttacctacaaaatgcttcggtatccatatttttgtagaatgtataaagaatgcctttcatgttggttggaatctggcatacctaatttaggtgtctggccaaacagaatacatactacagcagaaaaatatagagaatatgaagcccgggagcaaacagatcaaactcaagcccaggagttacacagatctcaagatagagattttgaaactatggctaaattacatattccagtaatggtggatgaagttgttcattgtttgtcaccacaaaaaggacagatttttctagatatgacatttggttcgggagggcacacaaaagccattctgcagaaggagtcagatattgttctctatgccttggacagagacccaacagcttatgcattagctgaacatctttcagagttgtatcctaaacaaatccgagctatgctgggccagttcagccaggcagaagccttattaatgaaagctggagtgcagccaggaacttttgatggagttcttatggatcttgggtgttcctccatgcaacttgatactcctgaaagaggtttttcccttcggaaagatggccctttggacatgagaatggatggtggcaggtaccctgacatgcccactgctgctgatgttgtgaatgctttagatcaacaggcacttgcatctatcctaagaacatacggggaggagaagcatgccaagaaaatcgcttcagcaattgttcaggcacgcagcatctaccccatcaccagaacccagcagcttgccagcatcgttgcaggagcatttcctccctctgctatttatacacggaaagacttactacagcgatctacccatattgccaccaagactttccaggctcttcgcatatttgtgaacaatgagctcaatgaactctacacgggactgaagacagctcagaagtttctgagacctggtggtcgtcttgttgccctctccttccattcactagaggatcgcatcgtcaaaagatttttgcttggaataagcatgacagaaagatttaacctaagtgttagacaacaagtgatgaaaacatctcaattgggttcagatcacgaaaacacggaagaagtctctatgagaagagctcctttaatgtgggaattgatacacaagaaggtacttagtccacaagatcaggatgtacaagataaccccagagggcgctcagccaagcttagagcagctatcaaattataagttatcatcatcttattcttcaaatttttttctcacaatttctctaatctttactcatgttatgtccctgaatgtcttggtataggtttaagtgtgggacagtctgaaaattgatagcatttagcatttcttttttctcaaaaagaaactgtaggaaatacatgacagagaaagttacactcagggagcagcagcacctccagactggaaaaatatgttaatctttgcatcatattggactcttgaaggcaatccttcctctggccaggaaattttttaaaaaataatactgtgttgtgtttatctaaatacgtaaactcaagctaccaaagagaaagatgttgtaatcatatctgcatgtcctaaattttgaatttagatattccaatttgcatcagtctttctgtggctcaaataatgatgattatggaatgaattttaatgtccctacttgtgaataattagctttctcaaatgtaggctttttacaaattttaaattttaaaatattagtttaaatgtgtgttatactgataaaatttcatctttcaaattatagtctattattttaaagggatttttcagtatgatatgggccattttgttcatctatcgcaaagtaaaaatgtaaaatccttacagagaattgtttcacaaaacttatatttcatgtcaattgtatttattttaataatagctcacaatgcctttagtaagtaataaagtctcttattagaatcttgtattttttaattgagctaatcaaaataattcagccaagtctatttgaaatagaaaactgtctatttaatatagtaaaatcaatgctcccttaatgttgttacaaagatatggtaactgtaatatgggtaaaagtttattcaagaaaagagtacttggtagaagattctttaacaaattgaggagattgattcataattcacatgtcaattttttatagtaatatgtacttctaatttattatttatacttaaattgtgacctgaaagatgagttggagataattagtcaaagggcacatggagtatggaagggggcatgttgattaaccatacatagaaataaatattctcttagttatccttgaaatcatatttatactattaatttgctcagtgcacttttttcaaatacagaaaaaagattctccattatagttacaaattttaggttggtgaatccaagtgaatgaaatatcagcataactatgtgggcaaaatagatagaattaaatgcatgaattttcctcagacttattttatctgcctctgtaatatttaactttagtacccaggcttgttcactacttctgctttacaggctttatttaaatctgaacaatcctacagggaaatcagaattaggaaaaaaatctggagaacaatatggttgaaatagaaacaagagaatgcacctaggttaattccctgaatcctacttgaacattgtataaatttctctttgcatataatacatatttgtgaatgagacatattcccaaaaaattcttatctctgtatgtgattggaaaagaaaagatcacatttgtatattcaacaatctttcacctatttcataagtcattttttcaccctgtatagtatgggaattattttttatgttaaatagaaactgaatgtactgggttgaatggtgtcctctccaaaattcatgtacttcctggagcctcagtatgtgaccttatttggaaatactgtggttgtggttgtaagtagctaagatgaggtcatactggagcagggcaggcccttaatccaatatgactggtgttccttataagagaagatagggcgggcatggtggctcacgcctgtaatcccagcactgtgggaggccaagccaggcaaatcgcttgaggctgaggagttcaagaccagcctggccaacatggcgaaaacccatctctactaaaaataaaattagccatgcgtggtgcttgtaatgtcagctacccaggagtctgaggcacaagaatcactcgaacctgggaggtggaggttgcgagatcacaccactgcactccagtgtgagcaacagaacgagactctgtctcaaaaaaaaaaaaaaaaaggaagaaagagaagatagagacacaggggagaatgccacatgaagctggaggcagagattggagtgatacattgtgggaaccctcagaagataggaaaaaagcatggaatagattctccctcagagttccagtagttgccaaccctgctaacatggttttgcacatctagcatccagaacagtgagaatgtatttctgctgttttaaggtacccagttcatggtaatttgttacagcaatcctaggaagctaatactctgacagaaaaaaatcttggataatatgcatgagaaaaatccttcaataaacacaaaattggtttcaaaatgttttcatgtaaaaataaattaacttttctgtaattagattgtgttttatagtaattcttgcctgcttcttagtctttgttgtaggatgcataataaaatacatgaatgagttttaaatggttagctttggagaatggttttgggaagttcctacagtacacagaaataaaagctaatgttactatgaatgcgcattacttttctaataaaatgtttctgaatctc

SEQ ID NO: 4956 - DNA, 5749 bp, Homo sapiens
acgaggctagatggcttcacaagatggcggcgcgctgggagcgtatcatctgcgtttctaggagcttcgctatgcggctgctttaagattctagggttgtacaggcccacgccagacacgacgtctggcaggaacctcggcctcagagatggctctgagtaaatcaatgcatgcaagaaatagatacaaggacaaacctcctgactttgcatatctggcatccaaatatccagattttaagcagcatgttcagataaatctgaatggaagagtgagccttaattttaaagaccccgaagcagtcagagctctgacgtgtactctcctaagggaagattttggactttctattgatattccattggagagactaattcccacagttcccttgagactcaactatattcactgggtagaagatctgatcggtcaccaggattctgacaaaagtactctccgaagaggaattgacataggcacgggggcatcttgcatctaccccttacttggagcaaccttgaatggctggtatttcctcgcaacagaagtggatgatatgtgtttcaactatgcaaagaaaaatgtggaacagaataacttatctgatctcataaaagtggtgaaagtgccacagaagacactcctgatggatgctcttaaagaagaatctgagataatctatgacttttgcatgtgcaaccctcccttttttgccaatcaattggaagccaagggagtaaactcacgaaatcctcgaagacctccgcctagttctgttaatacaggaggcatcacagagatcatggcagaaggaggtgaattagagtttgttaaaaggatcatccatgacagtctacaacttaaaaaaagattaagatggtatagctgcatgctgggaaagaaatgcagcctggcgcctctgaaggaggagcttcgcatacaaggggttcccaaagtaacgtacactgaattctgtcaaggtcggacaatgagatgggccttagcttggagtttttatgatgatgtcacagtaccatcaccaccaagtaagcgaagaaaattagagaaaccgagaaaacccataacattcgtggtgctggcgtccgtgatgaaggaattatccctcaaagcatcacctctgcgctcggagacggcggaaggcatagtcgttgtcacgacatggattgaaaaaattctcactgatttgaaggtccagcataaacgagttccctgtggaaaagaggaagtcagccttttcctaacggccatagaaaactcctggattcatttaaggagaaagaaaagagagcgtgtgagacagctgagagaagttccccgagctcctgaggacgtcattcaggccttggaagagaaaaagcccacccccaaagagtctggcaatagccaagaactggccaggggcccccaggagaggaccccctgtgggcctgctctgcgggaaggcgaggctgccgctgtggagggcccgtgcccgagccaggagtccctgtcccaggaggaaaacccggaacccacggaggatgaaaggagtgaggaaaagggaggggtggaggttttggaaagttgtcaaggctctagcaacggagcccaggaccaagaggcttctgagcagttcggcagcccagtggctgaaagggggaaacgtctcccaggagtggccggacagtacctgtttaagtgtttgataaacgttaagaaggaggtggacgatgccttagtggagatgcactgggttgagggccagaacagggatctgatgaaccagctttgcacctacatacgtaaccaaattttcaggcttgttgcagttaactagaaacctcctgcacagttggaaacgtgttgatagtaacttgctttggagtggcctgtggggtggcaagaggaatcctaccagcggcccattagtagcacgatgtggaattatcttcgaaaacaaaaacctatgaatctgtcccccacctccccccgcctccttcccgctttttgagttacagggagtcgtagtgtggtcatttacaaggaggaattgtggtcatcagtaacaacagaaagccctcagtaaactcccgagggattgcaagctggctcaagctggcccctcagctctggactgcctctgcaaggtcagaagggttgtttgtggagtctgggctgggcagcactgcctagaatatcatgctgtctctgtcacccaagggtgtttcttgaggaggggtggctctctctgcctccagctggaggccctggtaccctgttctaggtcactcttcaagatggggcctaccttgcatcaatcccacaaagggagctgtatggtgggtggtggggaatctgggagagaaaccttagtaatgctgggaaggagcagcagagtctggggaccacccggtaaatggcacattcctgacacctggctgttttgatgttgcttatttcagaagcagaattaggtaagcaaaactccccggtgtgactgaggcacacagaaggcacccatacccccacctccagcctgttgacagtaccattttgtagcagttttactactgtgtgatttttgtttggacatctgaagtagagcttgttttgtttttaaataagaatattcacaaattaaaaaccagcggtcctatttgaatcctggggttagctgagtgagcggctgatgatagaaatgagaaatagaacaaaatagtatgtgccgtaggtagcttaagaaagtctcagatattttgttgctgatcaaatactgtttttttgtggcttcacttgtaatcccccctgtacttacctactcacattggagagttctgaggccggagtaactgtgtccttgaaacacgtttctaattggaatgccagggttcagtagccgtccccccggaaaggggtgaccttttgctgtgcttgatgttgcatcagcagcctagggttctgtttagactaaaatcttggccagagctccttgccatctgctaagaagactggggctgagtagttaagccagccttctgagaggtggctgttggtcaggacgggaagctggtgaccttggcatgtcttggcagcagctagatcaggccctcggcagagacacaggaagcggaactgctgtgccttaacttggctgtggagctggagctggagaaggcagcatactgaccagtggctttttgattgattgtttgttatgaggtggagttttactcttgttgtctaggctggagtgccgtggtgcgatcttagctcactgcaacccccgcctcccgggttcaagcgattctcctgcctcagcctcccaagtagctgggattacaggcacgcgccaccacgcctggctaattttgtgtttttggtagagatgggatttcaccatgttggccaggctaatctcgaactcatgatctcgggtgatccgcccaccttggcctcccaaagtgctgggattacagccgtgagccactactcccagcctctgaccagtgttcttaacctggtccgtggacctccagagagtccatgtacctcctagagttacttctaaaagctctgtgagcatgtgtgtgtgtgtgtgtgtgtgtgtgtattttttttcctggagagagggttcccagaaccctcagacacagacaaaggggtcaataacccactaaggattaagaatcattattctagtccaagcattcatgtgtcaggctgcaaaaaacaatacccagggtcacacagagccaagactcaattcaggaccgtggattcccctggtctagaaattttctgctgtgccagcccacaccaccccactgtccttacctcgagtgaatattacatttgagtcatttgctgggcccaaacctagtttccttggtataattttaggataattgtttaagtggcaactattcattcagtaagtagtaagtacttattgtttgcttgtttcattatgaaagagtggcacatgctcattaaagatttggaaaaatgaaagtcaaaacaacaaaatcaccccgagtcccaaccttctgtaacataaccactcttggcattggcgtgttcctttctagtctctctgtagacggggtgtgtgagtgtgtgggtttaactttggttgtcctcatgctgcgtattcagttttgtattctggtcctttgttcatttaacatcttacaagtatttgtccatgttgtaacagtagtgtattagcttacactccttgcctgttcaaaatgtctttcaggcacagcactggcctttaagcctgtgtcgtagggatttccagagaatgctctgtgtattgaagcacagaaggtgtttctgtgtctcagtgtgtttctgtccctaggtttaaggcttcatgtcatggaggagattttatagatgtcaagctaatgaccttagagttttaaaaaatccgtgaccgtggccaggcgcagtggctcacgcctgtaatcccagcactgtgaggctgagatgggcgcatcgcatgaggtcgggagtttgagaccagcctggccaacatggcgaaaccccgtctctactcaaaatacaaaaattagccgggcatgatagcacgtgcctgtaatcccagctactcgggaggctgaggcaggagactcgcttgaacctgggaggtggaggttgcagtgagccgagaatgccactgcactacagcctgggcgacaaagtgggactgtctcaaaaaaaaaaaaaaaaaaaaaaaaaaaggaacccatgagcaggccagctttcagtctggagccgagtgccttctgtgcatttggatgtttccatttccttccctgagaagattttcttaggctacctagtgagagaacattgaaaatatttttaaaggacatctaagcattgttttggtcatgcatatgctttataattgtgtgttgtttcatagcatatacctctggtacaggtgggcaagtttttctttgaagaaatgggttattgactcatatgtcataaccttgagtgttactctcccggtgtccagaggtcacattcatgttgcggggttggtatgaaattaaatcttggtgatgtgaccctacattctcttctggtccctagaatcggcttctggtctcctgataactgaagtggagacagaagttgagcctgttgcccaggcaaactaaagctgcttttgttcttcggaatctgctttgcctccgtcagcctgcttccttccccacacatgctggccgcactgtccccactccagacctctgctgtgtgtcctgggcagggccgcgttttggcagtaccctttcaactcatcctaagcttcgtgtagattactttagtatatattttttataaaacataaagcctttcctctcgatggaaatcaaagcttaccatgtgagcactcgaacttctaagttgtgacaggaataacaaaactgcaaggagtggaaaagatggaaaagcctgtgggaaatccgaggccttttgaaagaagggagctgatgacttcacgaccagctcctggagcccctcctttctgctgaagccgcggcatttccctccgtggccacacgagggcacccttggcccttttatcaaagcgccttcacttccccgtgggaatggagacaagtctgtccacggtgttttcttgaaatacccagttgctacccagatttgtatttttatgtaaacaaatacattttcacagaaataaaatttgaaaaataaaagtagaaag

SEQ ID NO: 4957 - DNA, 823 bp, Homo sapiens
acgaggctagatggcttcacaagatggcggcgcgctgggagcgtatcatctgcgtttctaggagcttcgctatgcggctgctttaagattctagggttgtacaggcccacgccagacacgacgtctggcaggaacctcggcctcagagatggctctgagtaaatcaatgcatgcaagaaatagatacaaggacaaacctcctgactttgcatatctggcatccaaatatccagattttaagcagcatgttcagataaatctgaatggaagagtgagccttaattttaaagaccccgaagcagtcagagctctgacgtgtactctcctaagggaagattttggactttctattgatattccattggagagactaattcccacagttcccttgagactcaactatattcactgggtagaagatctgatcggtcaccaggattctgacaaaagtactctccgaagaggaattgacataggcacgggggcatcttgcatctaccccttacttggagcaaccttgaatggctggtatttcctcgcaacagaagtggatgatatgtgtttcaactatgcaaagaaaaatgtggaacagaataacttatctgatctcataaaagtggtgaaagtgccacagaagacactcctgatggatgctcttaaagaagaatctgagataatctatgacttttgcatgtgcaaccctcccttttttgccaatcaattggaagccaagggagtaaactcacgaaatcctcgaagacctccgcctagttctgttaatacaggagaatcgcttgaacctgggaggcggaggttgcagtga

SEQ ID NO: 4958 - DNA, 1720 bp, Homo sapiens
atgcggctgctttaagattctagggttgtacaggcccacgccagacacgacgtctggcaggaacctcggcctcagagatggctctgagtaaatcaatgcatgcaagaaatagatacaaggacaaacctcctgactttgcatatctggcatccaaatatccagattttaagcagcatgttcagataaatctgaatggaagagtgagccttaattttaaagaccccgaagcagtcagagctctgacgtgtactctcctaagggaagattttggactttctattgatattccattggagagactaattcccacagttcccttgagactcaactatattcactgggtagaagatctgatcggtcaccaggattctgacaaaagtactctccgaagaggaattgacataggcacgggggcatcttgcatctaccccttacttggagcaaccttgaatggctggtatttcctcgcaacagaagtggatgatatgtgtttcaactatgcaaagaaaaatgtggaacagaataacttatctgatctcataaaagggagtaaactcacgaaatcctcgaagacctccgcctagttctgttaatacaggaggcatcacagagatcatggcagaaggaggtgaattagagtttgttaaaaggatcatccatgacagtctacaacttaaaaaaagattaagatggtatagctgcatgctgggaaagaaatgcagcctggcgcctctgaaggaggagcttcgcatacaaggggttcccaaagtaacgtacactgaattctgtcaaggtcggacaatgagatgggccttagcttggagtttttatgatgatgtcacagtaccatgctgctataggtaaaggaaaaccacctctgagctggccagactgaatgattttccgggcagtgacagaacagcatctgttgcttctcacagttccctcccaggtgtggttggcttcttgttgcctggagattcccagctgaagtgtctgcacacactgcccagcagtcaccaccaagtaagcgaagaaaattagagaaaccgagaaaacccataacattcgtggtgctggcgtccgtgatgaaggaattatccctcaaagcatcacctctgcgctcggagacggcggaaggcatagtcgttgtcacgacatggattgaaaaaattctcactgatttgaaggtccagcataaacgagttccctgtggaaaagaggaagtcagccttttcctaacggccatagaaaactcctggattcatttaaggagaaagaaaagagagcgtgtgagacagctgagagaagttccccgagctcctgaggacgtcattcaggccttggaagagaaaaagcccacccccaaagagtctggcaatagccaagaactggccaggggcccccaggagaggaccccctgtgggcctgctctgcgggaaggcgaggctgccgctgtggagggcccgtgcccgagccaggagtccctgtcccaggaggaaaacccggaacccacggaggatgaaaggagtgaggaaaagggaggggtggaggttttggaaagttgtcaaggctctagcaacggagcccaggaccaagaggcttgctggctcaagctggcccctcagctctggactgcctctgcaaggtcagaagggttgtttgtggagtctgggctgggcagcactgcctagaatatcatgctgtctctgtcacccaa

SEQ ID NO: 4959 - DNA, 1944 bp, Homo sapiens
acaagatggcggcgcgctgggagcgtatcatctgcgtttctaggagcttcgctatgcggctgctttaagattctagggttgtacaggcccacgccagacacgacgtctggcaggaacctcggcctcagagatggctctgagtaaatcaatgcatgcaagaaatagatacaaggacaaacctcctgactttgcatatctggcatccaaatatccagattttaagcagcatgttcagataaatctgaatggaagagtgagccttaattttaaagaccccgaagcagtcagagctctgacgtgtactctcctaagggaagattttggactttctattgatattccattggagagactaattcccacagttcccttgagactcaactatattcactgggtagaagatctgatcggtcaccaggattctgacaaaagtactctccgaagaggaattgacatagggagtaaactcacgaaatcctcgaagacctccgcctagttctgttaatacaggaggcatcacagagatcatggcagaaggaggtgaattagagtttgttaaaaggatcatccatgacagtctacaacttaaaaaaagattaagatggtatagctgcatgctgggaaagaaatgcagcctggcgcctctgaaggaggagcttcgcatacaaggggttcccaaagtaacgtacactgaattctgtcaaggtcggacaatgagatgggccttagcttggagtttttatgatgatgtcacagtaccatcaccaccaagtaagcgaagaaaattagagaaaccgagaaaacccataacattcgtggtgctggcgtccgtgatgaaggaattatccctcaaagcatcacctctgcgctcggagacggcggaaggcatagtcgttgtcacgacatggattgaaaaaattctcactgatttgaaggtccagcataaacgagttccctgtggaaaagaggaagtcagccttttcctaacggccatagaaaactcctggattcatttaaggagaaagaaaagagagcgtgtgagacagctgagagaagttccccgagctcctgaggacgtcattcaggccttggaagagaaaaagcccacccccaaagagtctggcaatagccaagaactggccaggggcccccaggagaggaccccctgtgggcctgctctgcgggaaggcgaggctgccgctgtggagggcccgtgcccgagccaggagtccctgtcccaggaggaaaacccggaacccacggaggatgaaaggagtgaggaaaagggaggggtggaggttttggaaagttgtcaaggctctagcaacggagcccaggaccaagaggcttctgagcagttcggcagcccagtggctgaaagggggaaacgtctcccaggagtggccggacagtacctgtttaagtgtttgataaacgttaagaaggaggtggacgatgccttagtggagatgcactgggttgagggccagaacagggatctgatgaaccagctttgcacctacatacgtaaccaaattttcaggcttgttgcagttaactagaaacctcctgcacagttggaaacgtgttgatagtaacttgctttggagtggcctgtggggtggcaagaggaatcctaccagcggcccattagtagcacgatgtggaattatcttcgaaaacaaaaacctatgaatctgtcccccacctccccccgcctccttcccgctttttgagttacagggagtcgtagtgtggtcatttacaaggaggaattgtggtcatcagtaacaacagaaagccctcagtaaactcccgagggattgcaagctggctcaagctggcccctcagctctggactgcctctgcaaggtcagaagggttgtttgtggagtctgggctgggcagcactgcctagaatatcatgctgtctctgtcacccaa

SEQ ID NO: 4960 - DNA, 1085 bp, Homo sapiens
ccggctatggacgtgtgtctgagctccgcgcagcagcctgggcgccggggggaaggactcagctccccgggtggctggttagaggctgagaagaagggggctccgcagaaagacagcaccgggggagtcctagaagaatccaacaagatagaaccatctcttcatagcctccagaaatttgttcctacagattacgccagctacactcaggagcattatcggtttgcaggaaaggagattgtcatccaggaatccatagagagttacggagcggtggtgtggccaggggctatggctttgtgtcaatacttggaggaacatgccgaggaattgaatttccaagatgcaaaaatacttgaaattggtgccggaccaggccttgtttccattgtggccagtattttaggagctcaagtcacagcaacagatttgcctgatgtcctgggaaaccttcaatacaatcttttaaaaaacacactacaatgtacagcacatctgcctgaagtgaaagaactggtatggggggaagacctggacaaaaactttcccaagtcagctttttactatgattacgtcctagcctcagatgtggtctaccatcactacttcctggacaagctgctcaccaccatggtgtacctttcccagccagggacggtgctgctttgggcaaacaaattcaggttcagcaccgactatgaatttttagataaattcaagcaagtttttgacacaacactgttggctgaatatccagagtcatcagtcaaactttttaaggggatactaaaatgggactaaatccaacaaaatgcctttcacaacgttactgtgtcttttgagcaatgtgttagaaattgctttggtaatagacttctttcacaggattgagaaggtagtgcatagaaacaacttgtatacttggaacaaatgtaacaatactgcagaaactttctaatttctaagataatttaagattatctggttaatctaaatatctaaaaagaacaacataaaaacatgaaagtagctttgttggttccaacgaagttacatgtttaataaatcttacatggataaagtaa

SEQ ID NO: 4961 - DNA, 1556 bp, Homo sapiens
atgtgggggcgccttcttgctgctttcccccctgtgcctacacctcagtcgacgttattttatagggctgatgttgtagtcaccgatcttgaggaattgcaagacttgctgaagatgaatattaatatgaacaagcatcttgtcactggttctgttcaagccaaggtactgaaatggggggaagaaatagaaggctttccttctccacccgacttcatactgatggccgactgcatatactatgaagagtctttggagccattgctgaaaactctaaaagatatcagcggatttgaaacttgtattatatgttgttatgaacaacgaacaatggggaaaaatccagaaattgagaaaaaatattttgagctccttcagctagattttgactttgaaaaaattcctttggaaaaacatgatgaagagtatcgaagtgaagatattcatattatatacatcagaaagaaaaaatcgaaatttccatcgtgaagcctttaatcatcttacccaaggctctaacaacctgggtaaactaaagatgtgaatagagcatgtgaatacagcatgggaagattgtgttcacagatttttttttccggcacgtccttagagatccgatgtatagatgatgaccaccaggggctgtctgcaatacgaaaaattcctgcttgcctgcctgcctgccaatggccctgaatccagcttaggttacttagttcagcatcaagttcttcttaaatgttgggaatcagttattcaaataaaaattggtattgaggcgaggctgaaatctgccaaaaacagccaacatgatttgactggaccttttacaggaagctagagataaatttctgaagagaactatctgctattatataataatgttttaaattcaaactagtaaattttagtttgtcttcagagtttaaaaggttttcattttgtacataattatacaatatttatcatttgtattttccacttcatttcttttaaaatatctttaatactgaaatgttcttttaattttaaaaagaactgagatattgtcttgtatacttatattagccaaagttttcttttcctccaccatacatatctatgtgatttaatcagtaaattgtactgtaatgagttgctaagaagacaaatcagaagattggaggaacaaaagatatctttacagatttttcatttgagcatggagtgagaatagaaagaccagtttcaggcttatgcacttacgtggctcatgcactttatgtatatgttccaggaaaatctggcttaaaaatactggtattgtttacatgaagcagtgaaaggtttttgaataactacaaatgtagttctatatgtatataccaaatgaatttctgttctgtgtctctctgttttatgttatgaagccattcgctcatatacaataatctgtcaaggactttaatcatacttgttccaaagagtagtaaccggatggaattctggtatttataggcattggtgctagatggtacattttatgtgttaaaataaacattgtttttgagaccttg

SEQ ID NO: 4962 - DNA, 1679 bp, Homo sapiens
gcgcgccgctttctgttgccgggcgcaatggcggatacgctggagtcctcgctggaggacccactgcggagctttgtgcgagttttggagaagcgggatggtacagtgctacgactacagcagtatagctccggtggcgtgggttgcgttgtgtgggacgctgccattgtcctttctaaatacctggaaacgcccgagttttctggcgacggggcccacgcgctgagccggcggtcggtgctggagctgggttcgggcaccggggccgtggggctcatggctgctaccctcggggctgatgttgtagtcaccgatcttgaggaattgcaagacttgctgaagatgaatattaatatgaacaagcatcttgtcactggttctgttcaagccaaggtactgaaatggggggaagaaatagaaggctttccttctccacccgacttcatactgatggccgactgcatatactatgaagagtctttggagccattgctgaaaactctaaaagatatcagcggatttgaaacttgtattatatgttgttatgaacaacgaacaatggggaaaaatccagaaattgagaaaaaatattttgagaaatttccatcgtgaagcctttaatcatcttacccaaggctctaacaacctgggtaaactaaagatgtgaatagagcatgtgaatacagcatgggaagattgtgttcacagatttttttttccggcacgtccttagagatccgatgtatagatgatgaccaccaggggctgtctgcaatacgaaaaattcctgcttgcctgcctgcctgccaatggccctgaatccagcttaggttacttagttcagcatcaagttcttcttaaatgttgggaatcagttattcaaataaaaattggtattgaggcgaggctgaaatctgccaaaaacagccaacatgatttgactggaccttttacaggaagctagagataaatttctgaagagaactatctgctattatataataatgttttaaattcaaactagtaaattttagtttgtcttcagagtttaaaaggttttcattttgtacataattatacaatatttatcatttgtattttccacttcatttcttttaaaatatctttaatactgaaatgttcttttaattttaaaaagaactgagatattgtcttgtatacttatattagccaaagttttcttttcctccaccatacatatctatgtgatttaatcagtaaattgtactgtaatgagttgctaagaagacaaatcagaagattggaggaacaaaagatatctttacagatttttcatttgagcatggagtgagaatagaaagaccagtttcaggcttatgcacttacgtggctcatgcactttatgtatatgttccaggaaaatctggcttaaaaatactggtattgtttacatgaagcagtgaaaggtttttgaataactacaaatgtagttctatatgtatataccaaatgaatttctgttctgtgtctctctgttttatgttatgaagccattcgctcatatacaataatctgtcaaggactttaatcatacttgttccaaagagtagtaaccggatggaattctggtatttataggcattggtgctagatggtacattttatgtgttaaaataaacattgtttttgagaccttg

SEQ ID NO: 4963 - DNA, 1761 bp, Homo sapiens
gcgcaatggcggatacgctggagtcctcgctggaggacccactgcggagctttgtgcgagttttggagaagcgggatggtacagtgctacgactacagcagtatagctccggtggcgtgggttgcgttgtgtgggacgctgccattgtcctttctaaatacctggaaacgcccgagttttctggcgacggggcccacgcgctgagccggcggtcggtgctggagctgggttcgggcaccggggccgtggggctcatggctgctaccctcggggctgatgttgtagtcaccgatcttgaggaattgcaagacttgctgaagatgaatattaatatgaacaagcatcttgtcactggttctgttcaagccaaggtactgaaatggggggaagaaatagaaggctttccttctccacccgacttcatactgatggccgactgcatatactatgaagagtctttggagccattgctgaaaactctaaaagatatcagcggatttgaaacttgtattatatgttgttatgaacaacgaacaatggggaaaaatccagaaattgagaaaaaatattttgagctccttcagctagattttgactttgaaaaaattcctttggaaaaacatgatgaagagtatcgaagtgaagatattcatattatatacatcagaaagaaaaaatcgaaatttccatcgtgaagcctttaatcatcttacccaaggctctaacaacctgggtaaactaaagatgtgaatagagcatgtgaatacagcatgggaagattgtgttcacagatttttttttccggcacgtccttagagatccgatgtatagatgatgaccaccaggggctgtctgcaatacgaaaaattcctgcttgcctgcctgcctgccaatggccctgaatccagcttaggttacttagttcagcatcaagttcttcttaaatgttgggaatcagttattcaaataaaaattggtattgaggcgaggctgaaatctgccaaaaacagccaacatgatttgactggaccttttacaggaagctagagataaatttctgaagagaactatctgctattatataataatgttttaaattcaaactagtaaattttagtttgtcttcagagtttaaaaggttttcattttgtacataattatacaatatttatcatttgtattttccacttcatttcttttaaaatatctttaatactgaaatgttcttttaattttaaaaagaactgagatattgtcttgtatacttatattagccaaagttttcttttcctccaccatacatatctatgtgatttaatcagtaaattgtactgtaatgagttgctaagaagacaaatcagaagattggaggaacaaaagatatctttacagatttttcatttgagcatggagtgagaatagaaagaccagtttcaggcttatgcacttacgtggctcatgcactttatgtatatgttccaggaaaatctggcttaaaaatactggtattgtttacatgaagcagtgaaaggtttttgaataactacaaatgtagttctatatgtatataccaaatgaatttctgttctgtgtctctctgttttatgttatgaagccattcgctcatatacaataatctgtcaaggactttaatcatacttgttccaaagagtagtaaccggatggaattctggtatttataggcattggtgctagatggtacattttatgtgttaaaataaacattgtttttgagacctt

SEQ ID NO: 4964 - DNA, 1485 bp, Homo sapiens
gttatggcggccgcctaagtcccacagagacgggagtcgggtgggatcccaggctgggccccgcggcggctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggccatggtacagctggctcctgcggcagccatggacgaggtcacctttaggagcgacactgtgctgtcagatgtccacctctataccccgaaccatagacatctcatggtacggctgaacagcgtggggcagccagttttcctgtcccaattcaagcttctatggagccaagactcttggacagattcaggagccaagggtggcagtcacagagatgttcacacaaaggagcctccttctgctgagacaggcagcacagggtcccctccaggaagtggccatggtaatgagggtttctccctccaggccgggactgacaccactggccaggaagtggctgaagctcagctggatgaggatggggatttggacgtggtgagaagaccacgagccgcctctgattccaacccagcagggcctctgagagacaaggtacatcccatgattctagcacaggaagaagacgacgtcctgggagaggaagcacaaggcagcccgcacgatatcatcagaataggtgtggcggggcgccctgctcctggcagactacatcctgttccgacaggacctcttccgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtggtatagttagggtcaaagaactggactggctgaaggacgacctctgcacagatcccaaggtccccttcagttggtcacaagaggaaatttctgacttgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggctcaacttcacattgagacacttggacgtcacatgtgaagcctacgatcacttccgctcctgcctgcacgcgctggagcagctcgcagatggcaagctgcgcttcgtggtggagcccgtggaggcctccttcccacagctcctggtttacgagcgcctccagcaactggagctctggaagatcatcgcagaaccagtaacatgacccatcgcctccacaaggcgcggcgtctcgactgttcttagagtgtatttctagtaaaatcagaagctcacc

SEQ ID NO: 4965 - DNA, 1552 bp, Homo sapiens
gcgcctgcgcagaccgcctgttatggcggccgcctaagtcccacagagacgggagtcgggtgggatcccaggctgggccccgcggcggctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggccatggtacagctggctcctgcggcagccatggacgaggtcacctttaggagcgacactgtgctgtcagatgtccacctctataccccgaaccatagacatctcatggtacggctgaacagcgtggggcagccagttttcctgtcccaattcaagcttctatggagccaagactcttggacagattcaggagccaagggtggcagtcacagagatgttcacacaaaggagcctccttctgctgagacaggcagcacagggtcccctccaggaagtggccatggtaatgagggtttctccctccaggccgggactgacaccactggccaggaagtggctgaagctcagctggatgaggatggggatttggacgtggtgagaagaccacgagccgcctctgattccaacccagcagggcctctgagagacaaggtacatcccatgattctagcacaggaagaagacgacgtcctgggagaggaagcacaaggcagcccgcacgatatcatcagaatagagcacaccatggccacgcccctggaggatgttggcaagcaggtgtggcggggcgccctgctcctggcagactacatcctgttccgacaggacctcttccgaggatgtacagcgctggagctcggggccggcacggggctcgctagcatcatcgcagccaccatggcacggaccgtttattgtacagatgtcggtgcagatctcttgtccatgtgccagcgaaacattgccctcaacagccacctggctgccactggaggtggtatagttagggtcaaagaactggactggctgaaggacgacctctgcacagatcccaaggtccccttcagttggtcacaagaggaaatttctgacttgtacgatcacaccaccatcctgtttgcagccgaagtgttttacgacgacgacttgactgatgctgtgtttaaaacgctctcccgactcgcccacagattgaaaaatgcctgcacagccatactgtcggtggagaagaggctcaacttcacattgagacacttggacgtcacatgtgaagcctacgatcacttccgctcctgcctgcacgcgctggagcagctcgcagatggcaagctgcgcttcgtggtggagcccgtggaggcctccttcccacagctcctggtttacgagcgcctccagcaactggagctctggaagatcatcgcagaaccagtaacatgacccatcgcctccacaaggcgcggcgtctcgactgttcttagagtgtatttctagtaaaatcagaagctcaccaaagcaa

SEQ ID NO: 4966 - DNA, 2519 bp, Homo sapiens
gtttccggctccggtgtcatggccggctcctaccctgaaggtgcacctgcagtcctcgccgataagaggcagcagttcggaagccggttcctgagagatccggcgcgcgtcttccaccacaatgcctgggacaatgtggagtggtcggaagagcaagccgcggcggcggagagaaaagtccaggagaacagtatccagcgggtgtgccaggagaaacaagttgattatgagatcaatgcccacaaatactggaatgacttctacaaaatccacgaaaatgggtttttcaaggatagacattggctttttaccgaattccctgagctggcacctagccaaaatcaaaatcatttgaaggactggttcttggagaacaagagtgaagtacctgaatgtagaaacaatgaggatggacctggtttaataatggaagaacagcacaagtgttcttcaaagagccttgaacataaaacacagacacttcctgtggaggagaatgtaactcagaaaattagtgacctggaaatttgtgctgatgagtttcctggatcctcagccacctaccgaatactggaggttggctgtggtgtgggaaacacagtctttccaattttacaaacgaacaatgacccaggactctttgtttattgctgtgatttttcttccacagctatagaactggtccagacaaattcagaatatgatccttctcggtgttttgcctttgttcacgacctgtgtgatgaagagaagagttacccagtgcccaagggcagtcttgatattatcattctcatatttgttctttcagcaattgttccagacaagatgcagaaggctatcaacaggctgagcaggcttctgaaacctggcgggatgatgcttctgcgagattacggccgctatgacatggctcagcttcggtttaaaaaaggtcagtgtctatctggaaatttctacgtgagaggtgatggaaccagagtttacttcttcacacaagaggaactggacacgcttttcaccactgctggactggaaaaagttcagaacctggtggatcgccgactgcaggtgaaccgaggaaagcaactgacaatgtaccgggtttggattcagtgcaaatactgcaagccccttctgtccagcaccagctgagaggcacctgctgccaacacgatgcaagcccattgtgtttccgggcttttttaaaaaaaaaattgtagcactgggcgtggtgcatgcctgtaatcccagccactcaggaggctgaggcggggaggatccattgagcccagcagtccaacctgggcaaaatagtgagagaccctgtatctgaaagtaataataaaaataaaaaatataaatgaggtctcgttgatgttggacaattcaagaattcagacttgaaccttaaacctaggaaaagttactttgtatcaggattctaacaattatgcttcatatttgtgaagtcctttaaaacataattttctcaagttctttctttgagatctcaatctgtcttagcattttgtaactaataactgaaattttattcaaaggaattgtaaaccttaaaccaccaatttatttccatgtgaaaaagtgttacatatgacaagtgttttttgactgtaattgcgttaaatcttttgagaatgtaaatgccgggctaggcaattgcagttaatacatacagaggttagtgaagggcttattaagttgtaggggaagcaagctgggaagaatcagatcagatattttcctgacaaaaaaaaatgaccctacagagagcatcaaaatgtggtgttcttgttaagtaattgatcgtggtcttcgctttaatcttagttccgccaggcacggtggctcacacctgtaatcccagcactttgggaggccaaggcgggcggatcagctgaggtcaggagttggagaccagcgtggccaacatggtgaaaccccgtctctactaaagataaaaaaattagctgagtgtgttggtgggtgcctgtaatccagctacttgggagactgaggcaggagaattgcttgaacccaggaggcagaggttgcagtgagctgagattgtgccactgcactccagcctgggcaacaaagcaagactctgtctcaaaaaaataaaaataaaaaaaaaatcttagttccatggaattttaagcattgttccccctctaacctgtgtctaaagaattaaaagaatttggccgggtgcggcagctcatgcctgtaatcccaacactttgggaggctgaggcaggcggatcacgaggtcaggagatcgagaccatcctggccaacacggtgaaacctcgtctccactaaaaataccaaaaaaattagctgggcatggtggcacacacctgtagtcccctgtagtcccagctactcgggaggctgaggcaggagaatcgtttgaacctgggaggtggaggttgcagtgagccaagatcatgtcactgcattccagcctgggcaacagaggaagactccgtctc

SEQ ID NO: 4967 - DNA, 1342 bp, Homo sapiens
gtttccggctccggtgtcatggccggctcctaccctgaaggtgcacctgcagtcctcgccgataagaggcagcagttcggaagccggttcctgagagatccggcgcgcgtcttccaccacaatgcctgggacaatgtggagtggtcggaagagcaagccgcggcggcggagagaaaagtccaggagaacagtatccagcgggtgtgccaggagaaacaagttgattatgagatcaatgcccacaaatactggaatgacttctacaaaatccacgaaaatgggtttttcaaggatagacattggctttttaccgaattccctgagctggcacctagccaaaatcaaaatcatttgaaggactggttcttggagaacaagagtgaagtacctgaatgtagaaacaatgaggatggacctggtttaataatggaagaacagcacaagtgttcttcaaagagccttgaacataaaacacagacacttcctgtggaggagaatgtaactcagaaaattagtgacctggaaatttgtgctgatgagtttcctggacagccacctaccgaatactggaggttggctgtggtgtgggaaacacagtctttccaattttacaaacgaacaatgacccaggactctttgtttattgctgtgatttttcttccacagctatagaactggtccagacaaattcagaatatgatccttctcggtgttttgcctttgttcacgacctgtgtgatgaagagaagagttacccagtgcccaagggcagtcttgatattatcattctcatatttgttctttcagcaattgttccagacaagatgcagaaggctatcaacaggctgagcaggcttctgaaacctggcgggatgatgcttctgcgagattacggccgctatgacatggctcagcttcggtttaaaaaaggtcagtgtctatctggaaatttctacgtgagaggtgatggaaccagagtttacttcttcacacaagaggaactggacacgcttttcaccactgctggactggaaaaagttcagaacctggtggatcgccgactgcaggtgaaccgaggaaagcaactgacaatgtaccgggtttggattcagtgcaaatactgcaagccccttctgtccagcaccagctgagaggcacctgctgccaacacgatgcaagcccattgtgtttccgggcttttttaaaaaaaaaattgtagcactgggcgtggtgcatgcctgtaatcccagccactcaggaggctgaggcggggaggatccattgagcccagcagtccaacctgggcaaaatagtgagagaccctgtatctgaaagtaataat

SEQ ID NO: 4968 - DNA, 2182 bp, Homo sapiens
gcgttacggaaagtgaagtgtttccggctccggtgtcatggccggctcctaccctgaaggtgcacctgcaatcctcgccgataagaggcagcagttcggaagccggttcctgagcgatccggcgcgcgtcttccaccacaatgcctgggacaatgtggagtggtcggaagagcaagccgcggcggcggagagaaaagtccaggagaacagtatccagcgggtgtgccaggagaaacaagttgattatgagatcaatgcccacaaatactggaatgacttctacaaaatccacgaaaatgggtttttcaaggatagacattggctttttaccgaattccctgagctggcacctagccaaaatcaaaatcatttgaaggattggttcttggagaacaagagtgaagtatgtgaatgtagaaacaatgaggatggacctggtttaataatggaagaacagcacaagtgttcttcgaagagccttgaacataaaacacagacacctcctgtggaggagaatgtaactcagaaaattagtgacctggaaatttgtgctgatgagtttcctggatcctcagccacctaccgaatactggaggttggctgtggtgtgggaaacacagtctttccaattttacaaacgaacaatgacccaggactctttgtttattgctgtgatttttcttccacagctatagaactggtccagacaaattcagaatatgatccttctcggtgttttgcctttgttcacgacctgtgtgatgaagagaagagttacccagtgcccaagggcagtcttgatattatcattctcatatttgttctttcagcagttgttccagacaagatgcagaaggctatcaacaggctgagcaggcttctgaaacctggggggatggtacttctgcgagattacggccgctatgacatggctcagcttcggtttaaaaaaggtcagtgtctatctggaaatttctatgtgagaggtgatggaaccagagtttacttcttcacacaagaggaactggacacgcttttcaccactgctggactggaaaaagttcagaatctggtggaccgccgactgcaggtgaaccgagggaagcaactgacaatgtaccgggtttggattcagtgcaaatactgcaagccccttctgtccagcaccagctaagaggcacctgctgccaacacgatgcaagcccgttgtgtttccgagcttttttaaaaaaaaatttgtagcaccgggcatggtgcatgcctgtaatcccagccactcaggaggctgaggcagggaggatccattgagcccaggagtccagcctgggcaaaatagcgagagaccctgaatctgaaagtaatgataaaataaaaagaatataaatgaggtctcgttgatgctggacaattcaagaattcagacttgaaccttaaacctaggaaaagttactttgtatcaggattctaacaattatgcttcatatttgtgaagtcctttaaaacataattttctcaagttctttctttgagacctcaatctgtcttagcattttgtaactaataactgaaattttattcaaaggaattgtaaaccttaaaccaccatttatttccatgtgaaaaagtgttatatatgacaagtgttttttgattgtaattgcgttaaatcttttgagagtgtaaatgccgggctaggcaattgcagttaatacatacaggggttagtgaagggcttattaagttgtaggggaagcaagctgggaagaatcagatcagatattttcctgacaagaaaaaaatgaccctgtagacagcatcaaaatgtggtgttcttgttaagtaattgatcgtggtctttgctttaatcttagttccgccaggcacggtggctcacacctgtaatcccagcactttgggaggccgaggcgggcagatcacctgaggtcaggagttcgagaccagcgtggccaacatggtgaaaccccgtctctactaaagataaaaaaattagctgggtgtgttggtgggtgcctgtaatccagctactcgggaggctgaggcaggagaatcacttgaacccaggaggcagaggttgcagtgagctgagattgcgccactgtactccagcctgggcaacaaagcaagactctgtctcaaaaaaataaaaataaaaaaaatctta

SEQ ID NO: 4969 - DNA, 3693 bp, Homo sapiens
acttccatgcgaccgcctcgtcgctggaaggctgcgtgctggtcgcgcccagctgcgtcaccccaggaactggggtctgtgggccagtgtggccgtctctacgaagactggcacgacccctaaagttaggtcggaagacctgtgggcagcttgagcgccgaggagtgccctgaacgctcaactcgccctggaaacgtttttccgtacagcaacatggcggcgcccatggactcttagaaaaggagaaagctttttctctgtggactggaaggggcatttttcatgatcactatttagatgggtgctgttttcatgaggagagtctgggaaggcggcgtccgcttttctgacaagggaagaggctactttgtccttttaaggattcaatgacttcctgacttggaggatgtggacctagtggctagacccaaggaccaaagcaagaagtcgtggggggcccaggaagacaggaggatcacattgggattccagacataagatcaggttttaaccccctttggccaaattttggctgaaaatgttgaattatcaactctgaaattaaaaagaaagtttatattaaaacattgcaattttccttagaatttctgtatatattaacatcatgaatgataaattctcttcaatgtgcatgtcaggtttttgtacttgtatatcaaatctatctgtgtgtatgaagtgtatgtttattgaaatacaagatatttaagaagctgatctggaaagttggattttcattctagttcctaattcccagaggcttttttaaaggaagggaatgtctgtggtacaccagttgtcagctgggtggttactggatcatctttcttttatcaacaagataaactatcaacttcaccagcatcatgaaccttgttgccgtaaaaaggagttcactacttctgttcactttgagtctcttcaaatggattctgtgtcctcctctggagtctgtgctgcatttattgcttctgactcttccactaagccagagaatgatgatggaggaaattatgaaatgttcacacgaaaatttgtttttcgacctgaactgtttgatgtcaccaaaccttatataactccagctgttcataaagaatgccagcaaagtaatgaaaaggaagatctgatgaatggtgttaaaaaagaaatctccatttctattattgggaagaagcgtaaaagatgtgttgttttcaatcaaggtgaattggatgctatggaataccatacaaagatcagggagctgattttggatggatctttacagttgatccaggaaggtctcaaaagtggttttctttatccactttttgaaaaacaggacaagggtagtaagcccattactttaccacttgacgcctgcagtttgtcagaattatgtgaaatggcaaagcatttgccttctctgaatgaaatggaacatcagacattacaattggtggaagaggatacatctgttacagaacaggatttatttttgcgagttgttgaaaacaactctagctttacaaaagtgattactttaatgggacagaaatacctgctaccaccgaaaagcagttttcttttatctgacatttcttgtatgcaaccacttctaaactataggaaaacatttgatgtaattgtgatagatccaccatggcagaacaaatcagttaaaagaagtaataggtacagttatttgtcacccctgcaaatacagcaaatacctatccctaaattggctgctccaaactgtcttcttgttacttgggtgaccaatagacagaagcacctacgttttataaaggaagaactttatccctcttggtctgtggaggtagttgctgagtggcactgggtaaaaataaccaattcaggagaatttgtgttcccattagattctccacacaaaaagccctacgaaggtcttatactggggagggttcaagaaaaaactgctctaccattgaggaatgcagatgtaaacgtgctccccattccagaccacaaattaattgtcagcgtgccctgtactcttcactcacataagccaccgcttgctgaggttttaaaagactacatcaagccagatggggaatatttggagttgtttgctcgaaatttacagccaggttggactagttggggcaatgaagttctcaaatttcagcatgtggattattttattgctgtggagtctggaagctgactatgatcttgattaaagtagtggtttcttcattgtttcctcaccacttttcccttaattctaagtcatttttttattttgttaccaacccatattcttagaatataaacaggacttgtttttttcagtaagggaccagaagtgactagccttcatgtaattttaagatgaattttacttgagttgcactaacattctatgttattctagactatacaaattaagtggtaagcagttataaagacggcaagaccatgctattgaaaaagttcagaaaacatacaccgtggaccagaggtcttaatcctatctatggatgtgttttgtgtgacccatacagtgttgtaaaaaacacttagaaccattattctaaaaaatggggctatttcacattaaagtccagatttctgcttctttttaaacatcagaggctctggctacacagaggcctttgttctttcctggcatcagtctgcaggaccaagcggtggtggctcacttgggaagagccttgtgctctccactttgccacagtaccactgccaccatgctgctcacttatgtcatccacttggcccttgtatgacctgaatttgcaacctctggtatactgttatgttctggagaaaatattcaaagatctgccaaatactgcattagtatactgagtttatacagcatttttgtagggttttaaattgcattcaaggtcactttccaagcactttctggttttgcttgtttttctagaagaaaatgaaaagctattccttataataaacatggcagcaagtaaacagtgtgattgtgaaaaaaatattatttatagattttctacaaataaatatttgtctaccaagtaaaatattttgactgaaatgattctttgaaatgcatattgatttattatgtattgactttttaaaaattgaggtataattttcacaaaattctccaattttcagtgtcaaattcagtgaattttgaaaacatatatacagttgtctgtctgccacagtgatcatgatacagaacactttctttaccctgaaaacttctcatttttccttttgcagtcaatcccctgctcctatccttggcccctggcaaacactggtttgctttctatcattagttctgctgtttgagaatttcatataaatggaatcatgcaatgtgtaatctattgtgcctggcttctttcacgtagcattttgagaaaagcatttatactatttacagattgttgacaaatatttatccactaagtaaaatgttagactgaaatgattctttgacaagcttgccaatttactgattttgtcaaagaaaaatatgttatttttgaagtttgttcatcctttgagtgtgtgagtatagtatcagaggcttaattttgtatttatggagctattctaacttgttatttaaaaggaaaaaggtattaaacttgaagcaaacttctcatgatctca

SEQ ID NO: 4970 - DNA, 2742 bp, Homo sapiens
ctggaaggctgcgtgctggtcgcgcccagctgcgtcaccccaggaactggggtctgtgggccagtgtggccgtctctacgaagactggcacgacccctaaagttaggtcggaagacctgtgggcagcttgagcgccgaggagtgccctgaacgctcaactcgccctggaaacgtttttccgtacagcaacatggcggcgcccatggactcttagaaaaggagaaagctttttctctgtggactggaaggggcatttttcatgatcactatttagatgggtgctgttttcatgaggagagtctgggaaggcggcgtccgcttttctgacaagggaagaggctactttgtccttttaaggattcaatgacttcctgacttggaggatgtggacctagtggctagacccaaggaccaaagcaagaagtcgtggggggcccaggaagacaggaggatcacattgggattccagacataagatcaggttttaaccccctttggccaaattttggctgaaaatgttgaattatcaactctgaaattaaaaagaaagtttatattaaaacattgcaattttccttagaatttctgtatatattaacatcatgaatgataaattctcttcaatgtgcatgtcaggtttttgtacttgtatatcaaatctatctgtgtgtatgaagtgtatgtttattgaaatacaagatatttaagaagctgatctggaaagttggattttcattctagttcctaattcccagaggcttttttaaaggaagggaatgtctgtggtacaccagttgtcagctgggtggttactggatcatctttcttttatcaacaagataaactatcaacttcaccagcatcatgaaccttgttgccgtaaaaaggagttcactacttctgttcactttgagtctcttcaaatggattctgtgtcctcctctggagtctgtgctgcatttattgcttctgactcttccactaagccagagaatgatgatggaggaaattatgaaatgttcacacgaaaatttgtttttcgacctgaactgtttgatgtcaccaaaccttatataactccagctgttcataaagaatgccagcaaagtaatgaaaaggaagatctgatgaatggtgttaaaaaagaaatctccatttctattattgggaagaagcgtaaaagatgtgttgttttcaatcaaggtgaattggatgctatggaataccatacaaagatcagggagctgattttggatggatctttacagttgatccaggaaggtctcaaaagtggttttctttatccactttttgaaaaacaggacaagggtagtaagcccattactttaccacttgacgcctgcagtttgtcagaattatgtgaaatggcaaagcatttgccttctctgaatgaaatggaacatcagacattacaattggtggaagaggatacatctgttacagaacaggatttatttttgcgagttgttgaaaacaactctagctttacaaaagtgattactttaatgggacagaaatacctgctaccaccgaaaagcagttttcttttatctgacatttcttgtatgcaaccacttctaaactataggaaaacatttgatgtaattgtgatagatccaccatggcagaacaaatcagttaaaagaagtaataggtacagttatttgtcacccctgcaaatacagcaaatacctatccctaaattggctgctccaaactgtcttcttgttacttgggtgaccaatagacagaagcacctacgttttataaaggaagaactttatccctcttggtctgtggaggtagttgctgagtggcactgggtaaaaataaccaattcaggagaatttgtgttcccattagattctccacacaaaaagccctacgaaggtcttatactggggagggttcaagaaaaaactgctctaccattgaggaatgcagatgtaaacgtgctccccattccagaccacaaattaattgtcagcgtgccctgtactcttcactcacataagccaccgcttgctgaggttttaaaagactacatcaagccagatggggaatatttggagttgtttgctcgaaatttacagccaggttggactagttggggcaatgaagttctcaaatttcagcatgtggattattttattgctgtggagtctggaagctgactatgatcttgattaaagtagtggtttcttcattgtttcctcaccacttttcccttaattctaagtcatttttttattttgttaccaacccatattcttagaatataaacaggacttgtttttttcagtaagggaccagaagtgactagccttcatgtaattttaagatgaattttacttgagttgcactaacattctatgttattctagactatacaaattaagtggtaagcagttataaagacggcaagaccatgctattgaaaaagttcagaaaacatacaccgtggaccagaggtcttaatcctatctatggatgtgttttgtgtgacccatacagtgttgtaaaaaacacttagaaccattattctaaaaaatggggctatttcacattaaagtccagatttctgcttctttttaaacatcagaggctctggctacacagaggcctttgttctttcctggcatcagtctgcaggaccaagcggtggtggctcacttgggaagagccttgtgctctccactttgccacagtaccactgccacc

SEQ ID NO: 4971 - DNA, 1335 bp, Homo sapiens
tgccatggcaaaagaactcccggataatccgaattcgtggtcctcagaattggtttagggttgtttcgcggttcttcccgtattctgcctccgaggcccagtggggctggctgtgggccccctgtgctgtttgaggcgtgaaactcacctcaggaaatgtatctgatccattagcgtggattcatattatttggtgatggagaatcttcagctgtgttaagtgttaccgtcagtttcagagatggcttctttgcaaaggaaagggctgcaggcaaggattctcacctctgaagaagaggagaaactgaaaagagaccaaactttggtgtctgattttaaacagcagaaattggaacaagaggctcagaaaaattgggatcttttttacaaaagaaatagcactaatttcttcaaagacagacactggaccaccagagagtttgaggagctaagatcatgtagagagtttgaagatcaaaagttaacaatgcttgaagctggctgtggggttggaaactgtttattcccacttttagaagaagatccgaatatctttgcctatgcctgtgatttttctccaagagccattgaatatgttaagcaaaatcctttatatgatacagaaagatgcaaggtattccagtgtgatctgactaaagatgatcttctggatcatgtaccgccagagtctgtggatgttgttatgttgatatttgtgctgtcagctgttcatcctgataagatgcaccttgtcttacaaaacatttacaaggtattaaaaccaggcaaaagtgtcttgtttcgtgactacggactgtatgatcatgccatgcttaggtttaaagccagcagcaaacttggagaaaacttttatgttagacaagatgggaccagatcatatttttttactgatgacttcctggctcagctctttatggacacaggttatgaagaagtggtaaacgagtatgtgtttcgagagacggtgaataaaaaagaaggcctgtgtgtgccaagagttttccttcagagcaaatttctaaagcctcctaagaacccatctcctgtggtcctgggcctggatcctaagtcctgacctttcatgaggttggcatttataccttcccttgaagaggaaaatttaaaatcactctttcgtctgggtgcggtggctcatgcctgtaatcccagcacttcgggaggccgaggttgggggatcatctgaggtcaggagtttgagaccagcctggccaacatggtgagaccccatctctactaaaaatacaaaaaaattagctgggcatagtggcgagtgcctgtaatcccagctactca

SEQ ID NO: 4972 - DNA, 4020 bp, Homo sapiens
tgccatggcaaaagaactcccggataatccgaattcgtggtcctcagaattggtttagggttgtttcgcggttcttcccgtattctgcctccgaggcccagtggggctggctgtgggccccctgtgctgtttgaggcgtgaaactcacctcaggaaatgtatctgatccattagcgtggattcatattatttggtgatggagaatcttcagctgtgttaagtgttaccgtcagtttcagagatggcttctttgcaaaggaaagggctgcaggcaaggattctcacctctgaagaagaggagaaactgaaaagagaccaaactttggtgtctgattttaaacagcagaaattggaacaagaggctcagaaaaattgggatcttttttacaaaagaaatagcactaatttcttcaaagacagacactggaccaccagagagtttgaggagctaagatcatgtagagagtttgaagatcaaaagttaacaatgcttgaagctggctgtggggttggaaactgtttattcccacttttagaagaagatccgaatatctttgcctatgcctgtgatttttctccaagagccattgaatatgttaagcaaaatcctttatatgatacagaaagatgcaaggtattccagtgtgatctgactaaagatgatcttctggatcatgtaccgccagagtctgtggatgttgttatgttgatatttgtgctgtcagctgttcatcctgataagatgcaccttgtcttacaaaacatttacaaggtattaaaaccaggcaaaagtgtcttgtttcgtgactacggactgtatgatcatgccatgcttaggtttaaagccagcagcaaacttggagaaaacttttatgttagacaagatgggaccagatcatatttttttactgatgacttcctggctcagctctttatggacacaggttatgaagaagtggtaaacgagtatgtgtttcgagagacggtgaataaaaaagaaggcctgtgtgtgccaagagttttccttcagagcaaatttctaaagcctcctaagaacccatctcctgtggtcctgggcctggatcctaagtcctgacctttcatgaggtctcaaacaaaagtctggaacctgggattctttgtaggatatctggctgtgcttttgtattatatgaaccacagaaaataatcttccagtatgatattgttttcagtatagtacctcaaccctaattttgcctggtaaccctttatccagagaccttttgttttcaacttacagtcttattctggggtgggggatgtacagtctggctgtgtggacttgcaggagagatttagggttctaacttcttcttactgacttccaaccaattctcctgtattcagtcttatacacacccccacttatactagacgtagctggtactaccaaagcctggtcacaaaactctatgggagtctcaatgcaagttgagttgcttcttgactttcatccctgctggcttaagactcagcttcacaagcctgctaagtcagttgctatttatcctgttttctagcccttcaaaattttaaatgaaaatttacatttttaattgacaaataatatatatatgggataaatatgatgttttgatagtaatagatgtatacattgtggaatgattatatgaagctaattagcatatcacactcctcacatacttctttttctttgtattgagaacatgtaaaatctattcttggccaagcatggtggctcacacctgtaattccaacactttgagaggccaaggcaggaagattgcttgagcccaggaattcaggggttccagacaccagcctgggcaacatagcaataccctgtctctaataaaaaaaaaaaaaagtaaaaataaatgtgtaatttaaaaaattcattattgttattatttttacaattttgaaactgtaggggccaggaacaaacttcccctttgccctctgaagaataactaaaaaatcactcaccaaatgcagattaataggagaaatggaataaaaacttagtaattgttttccttggtggatcccttaggtctttatgtagatagggaaaaggtttcttctagcatctgttgattgctaaggacatttaattcaaaatactcattataccagggagccatatctgggggtaaaattccagatgctccttcaaagtatacattattattgactatggtcaccatgtacagtagatctcaaaaacgtattccccctggctaactgaaatgtgtgccctttggtcaacatctcccctactcctctcctcccccagcctctggtaaccaccattctactttctgctgctgtgagttcaactttttaaaattccacgtataagtgaaatcatgtggtatttgtctttctgaatctggcttatttcacttagcataatatcttccaggttcacccatgttgttgcaaatgatagaatgtccttgtttctaatgttctcccaaatttaatcagttgtatggggtttatgtgataaaaatatccttttgctgtcattttcgtggggtttccagaaggatcctaactaggtacacatgcttagtctgtcttttttttttttttttttttgaagcaagtctccctctgttgccaggctggagtgcagtggcctgatcatgactcattgcaacctctgcctcccaggcccaagcaatcctcctacctcagcctccaagtagctgggactgaaggtgtgtgccagcatgtgtggctaattttatttttgtaaagacagagtctccttatattgcccaggctggtctcaaactcctgggttcgagatcctcctgcctctgcctcccaaagtgctgggattacaggcatgagccatggtgcctggtctagtctgtcatctttaaacaattgggttgggaaggaaaaggtagcacatagatagatgatttaagcagaaatagataagcataattgtccactgtaaaggggctgaatgatctggagaatggaggcatctcaggaaaactgaacttggtggtgtgtgcttaggactaatgaaaagtggccgggcacagatgctcatgcctataatcccagcacttcgggagggtgagagggagtataatttgaggccaggaattcaaggttgcagtgagccatgattgtgccactgttctccagcctgggcagcagagtgagaccccgactcttaaaaaaaaaaaaaaaagaaccaaagaaatgttagttccagggattcccagggacatgggcagggtccaagaatgatgctgagttaaggttaggtggctattcagaaagctacttcgacttgtatcccatattatggatcaaggaccttaaaaatagccatactttttttttgttctagtaactcaatttgtaggattgtttcctaagagataatctgacatattcaaggacttcttcacaaagatattcattagctgcattatttatagtaccaaacattataaatagtctaaaccagagatccacaagctatggctataacagtgacaaggaggcctagcgtgactaactccattttgctcctaacccccctgcagcgataacctgtatcttttaggttaactgcttttgcttatctctgcacataggccaagctaactatagaaggaatttagtttatagtttagagcaaggatggtaatagtgcctcccccaaaactaacccctgaggagataaggaggatgtatgcaagtaataatgttatgttaaagatttataagagcactgtgacctgaccaaggacaaagtttcaccacctccttggacccttgccaccacccagatgtgatcactggccacttcttgacctcaactccctccctcttcccccttcctctcacgtaaaaggagcctgaaatttgtattgacttaaaaatggttcttcaggacactactcttccattttcttggtttgctggctctctgaataaaagtcactttccttgcctcaa

SEQ ID NO: 4973 - DNA, 1506 bp, Homo sapiens
aaaagtcattgaagagcttgtggggctgtgggacctgcgccctctggaggaattccatacacccactcaactctggcaaataggaaattgtcaagtaggagacaaggagcaaagtcctatcacagcgggaggggacgccagcgcctgcagaggctgagcagggaaaaagccagtgccccagcggaagcacagctcagagctggtctgccatggacatcctggtcccactcctgcagctgctggtgctgcttcttaccctgcccctgcacctcatggctctgctgggctgctggcagcccctgtgcaaaagctacttcccctacctgatggccgtgctgactcccaagagcaaccgcaagatggagagcaagaaacgggagctcttcagccagataaaggggcttacaggagcctccgggaaagtggccctactggagctgggctgcggaaccggagccaactttcagttctacccaccgggctgcagggtcacctgcctagacccaaatccccactttgagaagttcctgacaaagagcatggctgagaacaggcacctccaatatgagcggtttgtggtggctcctggagaggacatgagacagctggctgatggctccatggatgtggtggtctgcactctggtgctgtgctctgtgcagagcccaaggaaggtcctgcaggaggtccggagagtactgagaccgggaggtgtgctctttttctgggagcatgtggcagaaccatatggaagctgggccttcatgtggcagcaagttttcgagcccacctggaaacacattggggatggctgctgcctcaccagagagacctggaaggatcttgagaacgcccagttctccgaaatccaaatggaacgacagccccctcccttgaagtggctacctgttgggccccacatcatgggaaaggctgtcaaataatctttcccaagctccaaggcactcatttgctccttccccagcctccaattagaacaagccacccaccagcctatctatcttccactgagagggacctagcagaatgagagaagacattcatgtaccacctactagtccctctctccccaacctctgccagggcaatctctaacttcaatcccgccttcgacagtgaaaaagctctacttctacgctgacccagggaggaaacactaggaccctgttgtatcctcaactgcaagtttctggactagtctcccaacgtttgcctcccaatgttgtccctttccttcgttcccatggtaaagctcctctcgctttcctcctgaggctacacccatgcgtctctaggaactggtcacaaaagtcatggtgcctgcatccctgccaagcccccctgaccctctctccccactaccaccttcttcctgagctgggggcaccagggagaatcagagatgctggggatgccagagcaagactcaaagaggcagaggttttgttctcaaatattttttaataaatagacgaaaccacgaaa

SEQ ID NO: 4974 - DNA, 3256 bp, Homo sapiens
ggccgctcgtaagtgctccggatggaaactggtgcagggggcagcggcgttccgcggccggaagggaagggggaggtgccgaggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaacgtaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcaccatt

SEQ ID NO: 4975 - DNA, 3191 bp, Homo sapiens
ggaagggaagggggaggtgccgaggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaacggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcacc

SEQ ID NO: 4976 - DNA, 2531 bp, Homo sapiens
tgcctgagcctggcgtccgtgtggctggcgcggaggatgtggacgctgcggagcccgctcacccgctccctgtacgtgaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaacgtaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagca

SEQ ID NO: 4977 - DNA, 1117 bp, Homo sapiens
agtgcttgggtatcgaggctctgagactccggcctcacctctccacggggtcgaagggaacctctcctgatgacagcagtcgcaaagggccgaccatgatgatgaaaccccaggcggagacgggggaagcagcacgggatcccagcctcaggcctgcacggacggtgttggttgggtcactgtcatggctaagaaagcaactccaacccacacactgcaaatatgaaggaccacgaaaggcacgcaggctctggtttgcatagtgaagatgagcgtctgtgttcctaagcatgaaggaggaccacatgagtatcctggacacctactgcatgaatgtattcgccctttcagatctagggacctgggtaccttgggacagagggagtgcagagcagagaaaacctacctgtgcaactgagaaggccgctcaggccacggggacagggcaggaatgctctcaggagtgtcccctgaacctgaacttgatttcacgccatcaccttccacctcttaaccagcatctcctggacagtcagccgagtgtttccatgataccagccatacctgatgccaggagactcgctacacttggaagctcttcaagatgtgtattgaatttgcagaaggcctcttttccaaatgatcaatgaatttcaacaccagagtcttggagtcagacaaggaaactttcagtttaacagcctcccaggatgtcaactggaagatcatgccactcctgacaatgagaagaggagttccctgtgcaagggaagcacatggtagggttaatgctacatggaacatgaactctgaagaccctcattttggtttccatgaaggtggtgaaggttctccaaataaaagcatttccaataagggtgaagagtagagagcagtgatgtttccaaaaagtttagaattcctccttcaaatgacttcctaatgaatatcagaaggcaatgtgtggagtcacaagtcattggaatggcacccactgtgtaatttcaacaaaacacttcatccctctgagcctctggtggctcatctgtaaattaaggcaaattctatcttcaaatttcttcactctttgatcaacaacttttattcaactttgttg

SEQ ID NO: 4978 - DNA, 660 bp, Homo sapiens
gactgggtggatgaggctcaccccggcggggagaagggacgaggaggggcggacagcggaaggtccgggagtgtccgccataaagtcgtttgagttttaacttctagtcatggcgaatgatcgcaggagagcacagactggaccctgctacgatctctcttggagtggatcagactgatgatcaccaacaaccaactcattcccggataaggaagaagagagtgtcacctacttcagtgtggtttcaaccctacttctgcatcttaaagacactgtgtacaacgttggacactgtgcaggatgatgccacttcatcttggatgctaatctgccatgttgacttctgattaaccccaggcccaggaatgcctcaagatttctactttacttactgttgcttgtgtaagccaagacaaccttgatgttatcataaacatgtacttacctaagtcctgtcctttggcaaattatgggctatgagacacagcattcttgcctttccctgaggggtcaatttcagcgatcctacacattccttctgaagcacttatgctctttctatatggtatgtaagctctcggtctggggagtaacagtgcagagatctacctgtcttgttgccacatgtttctaaactttccaataaatcaccttctactg

SEQ ID NO: 4979 - DNA, 7664 bp, Homo sapiens
aaacagatgacaaagtacctccgactgaatcccacagacagcgctttgagcagaacgcacggctcaactcatgtaattactgtttatagctggccgagcctgactaggagagggcagacccgagaggaaatcagtttcccggacctttgagaggaggctgtgtgttaattaaaggctaggacgggacgggtacttctcagacatgctccaagttgttcttgagatcacagttcccatcacattttctctggagggagtgagtagataattgggattttttttttatttttggccttgtctttcttccttttttttacctctccccattttagtcatatggccttgaacccacagtgaattgaagagagaaagaaatggatatgtctgaccccaatttttggactgtgctctcaaactttactttgcctcatttgaggagtgggaacaggcttcggcgaacacaaagttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaa

SEQ ID NO: 4980 - DNA, 9879 bp, Homo sapiens
atgaaagcccagcgggaaaggctacagattccggggctgaccttggatctcactcccaggagcctgagtccaaccccatccagcccaggcagtccttgtagtcctctcttggcctttcacttttggagttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggagtctcaataggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaacggggagggcccaggggcaggactgtggagacccgtcctgaacgggcgactgtgtcttgactacctttcaaaaccagcactgtgtgggaatgtccgccaggcagagctcggagcctcattgagacaggggagagagaaagacaaagaggggaccttcttccagatgccttcccagttgtaaccggtaaaactgttaccagatagtgtttgtacaaaaaaaaaaaaaaaaaaaaaaaaaaaaattacctttacagttgagggttgttgaggaaaatgattttctttgtaaatatatagcatcgtgtttggtttgggatgtagagtctatacctggctgctgattgcgtcgtttactacagctttttttaaataagatttttgctttaccatttatcataatgtagtaatgaagcaaaatggtcaaaactgggtgtgtgtgaacagagatacacccatattcgtgtatatacacatccacctacatgttttggtctgtggtttaagagactatttcaaggttccatttttataagctaaaacattctaagttaagatggaagaaagccctaaacacagtagattctgagtttttatgtgtattttaaccagagtttctgatagtactgtatctggctacctatatttccagatctaaagcaagaactactctaagtactgcatttggaatcctcctccattaggaatggccaggacaagtggagctagccattttcattacacggccatcccaatggacactggatccctggtccaactgtctaaaaggccagttgttcctttctgtggatgtggatgtctggccttcacctgaggtagagcggggactataaacacacatcaactttctttctgtttgctttcttttccttcttttcaaactcttaaactcaggcctttatgctgtgagtgactagtccaagaagcacacattttgtagtagtcctgcaccagccctgctcttgaataaaaaggaaaattactggctgcacccaaatcttctagtacttgagtaataagcatcaggcattggaagaggttttaaatttgcttttttgaggaaaagaactgggggtggattttggcatcgtagcatatcgattaaagaataatcaggacatcagatacattttaatacatagctggggccttatgttgtagatgaagcttgctgtttttagcaagttcctgggtttcacattcatttctgctgcatctagtagctccacacatttcataacctgatctctttatttgtatgcaaaaaatactgtcttaatacagagcagcatttttgtaacaaagagactcgctggagctatttggtgcttgaatgtgaccatcctttttacttttgctaagccttatttaaattttgtataccgtggaatatgtagaatttgtcaaatcattttagtgctgaaggtttttgatttcttgtttttgtttctgttgttgcagtttctttggtggcttgttttgtattgtaagatggcacttgctgatataaatactaaggcactaagagaaaatacagataagtatttataagttgcttgggaaccatagcagaattttttgtttggttttgtaagagaaaaaaaattaccaataaataactgatctagcacccaaactctcttgggggatgtcttagtatcttcacgctataaaattgttcatctaagcacagcatcatcttatggccttatggattgtaaatcttctagtgaggctataaactccactctgaaaacaaaggcataacttaaccgactgctcagttgtccttcgttgtaaaatgaattggctttgggaaaaaggaaaaaaacaaacaaaaaaagaaaaagaaaaaagcctcctccttgcccctaatttttttttcccatatggttttagccattccccatcactatattgtgaagctgtaaaaatatatatatatactttacaagagtttactaatggatttcaaaactggtctcaacgtttataatacatatctgtgtttggcagttgtcataacccaatcctacattcagccatcgggacaagtctgtcggggaggtagttcatggtttacaagcctttgctttttaactgtccaatttcctttaaagcacaactagctatttgtttacaaatgatatttttatgtatattttgtatagtgtatcatcatttttgccaaatatgtttttcattataaatgagtaaagagtacttaaggttgcattcatgtattacatgtttgttgttgtaaacctctccaatcagctggtagaaattctcctcattgtgttctatttggtcagtctctgtgtgattgtaggatgtgctccttggtagtactcccagctgtagatttaccagcttaaaagtttgttaggatctgtgcaataaagtgtttgcagtcttattttctctaagaaattccttatggacgtcataattgttgtatattgaacaaaatatttatacttatgcagttgcataacattgaaataaaaatttagcatgaaaaga

SEQ ID NO: 4981 - DNA, 7586 bp, Homo sapiens
gtgctgaagtagaggtagtacagcatggctagactgttgtgagaggctcagagaaagcagagggtgagatggatgagtccagcattctaagacgaagagggctccagaaggagctgagtctccccagaagaggaagtttgatagattcccagaagtggaattgcttggtcaaacgttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaacggggagggcccaggggcaggactgtggagacccgtcctgaacgggcgactgtgtcttgactacctttcaaaaccagcactgtgtgggaatgtccgccaggcagagctcggagcctcattgagacaggggagagagaaagacaaagaggggaccttcttccagatgccttcccagttgtaaccggtaaaactgttaccagatagtgtttgtac

SEQ ID NO: 4982 - DNA, 10733 bp, Homo sapiens
caaggagaagccgcagtacccgcggctcgggtgcagcgcgggagcacagtggagcgcagatcgcggacccgagcgggcatgtccccgcgcgcgggagcctccgtttgcggccgggcccgggcggctgtgaacttagcagcgggctcctgcggccccgtcactgccatgtagtcgctggcggggctccctgcagcccgggagcggcagtgccagtgagcctgagcccaggagcccgcgtcttccccgggaggcgctgagtgcgcgccgcgcccccgccgctcgggaggcactttgggccagacagggaaatgggggagaaagtttcggaggcgccagagccggtgccccgcggctgcagtggccacggcagccggactccagcctctgcgctggtcgccgcgtcctctccgggtgcttcctcggccgagtcctcctcgggctcagaaactctgtcggaggaaggggagcccggcggcttctccagagagcatcagccgccgccgccgccgccgttgggaggcaccctgggcgcccgggcgcccgccgcgtgggctccggcaagcgtgctgctggagcgcggagtccttgcgctgccgccgccgcttcccggaggagctgtgccgcccgcgccccggggcagcagcgcgtcccaggaggagcaggacgaggagcttgaccacatattatcccctccacccatgccgtttcggaaatgcagcaacccagatgtggcttctggccctggaaaatcactgaagtataaaagacagctgagtgaggatggaagacagctaaggcgagggagcctgggaggagccctgactgggaggtaccttcttccaaacccggtggcgggacaggcctggccggcctctgcagagacgtccaacctcgtgcgcatgcgcagccaggccctgggccagtcggcgccctcgctcaccgccagcctgaaggagctgagtctccccagaagaggaagtttttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggagtctcaataggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaacggggagggcccaggggcaggactgtggagacccgtcctgaacgggcgactgtgtcttgactacctttcaaaaccagcactgtgtgggaatgtccgccaggcagagctcggagcctcattgagacaggggagagagaaagacaaagaggggaccttcttccagatgccttcccagttgtaaccggtaaaactgttaccagatagtgtttgtacaaaaaaaaaaaaaaaaaaaaaaaaaaaaattacctttacagttgagggttgttgaggaaaatgattttctttgtaaatatatagcatcgtgtttggtttgggatgtagagtctatacctggctgctgattgcgtcgtttactacagctttttttaaataagatttttgctttaccatttatcataatgtagtaatgaagcaaaatggtcaaaactgggtgtgtgtgaacagagatacacccatattcgtgtatatacacatccacctacatgttttggtctgtggtttaagagactatttcaaggttccatttttataagctaaaacattctaagttaagatggaagaaagccctaaacacagtagattctgagtttttatgtgtattttaaccagagtttctgatagtactgtatctggctacctatatttccagatctaaagcaagaactactctaagtactgcatttggaatcctcctccattaggaatggccaggacaagtggagctagccattttcattacacggccatcccaatggacactggatccctggtccaactgtctaaaaggccagttgttcctttctgtggatgtggatgtctggccttcacctgaggtagagcggggactataaacacacatcaactttctttctgtttgctttcttttccttcttttcaaactcttaaactcaggcctttatgctgtgagtgactagtccaagaagcacacattttgtagtagtcctgcaccagccctgctcttgaataaaaaggaaaattactggctgcacccaaatcttctagtacttgagtaataagcatcaggcattggaagaggttttaaatttgcttttttgaggaaaagaactgggggtggattttggcatcgtagcatatcgattaaagaataatcaggacatcagatacattttaatacatagctggggccttatgttgtagatgaagcttgctgtttttagcaagttcctgggtttcacattcatttctgctgcatctagtagctccacacatttcataacctgatctctttatttgtatgcaaaaaatactgtcttaatacagagcagcatttttgtaacaaagagactcgctggagctatttggtgcttgaatgtgaccatcctttttacttttgctaagccttatttaaattttgtataccgtggaatatgtagaatttgtcaaatcattttagtgctgaaggtttttgatttcttgtttttgtttctgttgttgcagtttctttggtggcttgttttgtattgtaagatggcacttgctgatataaatactaaggcactaagagaaaatacagataagtatttataagttgcttgggaaccatagcagaattttttgtttggttttgtaagagaaaaaaaattaccaataaataactgatctagcacccaaactctcttgggggatgtcttagtatcttcacgctataaaattgttcatctaagcacagcatcatcttatggccttatggattgtaaatcttctagtgaggctataaactccactctgaaaacaaaggcataacttaaccgactgctcagttgtccttcgttgtaaaatgaattggctttgggaaaaaggaaaaaaacaaacaaaaaaagaaaaagaaaaaagcctcctccttgcccctaatttttttttcccatatggttttagccattccccatcactatattgtgaagctgtaaaaatatatatatatactttacaagagtttactaatggatttcaaaactggtctcaacgtttataatacatatctgtgtttggcagttgtcataacccaatcctacattcagccatcgggacaagtctgtcggggaggtagttcatggtttacaagcctttgctttttaactgtccaatttcctttaaagcacaactagctatttgtttacaaatgatatttttatgtatattttgtatagtgtatcatcatttttgccaaatatgtttttcattataaatgagtaaagagtacttaaggttgcattcatgtattacatgtttgttgttgtaaacctctccaatcagctggtagaaattctcctcattgtgttctatttggtcagtctctgtgtgattgtaggatgtgctccttggtagtactcccagctgtagatttaccagcttaaaagtttgttaggatctgtgcaataaagtgtttgcagtcttattttctctaagaaattccttatggacgtcataattgttgtatattgaacaaaatatttatacttatgcagttgcataacattgaaataaaaatttagcatgaaaaga

SEQ ID NO: 4983 - DNA, 7713 bp, Homo sapiens
ttatttttttgccccagtctgcagggtgaaaaggacttttcatttcactgaggtgaaaagtgggtctgtgagtagagcgactttctttaaaaaaaaaaaaaaaaatcagaaaccaattacttgatatgcagagctgcaagcctcgttcctttaacaaaatcagtgcagtgtgcactgccgttaacctgaggaaagcagctgacatctcttgattacggctagaggtggaaggacccaaacttgcagcctccccctccccctcgagagagtgttagtccagtcctttagagaggttcggtttggctctctgtcatcaccgggacgctggcagggagtgtgtgtcatggttacaatagagtgtgctaacatataacaaccatgaaagcccagcgggaaaggctacagattccggggctgaccttggatctcactcccaggagcctgagtccaaccccatccagcccaggcagtccttgtagtcctctcttggcctttcacttttggagttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggagaaatgacaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaa

SEQ ID NO: 4984 - DNA, 1066 bp, Homo sapiens
gcagcgcgggagcacagtggagcgcagatcgcggacccgagcgggcatgtccccgcgcgcgggagcctccgtttgcggccgggcccgggcggctgtgaacttagcagcgggctcctgcggccccgtcactgccatgtagtcgctggcggggctccctgcagcccgggagcggcagtgccagtgagcctgagcccaggagcccgcgtcttccccgggaggcgctgagtgcgcgccgcgcccccgccgctcgggaggcactttgggccagacagggaaatgggggagaaagtttcggaggcgccagagccggtgccccgcggctgcagtggccacggcagccggactccagcctctgcgctggtcgccgcgtcctctccgggtgcttcctcggccgagtcctcctcgggctcagaaactctgtcggaggaaggggagcccggcggcttctccagagagcatcagccgccgccgccgccgccgttgggaggcaccctgggcgcccgggcgcccgccgcgtgggctccggcaagcgtgctgctggagcgcggagtccttgcgctgccgccgccgcttcccggaggagctgtgccgcccgcgccccggggcagcagcgcgtcccaggaggagcaggacgaggagcttgaccacatattatcccctccacccatgccgtttcggaaatgcagcaacccagatgtggcttctggccctggaaaatcactgaagtataaaagacagctgagtgaggatggaagacagctaaggcgagggagcctgggaggagccctgactgggaggtaccttcttccaaacccggtggcgggacaggcctggccggcctctgcagagacgtccaacctcgtgcgcatgcgcagccaggccctgggccagtcggcgccctcgctcaccgccagcctgaaggagctgagtctccccagaagaggaagtttgatagattcccagaagtggaattgcttggtcaaacgccctgtgtgtccaaatgctgggagaacatcaccccttggatgaattgccaccacattaaataaaacatatccaaagctca

SEQ ID NO: 4985 - DNA, 9633 bp, Homo sapiens
atggatatgtctgaccccaatttttggactgtgctctcaaactttactttgcctcatttgaggagtgggaacaggcttcggcgaacacaaagttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaacggggagggcccaggggcaggactgtggagacccgtcctgaacgggcgactgtgtcttgactacctttcaaaaccagcactgtgtgggaatgtccgccaggcagagctcggagcctcattgagacaggggagagagaaagacaaagaggggaccttcttccagatgccttcccagttgtaaccggtaaaactgttaccagatagtgtttgtacaaaaaaaaaaaaaaaaaaaaaaaaaaaaattacctttacagttgagggttgttgaggaaaatgattttctttgtaaatatatagcatcgtgtttggtttgggatgtagagtctatacctggctgctgattgcgtcgtttactacagctttttttaaataagatttttgctttaccatttatcataatgtagtaatgaagcaaaatggtcaaaactgggtgtgtgtgaacagagatacacccatattcgtgtatatacacatccacctacatgttttggtctgtggtttaagagactatttcaaggttccatttttataagctaaaacattctaagttaagatggaagaaagccctaaacacagtagattctgagtttttatgtgtattttaaccagagtttctgatagtactgtatctggctacctatatttccagatctaaagcaagaactactctaagtactgcatttggaatcctcctccattaggaatggccaggacaagtggagctagccattttcattacacggccatcccaatggacactggatccctggtccaactgtctaaaaggccagttgttcctttctgtggatgtggatgtctggccttcacctgaggtagagcggggactataaacacacatcaactttctttctgtttgctttcttttccttcttttcaaactcttaaactcaggcctttatgctgtgagtgactagtccaagaagcacacattttgtagtagtcctgcaccagccctgctcttgaataaaaaggaaaattactggctgcacccaaatcttctagtacttgagtaataagcatcaggcattggaagaggttttaaatttgcttttttgaggaaaagaactgggggtggattttggcatcgtagcatatcgattaaagaataatcaggacatcagatacattttaatacatagctggggccttatgttgtagatgaagcttgctgtttttagcaagttcctgggtttcacattcatttctgctgcatctagtagctccacacatttcataacctgatctctttatttgtatgcaaaaaatactgtcttaatacagagcagcatttttgtaacaaagagactcgctggagctatttggtgcttgaatgtgaccatcctttttacttttgctaagccttatttaaattttgtataccgtggaatatgtagaatttgtcaaatcattttagtgctgaaggtttttgatttcttgtttttgtttctgttgttgcagtttctttggtggcttgttttgtattgtaagatggcacttgctgatataaatactaaggcactaagagaaaatacagataagtatttataagttgcttgggaaccatagcagaattttttgtttggttttgtaagagaaaaaaaattaccaataaataactgatctagcacccaaactctcttgggggatgtcttagtatcttcacgctataaaattgttcatctaagcacagcatcatcttatggccttatggattgtaaatcttctagtgaggctataaactccactctgaaaacaaaggcataacttaaccgactgctcagttgtccttcgttgtaaaatgaattggctttgggaaaaaggaaaaaaacaaacaaaaaaagaaaaagaaaaaagcctcctccttgcccctaatttttttttcccatatggttttagccattccccatcactatattgtgaagctgtaaaaatatatatatatactttacaagagtttactaatggatttcaaaactggtctcaacgtttataatacatatctgtgtttggcagttgtcataacccaatcctacattcagccatcgggacaagtctgtcggggaggtagttcatggtttacaagcctttgctttttaactgtccaatttcctttaaagcacaactagctatttgtttacaaatgatatttttatgtatattttgtatagtgtatcatcatttttgccaaatatgtttttcattataaatgagtaaagagtacttaaggttgcattcatgtattacatgtttgttgttgtaaacctctccaatcagctggtagaaattctcctcattgtgttctatttggtcagtctctgtgtgattgtaggatgtgctccttggtagtactcccagctgtagatttaccagcttaaaagtttgttaggatctgtgcaataaagtgtttgcagtcttattttctctaagaaattccttatggacgtcataattgttgtatattgaacaaaatatttatacttatgcagttgcataacattgaaataaaaatttagcatgaaaaga

SEQ ID NO: 4986 - DNA, 582 bp, Homo sapiens
agacagcgctttgagcagaacgcacggctcaactcattcatatggccttgaacccacagtgaattgaagagagaaagaaatggatatgtctgaccccaatttttggactgtgctctcaaactttactttgcctcatttgaggagtgggaacaggcttcggcgaacacaaagttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcc

SEQ ID NO: 4987 - DNA, 10713 bp, Homo sapiens
cgcagtacccgcggctcgggtgcagcgcgggagcacagtggagcgcagatcgcggacccgagcgggcatgtccccgcgcgcgggagcctccgtttgcggccgggcccgggcggctgtgaacttagcagcgggctcctgcggccccgtcactgccatgtagtcgctggcggggctccctgcagcccgggagcggcagtgccagtgagcctgagcccaggagcccgcgtcttccccgggaggcgctgagtgcgcgccgcgcccccgccgctcgggaggcactttgggccagacagggaaatgggggagaaagtttcggaggcgccagagccggtgccccgcggctgcagtggccacggcagccggactccagcctctgcgctggtcgccgcgtcctctccgggtgcttcctcggccgagtcctcctcgggctcagaaactctgtcggaggaaggggagcccggcggcttctccagagagcatcagccgccgccgccgccgccgttgggaggcaccctgggcgcccgggcgcccgccgcgtgggctccggcaagcgtgctgctggagcgcggagtccttgcgctgccgccgccgcttcccggaggagctgtgccgcccgcgccccggggcagcagcgcgtcccaggaggagcaggacgaggagcttgaccacatattatcccctccacccatgccgtttcggaaatgcagcaacccagatgtggcttctggccctggaaaatcactgaagtataaaagacagctgagtgaggatggaagacagctaaggcgagggagcctgggaggagccctgactgggaggtaccttcttccaaacccggtggcgggacaggcctggccggcctctgcagagacgtccaacctcgtgcgcatgcgcagccaggccctgggccagtcggcgccctcgctcaccgccagcctgaaggagctgagtctccccagaagaggaagtttttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaacggggagggcccaggggcaggactgtggagacccgtcctgaacgggcgactgtgtcttgactacctttcaaaaccagcactgtgtgggaatgtccgccaggcagagctcggagcctcattgagacaggggagagagaaagacaaagaggggaccttcttccagatgccttcccagttgtaaccggtaaaactgttaccagatagtgtttgtacaaaaaaaaaaaaaaaaaaaaaaaaaaaaattacctttacagttgagggttgttgaggaaaatgattttctttgtaaatatatagcatcgtgtttggtttgggatgtagagtctatacctggctgctgattgcgtcgtttactacagctttttttaaataagatttttgctttaccatttatcataatgtagtaatgaagcaaaatggtcaaaactgggtgtgtgtgaacagagatacacccatattcgtgtatatacacatccacctacatgttttggtctgtggtttaagagactatttcaaggttccatttttataagctaaaacattctaagttaagatggaagaaagccctaaacacagtagattctgagtttttatgtgtattttaaccagagtttctgatagtactgtatctggctacctatatttccagatctaaagcaagaactactctaagtactgcatttggaatcctcctccattaggaatggccaggacaagtggagctagccattttcattacacggccatcccaatggacactggatccctggtccaactgtctaaaaggccagttgttcctttctgtggatgtggatgtctggccttcacctgaggtagagcggggactataaacacacatcaactttctttctgtttgctttcttttccttcttttcaaactcttaaactcaggcctttatgctgtgagtgactagtccaagaagcacacattttgtagtagtcctgcaccagccctgctcttgaataaaaaggaaaattactggctgcacccaaatcttctagtacttgagtaataagcatcaggcattggaagaggttttaaatttgcttttttgaggaaaagaactgggggtggattttggcatcgtagcatatcgattaaagaataatcaggacatcagatacattttaatacatagctggggccttatgttgtagatgaagcttgctgtttttagcaagttcctgggtttcacattcatttctgctgcatctagtagctccacacatttcataacctgatctctttatttgtatgcaaaaaatactgtcttaatacagagcagcatttttgtaacaaagagactcgctggagctatttggtgcttgaatgtgaccatcctttttacttttgctaagccttatttaaattttgtataccgtggaatatgtagaatttgtcaaatcattttagtgctgaaggtttttgatttcttgtttttgtttctgttgttgcagtttctttggtggcttgttttgtattgtaagatggcacttgctgatataaatactaaggcactaagagaaaatacagataagtatttataagttgcttgggaaccatagcagaattttttgtttggttttgtaagagaaaaaaaattaccaataaataactgatctagcacccaaactctcttgggggatgtcttagtatcttcacgctataaaattgttcatctaagcacagcatcatcttatggccttatggattgtaaatcttctagtgaggctataaactccactctgaaaacaaaggcataacttaaccgactgctcagttgtccttcgttgtaaaatgaattggctttgggaaaaaggaaaaaaacaaacaaaaaaagaaaaagaaaaaagcctcctccttgcccctaatttttttttcccatatggttttagccattccccatcactatattgtgaagctgtaaaaatatatatatatactttacaagagtttactaatggatttcaaaactggtctcaacgtttataatacatatctgtgtttggcagttgtcataacccaatcctacattcagccatcgggacaagtctgtcggggaggtagttcatggtttacaagcctttgctttttaactgtccaatttcctttaaagcacaactagctatttgtttacaaatgatatttttatgtatattttgtatagtgtatcatcatttttgccaaatatgtttttcattataaatgagtaaagagtacttaaggttgcattcatgtattacatgtttgttgttgtaaacctctccaatcagctggtagaaattctcctcattgtgttctatttggtcagtctctgtgtgattgtaggatgtgctccttggtagtactcccagctgtagatttaccagcttaaaagtttgttaggatctgtgcaataaagtgtttgcagtcttattttctctaagaaattccttatggacgtcataattgttgtatattgaacaaaatatttatacttatgcagttgcataacattgaaataaaaatttagcatgaaaaga

SEQ ID NO: 4988 - DNA, 1200 bp, Homo sapiens
tgtcgactatcaggtgagctttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccacccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcggtggtccgtactccacccaagtcgccgtcttccgccaagagccgcctgcagacagcccccgtgcccatgccagacctgaagaacgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggt

SEQ ID NO: 4989 - DNA, 2438 bp, Homo sapiens
caggtgagctttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccacccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcggtggtccgtactccacccaagtcgccgtcttccgccaagagccgcctgcagacagcccccgtgcccatgccagacctgaagaacgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataatcgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatattttaaaaaaaaacattcaaaaacatggccacatccaacatttcctcaggcaattccttttgattcttttttcttcccccctccatgtagaagagggggaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccaccggcatctctggagtgtgtgggggtctgggaggcgggtcccgagccccctgtccttcccacggccactgcagtcacccctgtctgccccgctgtgctgttgtctgccgt

SEQ ID NO: 4990 - DNA, 2525 bp, Homo sapiens
caggtgagctttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccacccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcggtggtccgtactccacccaagtcgccgtcttccgccaagagccgcctgcagacagcccccgtgcccatgccagacctgaagaacgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataatcgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatattttaaaaaaaaacattcaaaaacatggccacatccaacatttcctcaggcaattccttttgattcttttttcttcccccctccatgtagaagagggggaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccaccggcatctctggagtgtgtgggggtctgggaggcgggtcccgagccccctgtccttcccacggccactgcagtcacccctgtctgccccgctgtgctgttgtctgccgt

SEQ ID NO: 4991 - DNA, 1974 bp, Homo sapiens
actcgggaggctgagggggctgatggtaaaacgaagatcgccacaccgaagggccaggccaacgccaccaggattccagcaaaaaccccacccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcggtggtccgtactccacccaagtcgccgtcttccgccaagagccgcctgcagacagcccccgtgcccatgccagacctgaagaacgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataatcgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatattttaaaaaaaaacattcaaaaacatggccacatccaacatttcctcaggcaattccttttgattcttttttcttcccccctccatgtagaagagggggaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccaccggcatctctggagtgtgtgggggtctgggaggcgggtcccgagccccctgtccttcccacggccactgcagtcacccctgtctgccccgctgtgctgttgtctgccgt

SEQ ID NO: 4992 - DNA, 1830 bp, Homo sapiens
atggctgagccccgccaggagttcgaagtgatggaagatcacgctgggacgtacgggttgggggacaggaaagatcagcgggagcccaagaaggtggcggtggtccgtactccacccaagtcgccgtcttccgccaagagccgcctgcagacagcccccgtgcccatgccagacctgaagaacgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataatcgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatattttaaaaaaaaacattcaaaaacatggccacatccaacatttcctcaggcaattccttttgattcttttttcttcccccctccatgtagaagagggggaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccaccggcatctctggagtgtgtgggggtctgggaggcgggtcccgagccccctgtccttcccacggccactgcagtcacccctgtctgccccgctgtgctgttgtctgccgt

SEQ ID NO: 4993 - DNA, 2351 bp, Homo sapiens
caggtgagctttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccacccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcggtggtccgtactccacccaagtcgccgtcttccgccaagagccgcctgcagacagcccccgtgcccatgccagacctgaagaacgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataatcgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatattttaaaaaaaaacattcaaaaacatggccacatccaacatttcctcaggcaattccttttgattcttttttcttcccccctccatgtagaagagggggaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccaccggcatctctggagtgtgtgggggtctgggaggcgggtcccgagccccctgtccttcccacggccactgcagtcacccctgtctgccccgctgtgctgttgtctgccgt

SEQ ID NO: 4994 - DNA, 2130 bp, Homo sapiens
atgctaagagcactccaacagcggaagcgtgaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccacccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcggtggtccgtactccacccaagtcgccgtcttccgccaagagccgcctgcagacagcccccgtgcccatgccagacctgaagaacgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataatcgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatattttaaaaaaaaacattcaaaaacatggccacatccaacatttcctcaggcaattccttttgattcttttttcttcccccctccatgtagaagagggggaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccaccggcatctctggagtgtgtgggggtctgggaggcgggtcccgagccccctgtccttcccacggccactgcagtcacccctgtctgccccgctgtgctgttgtctgccgt

SEQ ID NO: 4995 - DNA, 3476 bp, Homo sapiens
caggtgagctttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgctgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccaacgggcccagtgcagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagctgggtccctcaactcaaagctcgcatggtcagtaaaagcaaagacgggactggaagcgatgacaaaaaagccaagacatccacacgttcctctgctaaaaccttgaaaaataggccttgccttagccccaaacaccccactcctggtagctcagaccctctgatccaaccctccagccctgctgtgtgcccagagccaccttcctctcctaaatacgtctcttctgtcactccccgaactggcagttctggagcaaaggagatgaaactcaagggggctgatggtaaaacgaagatcgccacaccgcggggagcagcccctccaggccagaagggccaggccaacgccaccaggattccagcaaaaaccccacccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcggtggtccgtactccacccaagtcgccgtcttccgccaagagccgcctgcagacagcccccgtgcccatgccagacctgaagaacgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataatcgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatattttaaaaaaaaacattcaaaaacatggccacatccaacatttcctcaggcaattccttttgattcttttttcttcccccctccatgtagaagagggggaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccaccggcatctctggagtgtgtgggggtctgggaggcgggtcccgagccccctgtccttcccacggccactgcagtcacccctgtctgccccgctgtgctgttgtctgccgt

SEQ ID NO: 4996 - DNA, 3530 bp, Homo sapiens
caggtgagctttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgctgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccaacgggcccagtgcagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagctgggtccctcaactcaaagctcgcatggtcagtaaaagcaaagacgggactggaagcgatgacaaaaaagccaagacatccacacgttcctctgctaaaaccttgaaaaataggccttgccttagccccaaacaccccactcctggtagctcagaccctctgatccaaccctccagccctgctgtgtgcccagagccaccttcctctcctaaatacgtctcttctgtcactccccgaactggcagttctggagcaaaggagatgaaactcaagggggctgatggtaaaacgaagatcgccacaccgcggggagcagcccctccaggccagaagggccaggccaacgccaccaggattccagcaaaaaccccacccgctccaaagacaccacccagctctgcgaccaagcaagtccagagaagaccaccccctgcagggcccagatctgagagaggtgaacctccaaaatcaggggatcgcagcggctacagcagccccggctccccaggcactcccggcagccgctcccgcaccccgtcccttccaaccccacccacccgggagcccaagaaggtggcggtggtccgtactccacccaagtcgccgtcttccgccaagagccgcctgcagacagcccccgtgcccatgccagacctgaagaacgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataatcgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatattttaaaaaaaaacattcaaaaacatggccacatccaacatttcctcaggcaattccttttgattcttttttcttcccccctccatgtagaagagggggaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccaccggcatctctggagtgtgtgggggtctgggaggcgggtcccgagccccctgtccttcccacggccactgcagtcacccctgtctgccccgctgtgctgttgtctgccgt

SEQ ID NO: 4997 - DNA, 2432 bp, Homo sapiens
caggtgagctttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccacccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcggtggtccgtactccacccaagtcgccgtcttccgccaagagccgcctgcagacagcccccgtgcccatgccagacctgaagaacgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataatcgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatattttaaaaaaaaacattcaaaaacatggccacatccaacatttcctcaggcaattccttttgattcttttttcttcccccctccatgtagaagagggggaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccaccggcatctctggagtgtgtgggggtctgggaggcgggtcccgagccccctgtccttcccacggccactgcagtcacccctgtctgccccgctgtgctgttgtctgccgt

SEQ ID NO: 4998 - DNA, 1573 bp, Homo sapiens
gaccaatcaagacggccggccgaggcccctggaacggctcaggcggctgcggctgctacggcggcgcatgctaggggattctgccgggtagaagagctgggcctggaacccagccctgaggacatcctgcggcccaggggcaagtgacacctgctgagagaggcccaggatggtggaggctgaggaactggcacagctgcggctgctcaatctggagctcctgaggcagctgtgggtggggcaggatgctgtgcggcggtcagtggccagggcagcctcggagtcaagcctggaatccagcagcagctacaactcagagactccatcgaccccagagacgtcctcaacttccttgagcacctcctgcccacggggccggtcctccgtgtggggcccaccagatgcctgtcgaggggacctccgtgatgtggccagatcgggggtggcctctctcccacctgccaaatgccagcaccaggagtccctgggccgaccgagaccccactcagcaccctcgctgggcacctcaagcctgagggacccagagccctcagggaggctgggtgatccaggaccccaggaggcacagaccccgaggtccatcctggctcaacagagcaagctgtccaagcccagggtgaccttctctgaggagtctgcagttcctaagaggagctggcgcctcaggccatacctgggctatgactggattgcagggtctctggacaccagctcttccatcaccagccagcctgaggccttcttctccaagctgcaggagtttcgggaaaccaacaaggaggagtgtatctgcagccatcctgaaccccagttgccaggcctgcgtgagagcagtggcagcggcgtggaggaagaccatgaatgcgtgtactgttaccgtgtcaaccggcgcctgttcccggtgcctgtggatcccggtaccccctgccgcctgtgcaggacaccgcgagaccagcagggccctgggaccctggcgcagccagcgcacgtcagggtgagcatcccgctgtcgatcctggagcccccgcaccggtaccacatccaccggcgaaagagctttgacgcctctgacacactggccctgccccggcactgcctgctgggctgggacatttttcctccgaagtctgagaaaagctcagcccccaggaacctggacctctggtcctctgtctccgctgaggcccagcaccagaagctgtccggcaccagcagcccttttcacccggcctcaccaatgcagatgctgcccccgaccccgacctggtcagtgccccaggtccctcggccccacgtcccacggcagaagccctgaggactgactcctgggggagaacagcattcccgccgcctccagcctctcccctctggcaggcgcacccaggagatggaatcccctgcccgcccagctcaggcccagctgtcctaggttgggcaggtgggtggacccaagcttgtctgctgcctgagttccagagagggaggaccctggggtggagggtgagggattctgtggaagtttgtaaataaagctcagtgctctgcagctcaa

SEQ ID NO: 4999 - DNA, 1402 bp, Homo sapiens
atgctaggggattctgccgggtagaagagctgggcctggaacccagccctgaggacatcctgcggcccaggggcaagtgacacctgctgagagaggcccaggatggtggaggctgaggaactggcacagctgcggctgctcaatctggagctcctgaggcagctgtgggtggggcaggatgctgtgcggcggtcagtggccagggcagcctcggagtcaagcctggaatccagcagcagctacaactcagagactccatcgaccccagagacgtcctcaacttccttgagcacctcctgcccacggggccggtcctccgtgtggggcccaccagatgcctgtcgaggggacctccgtgatgtggccagatcgggggtggcctctctcccacctgccaaatgccagcaccaggagtccctgggccgaccgagaccccactcagcaccctcgctgggcacctcaagcctgagggacccagagccctcagggaggctgggtgatccaggaccccaggaggcacagaccccgaggtccatcctggctcaacagagcaagctgtccaagcccagggtgaccttctctgaggagtctgcagttcctaagaggagctggcgcctcaggccatacctgggctatgactggattgcagggtctctggacaccagctcttccatcaccagccagcctgaggccttcttctccaagctgcaggagtttcgggaaaccaacaaggaggagtgtatctgcagccatcctgaaccccagttgccaggcctgcgtgagagcagtggcagcggcgtggaggaagaccatgaatgcgtgtactgttaccgtgtcaaccggcgcctgttcccggtgcctgtggatcccggtaccccctgccgcctgtgcaggacaccgcgagaccagcagggccctgggaccctggcgcagccagcgcacgtcagcactgcctgctgggctgggacatttttcctccgaagtctgagaaaagctcagcccccaggaacctggacctctggtcctctgtctccgctgaggcccagcaccagaagctgtccggcaccagcagcccttttcacccggcctcaccaatgcagatgctgcccccgaccccgacctggtcagtgccccaggtccctcggccccacgtcccacggcagaagccctgaggactgactcctgggggagaacagcattcccgccgcctccagcctctcccctctggcaggcgcacccaggagatggaatcccctgcccgcccagctcaggcccagctgtcctaggttgggcaggtgggtggacccaagcttgtctgctgcctgagttccagagagggaggaccctggggtggagggtgagggattctgtggaagtttgtaaataaagctcagtgctctgc

SEQ ID NO: 5000 - DNA, 2444 bp, Homo sapiens
gttgatatggcttgcttgtttcctcaggtctgacggtaactgctgtaaaagactcaggagaatggaatttggaggctggggcattagttcttgcagatgcgggcctttgctgtattgatgagttcaatagcctcaaagagcatgataggaccagtatccatgaagcaatggagcaacaaaccataagtgttgctaaggctggcctcgtgtgcaagctgaacacaaggaccaccatcctggcagcaacgaaccccaaaggccagtacgacccccaggagtccgtgtctgtgaacattgccctcggcagcccactcttaagtcgatttgacctgatcctggttttgcttgataccaagaatgaagactgggatcgtatcatttcctcctttatcttagaaaataaaggttacccaagcaaatcagagaagctctggagcatggaaaagatgaaaacctatttctgcctcataaggaatctgcagcccacactgtctgatgtgggcaatcaggttcttctccggtactaccagatgcaaaggcagagtgattgccggaacgctgcccggaccaccattcggctgttggaaagcttgatacgattagcagaagctcatgctcgcctgatgtttcgtgatactgtaactctggaagacgctattacggtggtgtcagtcatggagtcctcaatgcagggaggtgcactgctaggaggtgtgaatgccctccacacttcctttcctgaaaaccctggagagcagtaccagagacagtgtgaacttattctggaaaagctagagctgcagagcctcttgagtgaagagcttagaagacttgaaaggttacagaatcagagtgtgcaccaatcccaaccacgggtattggaggtagagactactccaggatccttgagaaatggtccaggggaagaatcaaacttcagaacttcatcacagcaggaaatcaactatagcacacatatcttctctcctggaggcagccccgagggaagcccagttctagatcccccaccgcatctggagcctaatagatcaacaagtaggaaacattcagctcagcacaaaaataacagagatgacagtttagattggtttgatttcatggcaactcatcagagtgaacctaaaaacactgttgttgtgtctcctcatcccaaaacatctggagaaaatatggcttcgaagatctctaacagcacatctcagggtaaggagaagagtgagccaggccaaaggagcaaagtggacattgggttgcttccatcaccaggagagacaggtgttccatggagggcagacaatgtggaaagtaacaagaaaaaaaggctagcactagattctgaagcagcagtctctgctgataaaccagactcagtactgactcatcatgtccccaggaacctgcagaagctgtgcaaagagagggcccagaagttgtgcagaaatagcaccagggtgcctgcacagtgcacagtcccttcccatcctcagtccactcctgtacatagcccagacagaatgctggactcacccaaaagaaagagaccgaaatcccttgcgcaagtggaagagcctgcaattgaaaatgttaagcctccaggttcccctgtggccaaactggcaaaatttactttcaagcagaagtcaaaactgatccactcctttgaagatcacagccatgtgtcacctggtgcaactaaaatagcagttcatagtcctaaaatttcccagcgtagaacaagaagagacgcagccttgccggtgaagcgtccaggaaagttaacatctaccccaggaaaccagatctccagtcagccacagggtgagacaaaggaggtgtcgcagcagccaccagagaaacacggaccaagagagaaggtgatgtgtgcccctgagaagaggattattcagcctgaattagagcttgggaacgagactgggtgtgctcatcttacttgtgagggagacaaaaaggaagaggtttcaggcagtaataaaagcggcaaggttcatgcctgcacattagccagattggcaaacttctgctttactcccccatcggaatccaaatcaaaatcccctcctcctgaaaggaagaaccgaggtgagagaggcccaagctcccctcctacaaccacagctccaatgcgtgtcagtaaaaggaaatcttttcagctccgtgggtccaccgagaaactgattgtttccaaagaatccctcttcactttaccagaactaggtgatgaagcatttgattgtgactgggatgaagagatgagaaaaaagtcatagttgggaaaagctttctggtcaaatctcaccttcttcaactccacagaggaccttcaggatatcaatatggtatttataaatgtatagaacaattggccatattgaggatcactctgaatactggctcccccttaa

SEQ ID NO: 5001 - DNA, 2442 bp, Homo sapiens
ccggcgtcggtcgagagcgcaggcccggcagagccgcaggcgctaggccgcccgacacagcccgcgcgtccccgcggccggtggcgcctcgagcggccacgtgcacgcgcgcactccgcctcaccagccttcttgcgccggagacgaacccgctgcctggctggagctctctgggcccttcggcctcgggagcaacgcgttcccggcgacttctgacacagccattacctagattcaagatgaatagcgatcaagttacactggttggtcaagtgtttgagtcatatgtttcggaataccataagaatgatattcttctaatcttgaaggaaagggatgaagatgctcattacccagttgtggttaatgccatgactctgtttgagaccaacatggaaatcggggaatatttcaacatgttccccagtgaagtgcttacaatttttgatagtgcactgcgaaggtcagccttgacaattctccagtccctttctcagcctgaggctgtttccatgaaacagaatcttcatgccaggatatcaggtttgcctgtctgtcctgagctggtgagggaacacatacctaaaaccaaggatgtgggacactttttatctgtcactgggacagtgattcgaacaagtctggtgaaggttctggagtttgagcgggattacatgtgtaacaaatgcaagcatgtgtttgtgatcaaggctgactttgagcagtattacaccttttgccggccatcctcgtgtcccagcttggagagctgtgattcctctaaattcacttgcctctcaggcttgtcttcgtctccaaccaggtgtagagattaccaggaaatcaaaattcaggaacaggttcaaaggctatctgttggaagtattccacgatctatgaaggttattctggaagatgacttagtggatagttgcaaatctggtgatgacctcactatttacgggattgtaatgcaacggtggaagccctttcagcaagatgtgcgctgtgaagtggagatagtcctgaaagcaaattacatccaagtaaataatgagcagtcctcagggatcatcatggatgaggaggtccaaaaggaattcgaagatttttgggaatactataagagcgatccctttgcaggaaggaatgtaatattggctagcttgtgccctcaagtgtttggaatgtatctagtaaagcttgctgtggccatggtgctggctggtgggattcaaaggactgatgctacaggaacacgggtcagaggagaatctcatcttttattggttggggatcctggcacagggaaatctcagttcctcaaatatgcagcaaagattacaccaagatctgtgctgaccacaggaattggatctactagtgcaggtattgtatgtgacaatttcaagtaatttaacattacttcagaagttaacacaatggttttttctaatgaaaaactacctataataggataaatttcaagctaatttttgagttaccactaaaaatggaaggaaatatgcaatgttattttggtagctctaagaaaatatcttgcaagctccaccttcactttgcatcttagttttgaacaatcctattcaattttctcattctctagtgattaccttcatacttttatgcaggaaaaagtccgtatcatctggcattttatcaagactcagcaactggaatgttaaactaaagagggggatatttcactttaccaagtagatagatggtatagagcttaaggcattttcatgctcataaatctgataggcaacagtagctcctactgaaatttcttaggtagggaatgtttattaatatttggaaaatatacttccatcattgcaatgtggagcttcattcataagttgtaatgattctttagcaagtacacttaaaagcctttgcaggtagaatgtcaagatttgattataaataaagtgacccagggaatttagaaaaaaattattttaaaaaatatgtttgatgctattttgtatttttacagttttgattgggtaatgtttctgttcttctgaaaacagacccttggcttcacacattttaaaaatgtttgctacttgttaagggagtcagattaacttccattgggctaatgaatgctcaaatttctaatgagaaactaacactttaaaatttatcatacaacagaaaatggccaattaatggtcctgtataagtggaaaactgttaaggaggtctcaggttttgaaatataactcaacagtatattaaccattgacaagaatggatttttggaattgagaagggtagacaaacttcaggatactaggcaagaatatataaagaatatttcccatgcgttttaaatccgtatgacccagtgttctagagttctgtataaaatgataccaacaacaaataaagatgcttcccaagtaa

SEQ ID NO: 5002 - DNA, 5088 bp, Homo sapiens
tccatccggaagagccgccggggcagggaagttgaggcggtgcgcggcccggcgtcggtcgagagcgcaggcccggcagagccgcaggcgctaggccgcccgacacagcccgcgcgtccccgcggccggtggcgcctcgagcggccacgtgcacgcgcgcactccgcctcaccagccttcttgcgccggagacgaacccgctgcctggctggagctctctgggcccttcggcctcgggagcaacgcgttcccggcgacttctgacacagccattacctagattcaagatgaatagcgatcaagttacactggttggtcaagtgtttgagtcatatgtttcggaataccataagaatgatattcttctaatcttgaaggaaagggatgaagatgctcattacccagttgtggttaatgccatgactctgtttgagaccaacatggaaatcggggaatatttcaacatgttccccagtgaagtgcttacaatttttgatagtgcactgcgaaggtcagccttgacaattctccagtccctttctcagcctgaggctgtttccatgaaacagaatcttcatgccaggatatcaggtttgcctgtctgtcctgagctggtgagggaacacatacctaaaaccaaggatgtgggacactttttatctgtcactgggacagtgattcgaacaagtctggtgaaggttctggagtttgagcgggattacatgtgtaacaaatgcaagcatgtgtttgtgatcaaggctgactttgagcagtattacaccttttgccggccatcctcgtgtcccagcttggagagctgtgattcctctaaattcacttgcctctcaggcttgtcttcgtctccaaccaggtgtagagattaccaggaaatcaaaattcaggaacaggttcaaaggctatctgttggaagtattccacgatctatgaaggttattctggaagatgacttagtggatagttgcaaatctggtgatgacctcactatttacgggattgtaatgcaacggtggaagccctttcagcaagatgtgcgctgtgaagtggagatagtcctgaaagcaaattacatccaagtaaataatgagcagtcctcagggatcatcatggatgaggaggtccaaaaggaattcgaagatttttgggaatactataagagcgatccctttgcaggaaggaatgtaatattggctagcttgtgccctcaagtgtttggaatgtatctagtaaagcttgctgtggccatggtgctggctggtgggattcaaaggactgatgctacaggaacacgggtcagaggagaatctcatcttttattggttggggatcctggcacagggaaatctcagttcctcaaatatgcagcaaagattacaccaagatctgtgctgaccacaggaattggatctactagtgcaggtctgacggtaactgctgtaaaagactcaggagaatggaatttggaggctggggcattagttcttgcagatgcgggcctttgctgtattgatgagttcaatagcctcaaagagcatgataggaccagtatccatgaagcaatggagcaacaaaccataagtgttgctaaggctggcctcgtgtgcaagctgaacacaaggaccaccatcctggcagcaacgaaccccaaaggccagtacgacccccaggagtccgtgtctgtgaacattgccctcggcagcccactcttaagtcgatttgacctgatcctggttttgcttgataccaagaatgaagactgggatcgtatcatttcctcctttatcttagaaaataaaggttacccaagcaaatcagagaagctctggagcatggaaaagatgaaaacctatttctgcctcataaggaatctgcagcccacactgtctgatgtgggcaatcaggttcttctccggtactaccagatgcaaaggcagagtgattgccggaacgctgcccggaccaccattcggctgttggaaagcttgatacgattagcagaagctcatgctcgcctgatgtttcgtgatactgtaactctggaagacgctattacggtggtgtcagtcatggagtcctcaatgcagggaggtgcactgctaggaggtgtgaatgccctccacacttcctttcctgaaaaccctggagagcagtaccagagacagtgtgaacttattctggaaaagctagagctgcagagcctcttgagtgaagagcttagaagacttgaaaggttacagaatcagagtgtgcaccaatcccaaccacgggtattggaggtagagactactccaggatccttgagaaatggtccaggggaagaatcaaacttcagaacttcatcacagcaggaaatcaactatagcacacatatcttctctcctggaggcagccccgagggaagcccagttctagatcccccaccgcatctggagcctaatagatcaacaagtaggaaacattcagctcagcacaaaaataacagagatgacagtttagattggtttgatttcatggcaactcatcagagtgaacctaaaaacactgttgttgtgtctcctcatcccaaaacatctggagaaaatatggcttcgaagatctctaacagcacatctcagggtaaggagaagagtgagccaggccaaaggagcaaagtggacattgggttgcttccatcaccaggagagacaggtgttccatggagggcagacaatgtggaaagtaacaagaaaaaaaggctagcactagattctgaagcagcagtctctgctgataaaccagactcagtactgactcatcatgtccccaggaacctgcagaagctgtgcaaagagagggcccagaagttgtgcagaaatagcaccagggtgcctgcacagtgcacagtcccttcccatcctcagtccactcctgtacatagcccagacagaatgctggactcacccaaaagaaagagaccgaaatcccttgcgcaagtggaagagcctgcaattgaaaatgttaagcctccaggttcccctgtggccaaactggcaaaatttactttcaagcagaagtcaaaactgatccactcctttgaagatcacagccatgtgtcacctggtgcaactaaaatagcagttcatagtcctaaaatttcccagcgtagaacaagaagagacgcagccttgccggtgaagcgtccaggaaagttaacatctaccccaggaaaccagatctccagtcagccacagggtgagacaaaggaggtgtcgcagcagccaccagagaaacacggaccaagagagaaggtgatgtgtgcccctgagaagaggattattcagcctgaattagagcttgggaacgagactgggtgtgctcatcttacttgtgagggagacaaaaaggaagaggtttcaggcagtaataaaagcggcaaggttcatgcctgcacattagccagattggcaaacttctgctttactcccccatcggaatccaaatcaaaatcccctcctcctgaaaggaagaaccgaggtgagagaggcccaagctcccctcctacaaccacagctccaatgcgtgtcagtaaaaggaaatcttttcagctccgtgggtccaccgagaaactgattgtttccaaagaatccctcttcactttaccagaactaggtgatgaagcatttgattgtgactgggatgaagagatgagaaaaaagtcatagttgggaaaagctttctggtcaaatctcaccttcttcaactccacagaggaccttcaggatatcaatatggtatttataaatgtatagaacaattggccatattgaggatcactctgaatactggctcccccttaaggctttctaatttcaggttaatcttcatgacttaaaaagttgtataatcagttgaggtcagtgtgataccagcagctgagctgaattaattatgttgtgcttaattttacaaatggagtacttgtattcctgttcctgaagctgtttctgttttttgttttgttttgtttttaagggggagaggttcttccctagattaatttcttctttcattcactcaggaacaaatgtcaagaaggtagcactcataaatctaacaaggcagatgaactcttttctactttttttttttttttttgtattttcacctggaatgggctaagtacagtgaatataatcacttggatgatttgccaaaatcagactatttttctagtattatttttgtattgatttgtgtggatcaggttaaatgtgactaatgcttttctttctttgagaggtatccttacaattccatgatgttcttagagatctggccactggtcaaacagtacctttctgaagtactgaccttctgagttgtcctttctttcttgagccaacattttgtacttcagattcttttttctcttgggggcctaccttcaaccaagtaaaatactgtgattagaagaagagagagtatgagccaggcacagtgactcactcctgtagtcctagctactcggggaggctgaggcaggatgattgcttaagcccaggagttcggggttacagtgagctgtggtcacaccactgtattccagcctgggtgacagagtgagatcctgtctctaaaaataaaataaatgaagaagagagactatgtggtagtctcaatcaaacatcatgtctcatctacccagctggttaatatggaaatgtgattcctactaagttgtgattcacttgtctttaaaaccaaggaaattatatactgtttttggtcagaatagataacctcaagctttgtctttctatgtgcttttaaaatcacttattcctttggattctaataagggttattaggattcagtaattatggactttctcttctgaagtgtgaatttgtaaactgattgtttaattgtcagagggacttttggacatagaatactcaaaactatatgtattttgtttaattttcacttcattcaattcacgcattgaaaacaaatttagaaaatccaatttttcttaagcatttaaacgttctaaaattcactaataaaattttctgaaaaaatttaaa

SEQ ID NO: 5003 - DNA, 752 bp, Homo sapiens
gagcggccacgtgcacgcgcgcactccgcctcaccagccttcttgcgccggagacgaacccgctgcctggctggagctctctgggcccttcggcctcgggagcaacgcgttcccggcgacttctgacacagccactgtttctgcagaacccagtagatttcctacggtaagaaagagaaagaaggaaacaaattcacttccaagtatgaatttctaaggacagtctgttaattattcatgtcagaactggctgtcagtctgattaatgttacctagattcaagatgaatagcgatcaagttacactggttggtcaagtgtttgagtcatatgtttcggaataccataagaatgatattcttctaatcttgaaggaaagggatgaagatgctcattacccagttgtggttaatgccatgactctgtttgagaccaacatggaaatcggggaatatttcaacatgttccccagtgaagtgcttacaatttttgatagtgcactgcgaaggtcagccttgacaattctccagtccctttctcagcctgaggctgtttccatgaaacagaatcttcatgccaggatatcaggtttgcctgtctgtcctgagctggtgagggaacacatacctaaaaccaaggatgtgggacactttttatctgtcactgggacagtgattcgaacaagtctggtgaaggttctggagtttgagcgggattacatgtgtaacaaatgcaagcatgtgtttgtgatca

SEQ ID NO: 5004 - DNA, 470 bp, Homo sapiens
gattcccggagacagctgggggatgccagtgcagttaggcactctcctgtcttcttttcgacgcttcgctgtggtcaagaggacaaactgtttctgcagaacccagtagatttcctacggtaagaaagagaaagaaggaaacaaattcacttccaagtatgaatttctaaggacagtctgttaattattcatgtcagaactggctgtcagtctgattaatgttacctagattcaagatgaatagcgatcaagttacactggttggtcaagtgtttgagtcatatgtttcggaataccataagaatgatattcttctaatcttgaaggaaagggatgaagatgctcattacccagttgtggttaatgccatgactctgtttgagaccaacatggaaatcggggaatatttcaacatgttccccagtgaagtgcttacaatttttgatagtgcactgcgaaggtcagccttg

SEQ ID NO: 5005 - DNA, 3453 bp, Homo sapiens
gctgggaaactccccttccaaggccgaggcgccgctgcgcgtcctccaggcgtggtggtggggtcgtgggtcccagcccagtggtccaggtcacgggccgcacggccgcggccgccatcttgcccgcgtccgggctcctgcggcgggcggggcggtgtcccggccggaagcggctgtgcggcggccgcgctgccacctcagggaaatttggatatgtgcagtgcatctcctcgaagatgctgatggtggaaatttcttgaaaccgctctcgtaatttgccacgtgctgttgcaaatattctggtgaatgaacacagaatcagcatggctttcctttgctgagaaatcactgatgggaagtgagacttgttaaacttgaaagtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaatgtgttgcctggtatcttaattatgatcctgaatgtctgctggcagttggacaagcaaatggtcgagttgtacttacaagccttggtcaagatcataactcaaagttcaaagatttgataggaaaagagtttgttccaaaacatgcacgacaatgtaatacccttgcctggaatccactggatagtaactggctagctgctggtttagataagcacagagctgacttttcagtgctaatatgggatatctgcagcaaatatactcctgatatagttcccatggaaaaagtgaaactttcagcaggtgaaactgaaacaacattattagtaacaaaaccactttatgagttaggacagaatgatgcttgtctgtctctttgttggcttccacgagaccagaaacttctccttgctggtatgcatcgtaacctagctatatttgatcttcggaatacaagccaaaagatgttcgtaaatacaaaagctgttcagggtgtgacggtagacccatatttccacgatcgtgttgcttccttctatgaaggtcaggttgcaatatgggatcttagaaaatttgagaagccagttttgacattgactgagcaaccaaaacccttaacaaaagtagcatggtgtcccactaggactggtctacttgccactttaacaagggatagtaatattattagattgtatgatatgcagcatacacccactcccattggggatgaaactgaacccacaataattgaaagaagtgtgcaaccttgtgacaattacattgcttcctttgcgtggcatccaacaagtcaaaatcgaatgatagttgtaactcccaaccgaacaatgtcagacttcactgtttttgaaaggatatctcttgcctggagcccaattacatctttaatgtgggcttgtggtcgtcatttatatgaatgtacggaagaagaaaatgataattctttagaaaaagatatagcaacgaagatgcgtcttcgggctttatcaaggtatggacttgatacagagcaggtgtggaggaaccacattttagctggaaatgaagatccacagctcaagtcactctggtatactctgcactttatgaagcaatacacagaagatatggatcagaaatctccaggcaacaaaggatcattggtttatgcaggaattaaatcaattgtaaagtcatcgttgggaatggtggaaagcagcagacataattggagtgggttggataagcaaagtgatattcaaaatttaaatgaagagagaatcttagctttacagctttgtgggtggataaagaaaggaacggatgtagacgtggggccatttttgaactcccttgtacaagaaggggaatgggaaagagctgctgctgtggcattgttcaacttggatattcgccgagcaatccaaatcctgaatgaaggggcatcttctgaaaaaggagatctgaatctcaatgtggtagcaatggctttatcgggttatacggatgagaagaactccctttggagagaaatgtgtagcacactgcgattacagctaaataacccgtatttgtgtgtcatgtttgcatttctgacaagtgaaacaggatcttacgatggagttttgtatgaaaacaaagttgcagtacgtgacagagtggcatttgcttgtaaattccttagtgatactcagttaaatagatacatcgaaaagttgaccaatgaaatgaaagaggctggaaatttggaaggaattttgcttacaggccttactaaagatggagtggacttaatggagagttatgttgatagaactggagatgttcaaacagcaagttactgtatgttacagggttcacctttagatgttcttaaagatgaaagggttcagtactggattgagaattatagaaatttattagatgcctggaggttttggcataaacgagctgaatttgatattcacaggagtaagttggatcccagttccaagcctttagcacaagtttttgtgagttgcaatttctgtggcaagtcaatctcctacagctgttcagctgtgcctcatcagggcagaggttttagtcagtatggtgtgagtggctcaccaacgaaatctaaagtcacaagttgtcctggctgtcgaaaaccacttcctcgatgtgcgctttgtctcattaatatgggaacaccagtttctagctgtcctggaggaaccaaatcagatgaaaaagtggacttgagcaaggacaaaaaattagcccaatttaacaactggtttacatggtgtcataattgcaggcacggtggacatgctggacatatgcttagttggttcagggaccatgcagagtgccctgtgtcggcatgcacgtgtaaatgtatgcagttggatacaacagggaatctggtacctgcagagactgtccagccataaaatgttaccaccttaagagaacccttcaagtgtggagctttctagtaggtgtccttcatagctcagaaacatacctcagaacaagccattcatgacttacctgtaatgggaaaataaatcattctatcagatcagcagttttgatgtttgagtgattttgatatgcttcacagagacaaatgctgccaaaataaacatcgaagtatagacatgagttctgttcagcaggttgaaaagtctgatttagaaaaactttctaagttttggttgaaattatgaacactctagaagcagaatttctggaagagccaagaacagactttgagcctatatcttcaaagctgaaactggatatctttcaataaaatatgtgcacttttaaaataaaatgactaattctgtga

SEQ ID NO: 5006 - DNA, 3095 bp, Homo sapiens
gggaaactccccttccaaggccgaggcgccgctgcgcgtcctccaggcgtggtggtggggtcgtgggtcccagcccagtggtccaggtcacgggccgcacggccgcggccgccatcttgcccgcgtccgggctcctgcggcgggcggggcggtgtcccggccggaagcggctgtgcggcggccgcgctgccacctcagtgctgttgcaaatattctggtgaatgaacacagaatcagcatggctttcctttgctgagaaatcactgatgggaagtgagacttgttaaacttgaaagtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaatgtgttgcctggtatcttaattatgatcctgaatgtctgctggcagttggacaagcaaatggtcgagttgtacttacaagccttggtcaagatcataactcaaagttcaaagatttgataggaaaagagtttgttccaaaacatgcacgacaatgtaatacccttgcctggaatccactggatagtaactggctagctgctggtttagataagcacagagctgacttttcagtgctaatatgggatatctgcagcaaatatactcctgatatagttcccatggaaaaagtgaaactttcagcaggtgaaactgaaacaacattattagtaacaaaaccactttatgagttaggacagaatgatgcttgtctgtctctttgttggcttccacgagaccagaaacttctccttgctggtatgcatcgtaacctagctatatttgatcttcggaatacaagccaaaagatgttcgtaaatacaaaagctgttcagggtgtgacggtagacccatatttccacgatcgtgttgcttccttctatgaaggtcaggttgcaatatgggatcttagaaaatttgagaagccagttttgacattgactgagcaaccaaaacccttaacaaaagtagcatggtgtcccactaggactggtctacttgccactttaacaagggatagtaatattattagattgtatgatatgcagcatacacccactcccattggggatgaaactgaacccacaataattgaaagaagtgtgcaaccttgtgacaattacattgcttcctttgcgtggcatccaacaagtcaaaatcgaatgatagttgtaactcccaaccgaacaatgtcagacttcactgtttttgaaaggatatctcttgcctggagcccaattacatctttaatgtgggcttgtggtcgtcatttatatgaatgtacggaagaagaaaatgataattctttagaaaaagatatagcaacgaagatgcgtcttcgggctttatcaaggtatggacttgatacagagcaggtgtggaggaaccacattttagctggaaatgaagatccacagctcaagtcactctggtatactctgcactttatgaagcaatacacagaagatatggatcagaaatctccaggcaacaaaggatcattggtttatgcaggaattaaatcaattgtaaagtcatcgttgggaatggtggaaagcagcagacataattggagtgggttggataagcaaagtgatattcaaaatttaaatgaagagagaatcttagctttacagctttgtgggtggataaagaaaggaacggatgtagacgtggggccatttttgaactcccttgtacaagaaggggaatgggaaagagctgctgctgtggcattgttcaacttggatattcgccgagcaatccaaatcctgaatgaaggggcatcttctgaaaaaggagatctgaatctcaatgtggtagcaatggctttatcgggttatacggatgagaagaactccctttggagagaaatgtgtagcacactgcgattacagctaaataacccgtatttgtgtgtcatgtttgcatttctgacaagtgaaacaggatcttacgatggagttttgtatgaaaacaaagttgcagtacgtgacagagtggcatttgcttgtaaattccttagtgatactcagttaaatagatacatcgaaaagttgaccaatgaaatgaaagaggctggaaatttggaaggaattttgcttacaggccttactaaagatggagtggacttaatggagagttatgttgatagaactggagatgttcaaacagcaagttactgtatgttacagggttcacctttagatgttcttaaagatgaaagggttcagtactggattgagaattatagaaatttattagatgcctggaggttttggcataaacgagctgaatttgatattcacaggagtaagttggatcccagttccaagcctttagcacaagtttttgtgagttgcaatttctgtggcaagtcaatctcctacagctgttcagctgtgcctcatcagggcagaggttttagtcagtatggtgtgagtggctcaccaacgaaatctaaagtcacaagttgtcctggctgtcgaaaaccacttcctcgatgtgcgctttgtctcattaatatgggaacaccagtttctagctgtcctggaggaaccaaatcagatgaaaaagtggacttgagcaaggacaaaaaattagcccaatttaacaactggtttacatggtgtcataattgcaggcacggtggacatgctggacatatgcttagttggttcagggaccatgcagagtgccctgtgtcggcatgcacgtgtaaatgtatgcagttggatacaacagggaatctggtacctgcagagactgtccagccataaaatgttaccaccttaagagaacccttcaagtgtggagctttctagtaggtgtccttcatagctcagaaacatacctcagaacaagccattcatgacttacctgtaatgggaaaataaatcattctatcaga

SEQ ID NO: 5007 - DNA, 844 bp, Homo sapiens
cggccgcgctgccacctcaggtcagtgagcgcgacccggttcgcgtctcgactctcgggagcgccgcggccgcagcgaggggccggagatagcctagttgaaaggcccgggcgtctcggcggggagcgcgttccgcgctgtagggtaatcgcgccgggcggccggccgcctggccgggcctcagcgggagccaccgggggctgcgggcggccgtgggacctgcggagacctcctcggggcgcagggaacacgctacagccttcgccgcggcgggcttgtggggagcggcgtcccagcctttcccgggaggctcagccaggtgcctggagcgggagagtcggactcagattcctgctttacctagaatagcaacgtgccctgttcccgttgtaccctcttaaatactatacttcttaaacggcctgtctcccgggaaatttggatatgtgcagtgcatctcctcgaagatgctgatggtggaaatttcttgaaaccgctctcgtaatttgccacgtgctgttgcaaatattctggtgaatgaacacagaatcagcatggctttcctttgctgagaaatcactgatgggaagtgagacttgttaaacttgaaagtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaa

SEQ ID NO: 5008 - DNA, 602 bp, Homo sapiens
gtcacgggccgcacggccgcggccgccatcttgcccgcgtccgggctcctgcggcgggcggggcggtgtcccggccggaagcggctgtgcggcggccgcgctgccacctcagtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaatgtgttgcctggtatcttaattatgatcctgaatgtctgctggcagttggacaagcaaatggtcgagttgtacttacaagccttggtcaagatcataactcaaagttcaaagatttgataggaaaagagtttgttccaaaacatgcacgacaatgtaatacccttgcctggaatccactggatagtaactggctagctgctggtttagataagcacagagctgacttttcagtgctaatatgggatatctgcagcaaa

SEQ ID NO: 5009 - DNA, 536 bp, Homo sapiens
cggtgagctctgttctcttctcatatgagtaatgaaaattaagaggatgaatgaaacctcacacatgttgtggactttgctgaataggttagcaaatgactgcaggccttttgtatattttaagggaaatttggatatgtgcagtgcatctcctcgaagatgctgatggtggaaatttcttgaaaccgctctcgtaatttgccacgtgctgttgcaaatattctggtgaatgaacacagaatcagcatggctttcctttgctgagaaatcactgatgggaagtgagacttgttaaacttgaaagtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaa

SEQ ID NO: 5010 - DNA, 1075 bp, Homo sapiens
atcttgcccgcgtccgggctcctgcggcgggcggggcggtgtcccggccggaagcggctgtgcggcggccgcgctgccacctcaggtcagtgagcgcgacccggttcgcgtctcgactctcgggagcgccgcggccgcagcgaggggccggagatagcctagttgaaaggcccgggcgtctcggcggggagcgcgttccgcgctgtagggtaatcgcgccgggcggccggccgcctggccgggcctcagcgggagccaccgggggctgcgggcggccgtgggacctgcggagacctcctcggggcgcagggaacacgctacagccttcgccgcggcgggcttgtggggagcggcgtcccagcctttcccgggaggctcagccaggtgcctggagcgggagagtcggactcagattcctgctttacctagaatagcaacgtgccctgttcccgttgtaccctcttaaatactatacttcttaaacggcctgtctcccgtgaatggacctgagtggaccctttgatcacatcagtaaacatgagcggtaccaaacctgatattttatgggcaccacaccatgttgatagatttgttgtgtgtgactcagaactaagtctttatcatgtggaatctactgtgaattcagaactcaaagctggatctttacgtttatctgaagactctgcagctacattactgtcaataaattcagatacaccctatatgaaatgtgttgcctggtatcttaattatgatcctgaatgtctgctggcagttggacaagcaaatggtcgagttgtacttacaagccttggtcaagatcataactcaaagttcaaagatttgataggaaaagagtttgttccaaaacatgcacgacaatgtaatacccttgcctggaatccactggatagtaactggctagctgctggtttagataagcacagagctgacttttcagtgctaatatgggatatctgcagcaaatatactcctgatatagttcccatggaaaaagtgaaactttcagcaggtgaaactgaaacaacattattagtaacaaaaccactttatg

SEQ ID NO: 5011 - DNA, 1675 bp, Homo sapiens
atgtttccaaggattgtcttcagtcatggccttgggattaaagtgctcccgcatggtccaccctgcctttcgcaattatcttgcagcctctatcagacccgtttcagaagttacactgaagaaagtgtatgaaagacaacatggccataggcaatacgtggcctattcagctgtaccagtccaccattttgctaccaagaaagccaaagccaaagggaaaggaaagtcccaaaccagagtgaatattagtgctgcctttgttgaggatataatcaacttggaagaggtgaatgaagaaatgaagtctgtgatagaagcacgcaaggataatttcaataagactctcaatatagggacctcaccaggatcccttgacaagattgctgtggtaaccgctgatggaaaacttgctttaaaccagattaggcagatctccgtgaagttgccacagctgattttggtgaatatggccagcttcccagagttcacagttgcagctatcaaggctataagagaaagtggaatgaatctgaacccagaagtggaagggacactaattcgggtacccattccccaagtaatcagagagcacagagaaatgctggtgaaactggccaaacagaacaccaacaaggccacatactctttacggaaggtttgtaccaacgcaatgaacaagctgaagaaatccaaggatacagtctcggagggcaccattaggctaacagagaaacagatcagccaaatggccgatgacacagtggcagaactgtacaggcatctggcagtgaagaccaaagaactccttggatgaaagtccactacagaccagcaatacttcagagcccagtttctgctggatcccatgggtggcacattgggacctctctccctcccccatccacacagaagactgtcaccatgctgacagaaggctgtctttgtgaggcccagccttccagtggaacactcagacttgttcattctcttcctccttctgctctgggccttctgatgtgggtggctctcagaaaatacttgctgctggcaaagggcctttactcaggcatttgctttgacttgatgtcaccaagagactgaggacattggcaggcttagtaccacctgctcctcatcttaggagcctccttttcaaataattaggctctgttcccattgtaaaactctgcttgggctgatattggccttcacctgtgactggacactttactagaggcccattttcactaaacaataaaatctaaataaattggaaggaataacaaccacaaaggaaagaaaagagttggtctggattgatgatcactgaggatctgtatgtgaagcacccagagcagtagttttgcctgtgagtcatcttcacacatgctcttttctctgcctggatctctcttcccctccttacctggccagtcctgtttatcatcaggccttgtcttggatatcacatcctctggggtcttcctttcccctctcacctaggaccctcattaccggctctcatagcacagtctactgctttgtacgaactctaagtattctttttgcatttaattagcctgtgtatcctcagaactttgtgtaatgcctggagcatagtaggcagtcatatgttatattgtgaataaattgcacatagtagctacccagcaaa

SEQ ID NO: 5012 - DNA, 2501 bp, Homo sapiens
aggcggtgcgctcggcgcttcctgttccggcgccaggaggagccgcgcgctgctggtgctgttgccgccgctgctctagctgccgtcagtcaggctgcgcccgcgtcttcagggcccagtccctcggacccatcgccgcttctagaccctactgcggtctcggatattgccgggaaaatgtctgatgaattttcgttggcagatgcactacctgaacactcccctgccaaaacctctgctgtgagcaatacaaaacctggccaacctcctcaaggctggccaggctccaacccttggaataatccgagtgctccatcttcagtgccatctggactcccaccaagtgcaacaccctccactgtgccttttggaccagcaccaacaggaatgtatccctccgtgcctcccaccggaccacctccaggacccccagcaccctttcctccttccggaccatcatgtcccccacctggtggtccttatccagccccaactgtgccgggccctggccccacagggccatatcctacaccaaatatgccctttccagagctacccagaccatatggtgcacccacagatccagctgcagctggtcctttaggtccatggggatccatgtcttctggaccttgggcgccaggaatgggagggcagtatcctacccctaatatgccatatccatctccaggcccatatcccgctcctcctcctccccaagcccctggggcagcaccacctgttccatggggcaccgttccaccaggagcctggggaccaccagcaccatatcctgcccctacaggatcgtatcccacaccaggactctatcctactcccagtaatcctttccaagtgccttcaggaccttctggtgctccaccaatgcctggtggcccccattcttaccattaagttaacaatggacgaagagatgacgctttgctttttgaagtacatgtatatgcacatgaatgcatatataaaaattgctggtttcactattagagggcattcatgaaagaacaactcttgcacctctcagagaagataactgcctcttgtacttggatgcgtagtacatcatatgtatacaatcagataaaagcatagaagtaaatcattcggatgtgatttttatttggttttcatggaaagttaaagtgataaagtatattgaatagttctttgacagaatttgtttaaactatgaaactacacacttaaaaatctaagatgtggattattgttagaatctgcaacttcattggcaaattatttcaagtatttttctataatcactttccccttctaaataaataaacttcgagaataacccatcataatccaaacaaatgatgcctcaacattttgagctgctctgtcggacaaataaacctggtcctcttgaggttatattttggatatacatttttaaactgtcagtaattattgtcagatgtggagttcaatagccagccagtgttcatttttatccttgagcttttagtaaaaacttcctggttttatttttagtcattgggtcatacagcactaaagtctgctatttatggaaactaacttttttgtttttaatccaggccaacatgtatgtaaattaaatttttagataattgattatctctttgtactacttgagatttgattatgagatgtgcatattgctttgggaagagctcgaggaaggaaataattctctcctttgttttgaacctcaaactagataaaccctaggaattgcttaactgcaacaagtaattttcattcccacaaaaacctgaggcagctcttttgcccagagcgttccctgtagccacccccaccccacttgcccttggttctttagaaggagcacacacatcccttgattcctccctgatgtggtaaactggcacactccaggggtctaaaacataaaacagttgtgtttagggaaccttaagtcatgcagacatgactgttctctttgtacaagtgtgaatcaaaatatgtatctctttttcagagtctggttaagctatgtcattgtctactgcatagtttcctgagtctgtttgtaaagtgcttatggctaacagttcagttctgtatttgttgacaggtaaataagtggagttgagtgccatctttgaaaaaattaccctctagctctaacactgaaaataataataaattgtagatctctgcaactaagtttaaagcagtgtgactgtgttgcttaaatatcaagtattgtttataaccaccaaaaaaaaaaagccctggtagttttttggcaccttatgtttaaatcagattcttagatttggagtagacctgaccttgttatttattagataacattttgaatgtatccattggatttctaaaatgtattgtgaatttctcagacaaacaggatttatgctggagctctgttttgcttagaaataaaatatttagtagtttatttctgctctaattaaaatgtcaagaatgcc

SEQ ID NO: 5013 - DNA, 6879 bp, Homo sapiens
ggctccgcccacccagcccgcggcttggcccaggcggtagttcgcgttttgagccgatcgtgccaccatagctcctgctgctgcctctaccgctgcggctaccgcggcggagctgaaattgccgaacgcgatgcccgagggcgctgtgagcggggtggccttagctcgccgaggctggtcagtgagagggcatactgggaagccctctggagtgggaagacagtgccgctgttgagacaagacccaggactgggccggggactgtcccaaagggtttctcgtcataatggctgtggaagggtcaaccattaccagccggatcaagaatctgttgagatctccatccatcaaactgcgcaggagtaaggcaggaaaccgacgagaggacctcagctccaaggtgaccttggagaaggtgctgggaattacagtgtctggaggcagaggacttgcctgtgacccccgatcaggtttagttgcttacccagcagggtgtgtggttgtgttgttcaatccccggaaacacaaacagcaccacatcctcaacagttccaggaaaaccatcactgcccttgccttctcccctgatggcaagtacttggtcactggagagagtgggcacatgcctgccgtgcgggtttgggacgtggcagagcacagccaggtggccgagctgcaggagcacaagtatggtgtggcttgtgtggccttctctcctagcgccaagtacattgtctctgtgggctaccagcatgacatgatcgtcaacgtgtgggcctggaagaaaaacattgtggtggcctccaacaaggtgtccagtcgggtgacagcagtgtccttctctgaggattgcagctactttgtcactgcaggcaaccgacacatcaaattctggtatctcgatgacagcaagacctcaaaggtgaatgccactgtgcccttgctgggccgctcagggctgctgggagagctacggaacaacctattcactgatgtggcctgtggcagaggaaaaaaggcggacagtaccttctgcatcacgtcctcagggctgctgtgcgagttcagtgatcgaaggcttttggacaagtgggtggagctgagggtctaccccgaggtgaaggatagtaaccaggcctgcctgccccccagttcctttattacctgctcctcagacaacaccatccgcctgtggaacacagagagctccggggtgcatggctccaccctccaccgaaacatcctcagcagtgacctcattaaaatcatctatgtggatgggaacacccaggccctgctggacacagagctgcctggaggagacaaagctgatgcatccctgttggatccccgcgtgggcatccgctcggtgtgtgtcagccccaatggacagcatctagcatcaggggaccgtatgggcacacttagggtgcacgaacttcagtccctgagtgagatgctgaaggtggaggcccatgactctgagattctgtgcctggagtattctaagccagacacaggtctgaaactgctagcatcggcgagccgggaccggctgatccatgtgctggatgccgggcgggagtacagcctacagcagacgctggacgaacactcatcctccatcactgctgttaagtttgcagccagtgatgggcaagtccgcatgatcagctgtggagcagacaagagcatctacttccgcactgcgcagaagtctggagatggagtgcagttcacacggacacaccacgtggtgcggaagacgaccctctatgacatggatgtggagcccagctggaagtacacggctatcggctgccaggaccgaaatattcggatatttaacatcagcagtggaaagcagaagaagctgtttaaagggtcacagggtgaggacggcacactcattaaggtgcagacagacccctcagggatctacattgccaccagctgttctgacaagaatctctccatttttgacttctcctcaggcgagtgcgtggccaccatgtttggccactcagagattgtcactggcatgaaatttagtaatgattgtaaacatctcatctctgtgtctggggacagctgcatatttgtgtggcgcctgagctctgagatgaccatcagcatgaggcagcgtctggccgagttgcgccagcgtcagcggggcggcaagcagcaaggaccatcctctccccaaagggcttctggacccaaccggcaccaggccccatcaatgctgtctcctggaccggctctctcatcagacagtgacaaggagggagaagatgaggggactgaagaagaacttccagcactgcccgtccttgccaagagtaccaagaaggcactggcctcggtccccagcccagctttgccccgaagcctgtcccactgggagatgagtcgggcacaggagtccgtggggttcctggacccagctcctgcagccaacccaggacccagaagaagagggcgctgggttcagccaggtgtggaactgagcgttagatccatgctggatctgcggcagctggaaacactggccccaagcctgcaggaccctagccaggactcgctggccatcatcccatctggtcccaggaagcatgggcaggaggcccttgagacttcactcactagccagaatgaaaagccccctcggcctcaggcttcccaaccttgttcctatccccatattatccgattattgtcacaagaggaaggggtctttgcccaagatctggaacctgcacccattgaagatggtattgtctacccggagccgagtgacaaccccaccatggataccagtgagttccaagtgcaggctccagcccggggaactctgggaagagtgtacccaggcagcaggagctcagaaaagcacagccctgacagtgcctgctctgtggattacagcagcagctgcctttccagcccggagcaccccactgaagactctgagagcacggagcccctcagtgtggatggcatctcctcagaccttgaagagccagctgagggtgatgaagaagaggaagaagaggagggaggcatgggcccctatgggctacaggagggcagcccccagactccagaccaggagcagtttctaaaacagcactttgagactctggccagtggagctgctccaggggccccagtgcaggtcccagagaggtcagagtctcggagtatctcttcacgattcctgttgcaagtacagacccgcccactcagggaaccatccccatcctcctcaagcctggcactgatgtcgagaccagcccaggtgccacaggcatctggtgagcagccgagaggcaatggtgccaatccccctggagcacccccggaggtggaaccgtcctctggcaaccccagcccccagcaggcagcctctgtgctgttgccacgatgccgtctcaaccctgacagcagctgggctcccaagagagtggccacagccagccccttttctggactccagaaggcccagtctgtgcacagtctggtgccacaggaaagacatgaggccagtctgcaggccccttcaccaggcgcactgctgtctcgggagatcgaagctcaggatggtctgggctccctgcccccagctgatggccgtccgtctcggcctcactcctatcagaaccccaccaccagttccatggccaagatatcccgcagtatctctgttggggagaacctgggcctggtggctgaacctcaagctcatgcccccatccgagtctcaccactcagcaagctggccctgcccagccgggctcacctggtcctggacatccccaaaccactgcctgaccgtcctaccctggctgcattctctcctgtcaccaaaggccgggcccctggcgaggcagaaaagcctggcttcccggtgggcctaggaaaagctcacagtacaactgagagatgggcctgtttgggggagggcaccactcccaagcctaggacagagtgccaggctcatcctgggcccagcagcccctgtgcccagcaactgccagtcagcagcctcttccaaggccctgaaaacttgcagcccccaccccctgagaagactcccaaccccatggaatgcaccaagccaggggcagccctgagccaggactcagagccagcggtgagcctggagcagtgtgagcagctggtggcagagctccgcggcagcgtgcgccaggcagtgcggctctaccactcggtggctggctgcaagatgccctcagcagagcaaagtcggattgcccagctcctcagagacaccttctcttcagtgcgacaggagctggaagctgtggctggggcagtgctgtccagcccaggcagcagccctggggctgtgggagccgagcagacacaggccctgctggagcaatactcagaactgttgcttcgagccgtggaacggcgtatggaacgcaaactctgagttctggaagcctgtcccaagtgaatgaatgctccagcgattccaaactgcagcccctctgcccctcaccaaaacctgcggggctgcttggagtggaaagcagggagcagtgttcagaggcaaagcagccttcccagccgctcctcgtggggggcctgtatttattaatttatttccctgactgttgcctcacttccttggaactcctgcctccacagcccctccagtggcagggacaggtcttgggtctttgtcatcttggtgctgtgagaggtaggagggcagcctgccccatctaggaatctgggaagggctggccctctcttagaagccatttgaaattactgcagggattagctccctgtggtggagcatacacagggtactctggggtcgaggtgagaggtgatgtggtattcagtgcccgtcagccaactgtgggccttcacctctacctgcacttcccctctcacaccagctgcactcccgtggctgccagagcagggtggttttccccaatacctggagctcagaaaggcagagccatctggccctccagggtgtccccagccatcaggagacttgagttggtatttggacctgagcccgcacattccactcccattctccctccaagaggggcccagcattgtatttccctgtgaccccttactctcctggccagaacttgagccagctgtgggatgttgctgcaggacagtaagccctcacctgggcaaacatgaagctctggcctcctttcctcagccccttgttcttccctgtcctccaccctggaccccagccggctgctggagcccagaggccaccttctccctgcatcctgaatgatgcttagtcagaagcctgtgttggaacatccctcgtttacggggcgctggcctacctcctgaggacctcagccacagatgagatcacacgcatgcacgtgcacacatgtacacacacacacctacctgcacagcacgctgttgagtgttggttgctagagtatctggctggctgctgtgtgcctggtttcctcacatcctgcctcagcttcaccaccctggcttatgtggaacacctatcagggagcagaaaaggggtgcagtacactaagtgaacccagattctggattcttggtgtccacagcctagctgatacgagatagcccataggacacctggtttaggtagaaggagcctcctcaaaggcagtgctgggcacccacgggtgtgctggatactggagtttgagaggagggaggtgctggggccaaaggagacactagaaaagtggtagatgggacaggtaagtggcagaggtgaggggataagttagaatgtaaaagggcagtaattaggggtgagggaaaggagataggggaccctaggaggtagagtgggaccatgtcgtgaggcagttgaagagttgaggaaaggtttttctgggccctactgctcccctctgctgcaggtaagtcagagcagctttaccacagcttcaggccacgagagccccttcacccgccctgctgcgccataggcagaggcttataaagaaatgggttctgggccaggtgtggtggctcaagcctgtaatcccagcactttgggaggccgaggcgggtggatcacctgaggttaggagttcgagatcagcctggccaacatggtgaaaccctgtctactaaaaataaaaaaattagctgggcgtggtggtgggcgcctgtaatcccagctactcgggaggtttaggcaggagaatcgcttgaaccctggaggtggaggtggaggttgcagtgagccgagatcgcgccattgcactccaacctaggtgacaaagctacacgccatctcaaaaaaaaaaaagaaaaagggttacaaaaggttcccagctccggggcatcagcctgagtgcgcttgagctgctccaaacctggcccttccccactcctctagcatcgccacccgcatggccctggaactcccgcggcggcgggggcgggcccgtgcctgctgtgccccgacttcccacaccagccgcgcccaccgcaggtgggactcaggttcgccctctgggccaggtccttcacgaggagggagctacccttcgccagaagtttgtgagaatgtggccgcccttttcctgccctctgccccatgtgggtggggggcctcgtggcccggccggcgccccgtccccttctgcatgtctgaggccaccggcaaccgccgccccactccagatttgcccccgccttgttttgaaagccccttatttataacttttatactttgtgcaggtcgcggcgcttcctgcctcatcctcggctgcatggggcgggggcgctgtttttaacgtgcccgtttgtactgatgtatgaacttgtcaataaacacaattgtttgtt

SEQ ID NO: 5014 - DNA, 4695 bp, Homo sapiens
gtgccaccatagctcctgctgctgcctctaccgctgcggctaccgcggcggagctgaaattgccgaacgcgatgcccgagggcgctgtgagcggggtggccttagctcgccgaggctggtcagtgagagggcatactgggaagccctctggagtgggaagacagtgccgctgttgagacaagacccaggactgggccggggactgtcccaaagggtttctcgtcataatggctgtggaagggtcaaccattaccagccggatcaagaatctgttgagatctccatccatcaaactgcgcaggagtaaggcaggaaaccgacgagaggacctcagctccaaggtgtgtggttgtgttgttcaatccccggaaacacaaacagcaccacatcctcaacagttccaggaaaaccatcactgcccttgccttctcccctgatggcaagtacttggtcactggagagagtgggcacatgcctgccgtgcgggtttgggacgtggcagagcacagccaggtggccgagctgcaggagcacaagtatggtgtggcttgtgtggccttctctcctagcgccaagtacattgtctctgtgggctaccagcatgacatgatcgtcaacgtgtgggcctggaagaaaaacattgtggtggcctccaacaaggtgtccagtcgggtgacagcagtgtccttctctgaggattgcagctactttgtcactgcaggcaaccgacacatcaaattctggtatctcgatgacagcaagacctcaaaggtgaatgccactgtgcccttgctgggccgctcagggctgctgggagagctacggaacaacctattcactgatgtggcctgtggcagaggaaaaaaggcggacagtaccttctgcatcacgtcctcagggctgctgtgcgagttcagtgatcgaaggcttttggacaagtgggtggagctgaggaccacagtggcccactgcatctctgtgagccaagactacatcttctgtggctgtgctgatggcaccgtgcgccttttcaacccctctaacctgcacttccttagcaccttgccccgaccccatgctctggggacagacattgctagcgtcaccgaggccagtcgcctcttctctggagtggcgaatgccaggtatccagacaccattgccttgacctttgatcctactaatcagtggctgtcttgtgtgtacaacgatcatagcatttatgtttgggatgtgagggaccccaagaaagtgggcaaggtgtactcggctctgtatcattcttcctgcgtctggagtgtggaggacctcattaaaatcatctatgtggatgggaacacccaggccctgctggacacagagctgcctggaggagacaaagctgatgcatccctgttggatccccgcgtgggcatccgctcggtgtgtgtcagccccaatggacagcatctagcatcaggggaccgtatgggcacacttagggtgcacgaacttcagtccctgagtgagatgctgaaggtggaggcccatgactctgagattctgtgcctggagtattctaagccagacacaggtctgaaactgctagcatcggcgagccgggaccggctgatccatgtgctggatgccgggcgggagtacagcctacagcagacgctggacgaacactcatcctccatcactgctgttaagtttgcagccagtgatgggcaagtccgcatgatcagctgtggagcagacaagagcatctacttccgcactgcgcagaagtctggagatggagtgcagttcacacggacacaccacgtggtgcggaagacgaccctctatgacatggatgtggagcccagctggaagtacacggctatcggctgccaggaccgaaatattcggatatttaacatcagcagtggaaagcagaagaagctgtttaaagggtcacagggtgaggacggcacactcattaaggtgcagacagacccctcagggatctacattgccaccagctgttctgacaagaatctctccatttttgacttctcctcaggcgagtgcgtggccaccatgtttggccactcagagattgtcactggcatgaaatttagtaatgattgtaaacatctcatctctgtgtctggggacagctgcatatttgtgtggcgcctgagctctgagatgaccatcagcatgaggcagcgtctggccgagttgcgccagcgtcagcggggcggcaagcagcaaggaccatcctctccccaaagggcttctggacccaaccggcaccaggccccatcaatgctgtctcctggaccggctctctcatcagacagtgacaaggagggagaagatgaggggactgaagaagaacttccagcactgcccgtccttgccaagagtaccaagaaggcactggcctcggtccccagcccagctttgccccgaagcctgtcccactgggagatgagtcgggcacaggagtccgtggggttcctggacccagctcctgcagccaacccaggacccagaagaagagggcgctgggttcagccaggtgtggaactgagcgttagatccatgctggatctgcggcagctggaaacactggccccaagcctgcaggaccctagccaggactcgctggccatcatcccatctggtcccaggaagcatgggcaggaggcccttgagacttcactcactagccagaatgaaaagccccctcggcctcaggcttcccaaccttgttcctatccccatattatccgattattgtcacaagaggaaggggtctttgcccaagatctggaacctgcacccattgaagatggtattgtctacccggagccgagtgacaaccccaccatggataccagtgagttccaagtgcaggctccagcccggggaactctgggaagagtgtacccaggcagcaggagctcagaaaagcacagccctgacagtgcctgctctgtggattacagcagcagctgcctttccagcccggagcaccccactgaagactctgagagcacggagcccctcagtgtggatggcatctcctcagaccttgaagagccagctgagggtgatgaagaagaggaagaagaggagggaggcatgggcccctatgggctacaggagggcagcccccagactccagaccaggagcagtttctaaaacagcactttgagactctggccagtggagctgctccaggggccccagtgcaggtcccagagaggtcagagtctcggagtatctcttcacgattcctgttgcaagtacagacccgcccactcagggaaccatccccatcctcctcaagcctggcactgatgtcgagaccagcccaggtgccacaggcatctggtgagcagccgagaggcaatggtgccaatccccctggagcacccccggaggtggaaccgtcctctggcaaccccagcccccagcaggcagcctctgtgctgttgccacgatgccgtctcaaccctgacagcagctgggctcccaagagagtggccacagccagccccttttctggactccagaaggcccagtctgtgcacagtctggtgccacaggaaagacatgaggccagtctgcaggccccttcaccaggcgcactgctgtctcgggagatcgaagctcaggatggtctgggctccctgcccccagctgatggccgtccgtctcggcctcactcctatcagaaccccaccaccagttccatggccaagatatcccgcagtatctctgttggggagaacctgggcctggtggctgaacctcaagctcatgcccccatccgagtctcaccactcagcaagctggccctgcccagccgggctcacctggtcctggacatccccaaaccactgcctgaccgtcctaccctggctgcattctctcctgtcaccaaaggccgggcccctggcgaggcagaaaagcctggcttcccggtgggcctaggaaaagctcacagtacaactgagagatgggcctgtttgggggagggcaccactcccaagcctaggacagagtgccaggctcatcctgggcccagcagcccctgtgcccagcaactgccagtcagcagcctcttccaaggccctgaaaacttgcagcccccaccccctgagaagactcccaaccccatggaatgcaccaagccaggggcagccctgagccaggactcagagccagcggtgagcctggagcagtgtgagcagctggtggcagagctccgcggcagcgtgcgccaggcagtgcggctctaccactcggtggctggctgcaagatgccctcagcagagcaaagtcggattgcccagctcctcagagacaccttctcttcagtgcgacaggagctggaagctgtggctggggcagtgctgtccagcccaggcagcagccctggggctgtgggagccgagcagacacaggccctgctggagcaatactcagaactgttgcttcgagccgtggaacggcgtatggaacgcaaactctgagttctggaagcctgtcccaagtgaatgaatgctccagcgattccaaactgcagcccctctgcccctcaccaaaacctgcggggctgcttggagtggaaagcagggagcagtgttcagaggcaaagcagccttcccagccgctcctcgtggggggcctgtatttattaatttatttccctg

SEQ ID NO: 5015 - DNA, 7158 bp, Homo sapiens
cgctgcggctaccgcggcggagctgaaattgccgaacgcgatgcccgagggcgctgtgagcggggtggccttagctcgccgaggctggtcagtgagagggcatactgggaagccctctggagtgggaagacagtgccgctgttgagacaagacccaggactgggccggggactgtcccaaagggtttctcgtcataatggctgtggaagggtcaaccattaccagccggatcaagaatctgttgagatctccatccatcaaactgcgcaggagtaaggcaggaaaccgacgagaggacctcagctccaaggtgaccttggagaaggtgctgggaattacagtgtctggaggcagaggacttgcctgtgacccccgatcaggtttagttgcttacccagcagggtgtgtggttgtgttgttcaatccccggaaacacaaacagcaccacatcctcaacagttccaggaaaaccatcactgcccttgccttctcccctgatggcaagtacttggtcactggagagagtgggcacatgcctgccgtgcgggtttgggacgtggcagagcacagccaggtggccgagctgcaggagcacaagtatggtgtggcttgtgtggccttctctcctagcgccaagtacattgtctctgtgggctaccagcatgacatgatcgtcaacgtgtgggcctggaagaaaaacattgtggtggcctccaacaaggtgtccagtcgggtgacagcagtgtccttctctgaggattgcagctactttgtcactgcaggcaaccgacacatcaaattctggtatctcgatgacagcaagacctcaaaggtgaatgccactgtgcccttgctgggccgctcagggctgctgggagagctacggaacaacctattcactgatgtggcctgtggcagaggaaaaaaggcggacagtaccttctgcatcacgtcctcagggctgctgtgcgagttcagtgatcgaaggcttttggacaagtgggtggagctgaggaacatagacagcttcacaaccacagtggcccactgcatctctgtgagccaagactacatcttctgtggctgtgctgatggcaccgtgcgccttttcaacccctctaacctgcacttccttagcaccttgccccgaccccatgctctggggacagacattgctagcgtcaccgaggccagtcgcctcttctctggagtggcgaatgccaggtatccagacaccattgccttgacctttgatcctactaatcagtggctgtcttgtgtgtacaacgatcatagcatttatgtttgggatgtgagggaccccaagaaagtgggcaaggtgtactcggctctgtatcattcttcctgcgtctggagtgtggaggtctaccccgaggtgaaggatagtaaccaggcctgcctgccccccagttcctttattacctgctcctcagacaacaccatccgcctgtggaacacagagagctccggggtgcatggctccaccctccaccgaaacatcctcagcagtgacctcattaaaatcatctatgtggatgggaacacccaggccctgctggacacagagctgcctggaggagacaaagctgatgcatccctgttggatccccgcgtgggcatccgctcggtgtgtgtcagccccaatggacagcatctagcatcaggggaccgtatgggcacacttagggtgcacgaacttcagtccctgagtgagatgctgaaggtggaggcccatgactctgagattctgtgcctggagtattctaagccagacacaggtctgaaactgctagcatcggcgagccgggaccggctgatccatgtgctggatgccgggcgggagtacagcctacagcagacgctggacgaacactcatcctccatcactgctgttaagtttgcagccagtgatgggcaagtccgcatgatcagctgtggagcagacaagagcatctacttccgcactgcgcagaagtctggagatggagtgcagttcacacggacacaccacgtggtgcggaagacgaccctctatgacatggatgtggagcccagctggaagtacacggctatcggctgccaggaccgaaatattcggatatttaacatcagcagtggaaagcagaagaagctgtttaaagggtcacagggtgaggacggcacactcattaaggtgcagacagacccctcagggatctacattgccaccagctgttctgacaagaatctctccatttttgacttctcctcaggcgagtgcgtggccaccatgtttggccactcagagattgtcactggcatgaaatttagtaatgattgtaaacatctcatctctgtgtctggggacagctgcatatttgtgtggcgcctgagctctgagatgaccatcagcatgaggcagcgtctggccgagttgcgccagcgtcagcggggcggcaagcagcaaggaccatcctctccccaaagggcttctggacccaaccggcaccaggccccatcaatgctgtctcctggaccggctctctcatcagacagtgacaaggagggagaagatgaggggactgaagaagaacttccagcactgcccgtccttgccaagagtaccaagaaggcactggcctcggtccccagcccagctttgccccgaagcctgtcccactgggagatgagtcgggcacaggagtccgtggggttcctggacccagctcctgcagccaacccaggacccagaagaagagggcgctgggttcagccaggtgtggaactgagcgttagatccatgctggatctgcggcagctggaaacactggccccaagcctgcaggaccctagccaggactcgctggccatcatcccatctggtcccaggaagcatgggcaggaggcccttgagacttcactcactagccagaatgaaaagccccctcggcctcaggcttcccaaccttgttcctatccccatattatccgattattgtcacaagaggaaggggtctttgcccaagatctggaacctgcacccattgaagatggtattgtctacccggagccgagtgacaaccccaccatggataccagtgagttccaagtgcaggctccagcccggggaactctgggaagagtgtacccaggcagcaggagctcagaaaagcacagccctgacagtgcctgctctgtggattacagcagcagctgcctttccagcccggagcaccccactgaagactctgagagcacggagcccctcagtgtggatggcatctcctcagaccttgaagagccagctgagggtgatgaagaagaggaagaagaggagggaggcatgggcccctatgggctacaggagggcagcccccagactccagaccaggagcagtttctaaaacagcactttgagactctggccagtggagctgctccaggggccccagtgcaggtcccagagaggtcagagtctcggagtatctcttcacgattcctgttgcaagtacagacccgcccactcagggaaccatccccatcctcctcaagcctggcactgatgtcgagaccagcccaggtgccacaggcatctggtgagcagccgagaggcaatggtgccaatccccctggagcacccccggaggtggaaccgtcctctggcaaccccagcccccagcaggcagcctctgtgctgttgccacgatgccgtctcaaccctgacagcagctgggctcccaagagagtggccacagccagccccttttctggactccagaaggcccagtctgtgcacagtctggtgccacaggaaagacatgaggccagtctgcaggccccttcaccaggcgcactgctgtctcgggagatcgaagctcaggatggtctgggctccctgcccccagctgatggccgtccgtctcggcctcactcctatcagaaccccaccaccagttccatggccaagatatcccgcagtatctctgttggggagaacctgggcctggtggctgaacctcaagctcatgcccccatccgagtctcaccactcagcaagctggccctgcccagccgggctcacctggtcctggacatccccaaaccactgcctgaccgtcctaccctggctgcattctctcctgtcaccaaaggccgggcccctggcgaggcagaaaagcctggcttcccggtgggcctaggaaaagctcacagtacaactgagagatgggcctgtttgggggagggcaccactcccaagcctaggacagagtgccaggctcatcctgggcccagcagcccctgtgcccagcaactgccagtcagcagcctcttccaaggccctgaaaacttgcagcccccaccccctgagaagactcccaaccccatggaatgcaccaagccaggggcagccctgagccaggactcagagccagcggtgagcctggagcagtgtgagcagctggtggcagagctccgcggcagcgtgcgccaggcagtgcggctctaccactcggtggctggctgcaagatgccctcagcagagcaaagtcggattgcccagctcctcagagacaccttctcttcagtgcgacaggagctggaagctgtggctggggcagtgctgtccagcccaggcagcagccctggggctgtgggagccgagcagacacaggccctgctggagcaatactcagaactgttgcttcgagccgtggaacggcgtatggaacgcaaactctgagttctggaagcctgtcccaagtgaatgaatgctccagcgattccaaactgcagcccctctgcccctcaccaaaacctgcggggctgcttggagtggaaagcagggagcagtgttcagaggcaaagcagccttcccagccgctcctcgtggggggcctgtatttattaatttatttccctgactgttgcctcacttccttggaactcctgcctccacagcccctccagtggcagggacaggtcttgggtctttgtcatcttggtgctgtgagaggtaggagggcagcctgccccatctaggaatctgggaagggctggccctctcttagaagccatttgaaattactgcagggattagctccctgtggtggagcatacacagggtactctggggtcgaggtgagaggtgatgtggtattcagtgcccgtcagccaactgtgggccttcacctctacctgcacttcccctctcacaccagctgcactcccgtggctgccagagcagggtggttttccccaatacctggagctcagaaaggcagagccatctggccctccagggtgtccccagccatcaggagacttgagttggtatttggacctgagcccgcacattccactcccattctccctccaagaggggcccagcattgtatttccctgtgaccccttactctcctggccagaacttgagccagctgtgggatgttgctgcaggacagtaagccctcacctgggcaaacatgaagctctggcctcctttcctcagccccttgttcttccctgtcctccaccctggaccccagccggctgctggagcccagaggccaccttctccctgcatcctgaatgatgcttagtcagaagcctgtgttggaacatccctcgtttacggggcgctggcctacctcctgaggacctcagccacagatgagatcacacgcatgcacgtgcacacatgtacacacacacacctacctgcacagcacgctgttgagtgttggttgctagagtatctggctggctgctgtgtgcctggtttcctcacatcctgcctcagcttcaccaccctggcttatgtggaacacctatcagggagcagaaaaggggtgcagtacactaagtgaacccagattctggattcttggtgtccacagcctagctgatacgagatagcccataggacacctggtttaggtagaaggagcctcctcaaaggcagtgctgggcacccacgggtgtgctggatactggagtttgagaggagggaggtgctggggccaaaggagacactagaaaagtggtagatgggacaggtaagtggcagaggtgaggggataagttagaatgtaaaagggcagtaattaggggtgagggaaaggagataggggaccctaggaggtagagtgggaccatgtcgtgaggcagttgaagagttgaggaaaggtttttctgggccctactgctcccctctgctgcaggtaagtcagagcagctttaccacagcttcaggccacgagagccccttcacccgccctgctgcgccataggcagaggcttataaagaaatgggttctgggccaggtgtggtggctcaagcctgtaatcccagcactttgggaggccgaggcgggtggatcacctgaggttaggagttcgagatcagcctggccaacatggtgaaaccctgtctactaaaaataaaaaaattagctgggcgtggtggtgggcgcctgtaatcccagctactcgggaggtttaggcaggagaatcgcttgaaccctggaggtggaggtggaggttgcagtgagccgagatcgcgccattgcactccaacctaggtgacaaagctacacgccatctcaaaaaaaaaaaagaaaaagggttacaaaaggttcccagctccggggcatcagcctgagtgcgcttgagctgctccaaacctggcccttccccactcctctagcatcgccacccgcatggccctggaactcccgcggcggcgggggcgggcccgtgcctgctgtgccccgacttcccacaccagccgcgcccaccgcaggtgggactcaggttcgccctctgggccaggtccttcacgaggagggagctacccttcgccagaagtttgtgagaatgtggccgcccttttcctgccctctgccccatgtgggtggggggcctcgtggcccggccggcgccccgtccccttctgcatgtctgaggccaccggcaaccgccgccccactccagatttgcccccgccttgttttgaaagccccttatttataacttttatactttgtgcaggtcgcggcgcttcctgcctcatcctcggctgcatggggcgggggcgctgtttttaacgtgcccgtttgtactgatgtatgaacttgtcaataaacacaattgtttgtt

SEQ ID NO: 5016 - DNA, 7232 bp, Homo sapiens
ggctccgcccacccagcccgcggcttggcccaggcggtagttcgcgttttgagccgatcgtgccaccatagctcctgctgctgcctctaccgctgcggctaccgcggcggagctgaaattgccgaacgcgatgcccgagggcgctgtgagcggggtggccttagctcgccgaggctggtcagtgagagggcatactgggaagccctctggagtgggaagacagtgccgctgttgagacaagacccaggactgggccggggactgtcccaaagggtttctcgtcataatggctgtggaagggtcaaccattaccagccggatcaagaatctgttgagatctccatccatcaaactgcgcaggagtaaggcaggaaaccgacgagaggacctcagctccaaggtgaccttggagaaggtgctgggaattacagtgtctggaggcagaggacttgcctgtgacccccgatcaggtttagttgcttacccagcagggtgtgtggttgtgttgttcaatccccggaaacacaaacagcaccacatcctcaacagttccaggaaaaccatcactgcccttgccttctcccctgatggcaagtacttggtcactggagagagtgggcacatgcctgccgtgcgggtttgggacgtggcagagcacagccaggtggccgagctgcaggagcacaagtatggtgtggcttgtgtggccttctctcctagcgccaagtacattgtctctgtgggctaccagcatgacatgatcgtcaacgtgtgggcctggaagaaaaacattgtggtggcctccaacaaggtgtccagtcgggtgacagcagtgtccttctctgaggattgcagctactttgtcactgcaggcaaccgacacatcaaattctggtatctcgatgacagcaagacctcaaaggtgaatgccactgtgcccttgctgggccgctcagggctgctgggagagctacggaacaacctattcactgatgtggcctgtggcagaggaaaaaaggcggacagtaccttctgcatcacgtcctcagggctgctgtgcgagttcagtgatcgaaggcttttggacaagtgggtggagctgaggaccacagtggcccactgcatctctgtgagccaagactacatcttctgtggctgtgctgatggcaccgtgcgccttttcaacccctctaacctgcacttccttagcaccttgccccgaccccatgctctggggacagacattgctagcgtcaccgaggccagtcgcctcttctctggagtggcgaatgccaggtatccagacaccattgccttgacctttgatcctactaatcagtggctgtcttgtgtgtacaacgatcatagcatttatgtttgggatgtgagggaccccaagaaagtgggcaaggtgtactcggctctgtatcattcttcctgcgtctggagtgtggaggtctaccccgaggtgaaggatagtaaccaggcctgcctgccccccagttcctttattacctgctcctcagacaacaccatccgcctgtggaacacagagagctccggggtgcatggctccaccctccaccgaaacatcctcagcagtgacctcattaaaatcatctatgtggatgggaacacccaggccctgctggacacagagctgcctggaggagacaaagctgatgcatccctgttggatccccgcgtgggcatccgctcggtgtgtgtcagccccaatggacagcatctagcatcaggggaccgtatgggcacacttagggtgcacgaacttcagtccctgagtgagatgctgaaggtggaggcccatgactctgagattctgtgcctggagtattctaagccagacacaggtctgaaactgctagcatcggcgagccgggaccggctgatccatgtgctggatgccgggcgggagtacagcctacagcagacgctggacgaacactcatcctccatcactgctgttaagtttgcagccagtgatgggcaagtccgcatgatcagctgtggagcagacaagagcatctacttccgcactgcgcagaagtctggagatggagtgcagttcacacggacacaccacgtggtgcggaagacgaccctctatgacatggatgtggagcccagctggaagtacacggctatcggctgccaggaccgaaatattcggatatttaacatcagcagtggaaagcagaagaagctgtttaaagggtcacagggtgaggacggcacactcattaaggtgcagacagacccctcagggatctacattgccaccagctgttctgacaagaatctctccatttttgacttctcctcaggcgagtgcgtggccaccatgtttggccactcagagattgtcactggcatgaaatttagtaatgattgtaaacatctcatctctgtgtctggggacagctgcatatttgtgtggcgcctgagctctgagatgaccatcagcatgaggcagcgtctggccgagttgcgccagcgtcagcggggcggcaagcagcaaggaccatcctctccccaaagggcttctggacccaaccggcaccaggccccatcaatgctgtctcctggaccggctctctcatcagacagtgacaaggagggagaagatgaggggactgaagaagaacttccagcactgcccgtccttgccaagagtaccaagaaggcactggcctcggtccccagcccagctttgccccgaagcctgtcccactgggagatgagtcgggcacaggagtccgtggggttcctggacccagctcctgcagccaacccaggacccagaagaagagggcgctgggttcagccaggtgtggaactgagcgttagatccatgctggatctgcggcagctggaaacactggccccaagcctgcaggaccctagccaggactcgctggccatcatcccatctggtcccaggaagcatgggcaggaggcccttgagacttcactcactagccagaatgaaaagccccctcggcctcaggcttcccaaccttgttcctatccccatattatccgattattgtcacaagaggaaggggtctttgcccaagatctggaacctgcacccattgaagatggtattgtctacccggagccgagtgacaaccccaccatggataccagtgagttccaagtgcaggctccagcccggggaactctgggaagagtgtacccaggcagcaggagctcagaaaagcacagccctgacagtgcctgctctgtggattacagcagcagctgcctttccagcccggagcaccccactgaagactctgagagcacggagcccctcagtgtggatggcatctcctcagaccttgaagagccagctgagggtgatgaagaagaggaagaagaggagggaggcatgggcccctatgggctacaggagggcagcccccagactccagaccaggagcagtttctaaaacagcactttgagactctggccagtggagctgctccaggggccccagtgcaggtcccagagaggtcagagtctcggagtatctcttcacgattcctgttgcaagtacagacccgcccactcagggaaccatccccatcctcctcaagcctggcactgatgtcgagaccagcccaggtgccacaggcatctggtgagcagccgagaggcaatggtgccaatccccctggagcacccccggaggtggaaccgtcctctggcaaccccagcccccagcaggcagcctctgtgctgttgccacgatgccgtctcaaccctgacagcagctgggctcccaagagagtggccacagccagccccttttctggactccagaaggcccagtctgtgcacagtctggtgccacaggaaagacatgaggccagtctgcaggccccttcaccaggcgcactgctgtctcgggagatcgaagctcaggatggtctgggctccctgcccccagctgatggccgtccgtctcggcctcactcctatcagaaccccaccaccagttccatggccaagatatcccgcagtatctctgttggggagaacctgggcctggtggctgaacctcaagctcatgcccccatccgagtctcaccactcagcaagctggccctgcccagccgggctcacctggtcctggacatccccaaaccactgcctgaccgtcctaccctggctgcattctctcctgtcaccaaaggccgggcccctggcgaggcagaaaagcctggcttcccggtgggcctaggaaaagctcacagtacaactgagagatgggcctgtttgggggagggcaccactcccaagcctaggacagagtgccaggctcatcctgggcccagcagcccctgtgcccagcaactgccagtcagcagcctcttccaaggccctgaaaacttgcagcccccaccccctgagaagactcccaaccccatggaatgcaccaagccaggggcagccctgagccaggactcagagccagcggtgagcctggagcagtgtgagcagctggtggcagagctccgcggcagcgtgcgccaggcagtgcggctctaccactcggtggctggctgcaagatgccctcagcagagcaaagtcggattgcccagctcctcagagacaccttctcttcagtgcgacaggagctggaagctgtggctggggcagtgctgtccagcccaggcagcagccctggggctgtgggagccgagcagacacaggccctgctggagcaatactcagaactgttgcttcgagccgtggaacggcgtatggaacgcaaactctgagttctggaagcctgtcccaagtgaatgaatgctccagcgattccaaactgcagcccctctgcccctcaccaaaacctgcggggctgcttggagtggaaagcagggagcagtgttcagaggcaaagcagccttcccagccgctcctcgtggggggcctgtatttattaatttatttccctgactgttgcctcacttccttggaactcctgcctccacagcccctccagtggcagggacaggtcttgggtctttgtcatcttggtgctgtgagaggtaggagggcagcctgccccatctaggaatctgggaagggctggccctctcttagaagccatttgaaattactgcagggattagctccctgtggtggagcatacacagggtactctggggtcgaggtgagaggtgatgtggtattcagtgcccgtcagccaactgtgggccttcacctctacctgcacttcccctctcacaccagctgcactcccgtggctgccagagcagggtggttttccccaatacctggagctcagaaaggcagagccatctggccctccagggtgtccccagccatcaggagacttgagttggtatttggacctgagcccgcacattccactcccattctccctccaagaggggcccagcattgtatttccctgtgaccccttactctcctggccagaacttgagccagctgtgggatgttgctgcaggacagtaagccctcacctgggcaaacatgaagctctggcctcctttcctcagccccttgttcttccctgtcctccaccctggaccccagccggctgctggagcccagaggccaccttctccctgcatcctgaatgatgcttagtcagaagcctgtgttggaacatccctcgtttacggggcgctggcctacctcctgaggacctcagccacagatgagatcacacgcatgcacgtgcacacatgtacacacacacacctacctgcacagcacgctgttgagtgttggttgctagagtatctggctggctgctgtgtgcctggtttcctcacatcctgcctcagcttcaccaccctggcttatgtggaacacctatcagggagcagaaaaggggtgcagtacactaagtgaacccagattctggattcttggtgtccacagcctagctgatacgagatagcccataggacacctggtttaggtagaaggagcctcctcaaaggcagtgctgggcacccacgggtgtgctggatactggagtttgagaggagggaggtgctggggccaaaggagacactagaaaagtggtagatgggacaggtaagtggcagaggtgaggggataagttagaatgtaaaagggcagtaattaggggtgagggaaaggagataggggaccctaggaggtagagtgggaccatgtcgtgaggcagttgaagagttgaggaaaggtttttctgggccctactgctcccctctgctgcaggtaagtcagagcagctttaccacagcttcaggccacgagagccccttcacccgccctgctgcgccataggcagaggcttataaagaaatgggttctgggccaggtgtggtggctcaagcctgtaatcccagcactttgggaggccgaggcgggtggatcacctgaggttaggagttcgagatcagcctggccaacatggtgaaaccctgtctactaaaaataaaaaaattagctgggcgtggtggtgggcgcctgtaatcccagctactcgggaggtttaggcaggagaatcgcttgaaccctggaggtggaggtggaggttgcagtgagccgagatcgcgccattgcactccaacctaggtgacaaagctacacgccatctcaaaaaaaaaaaagaaaaagggttacaaaaggttcccagctccggggcatcagcctgagtgcgcttgagctgctccaaacctggcccttccccactcctctagcatcgccacccgcatggccctggaactcccgcggcggcgggggcgggcccgtgcctgctgtgccccgacttcccacaccagccgcgcccaccgcaggtgggactcaggttcgccctctgggccaggtccttcacgaggagggagctacccttcgccagaagtttgtgagaatgtggccgcccttttcctgccctctgccccatgtgggtggggggcctcgtggcccggccggcgccccgtccccttctgcatgtctgaggccaccggcaaccgccgccccactccagatttgcccccgccttgttttgaaagccccttatttataacttttatactttgtgcaggtcgcggcgcttcctgcctcatcctcggctgcatggggcgggggcgctgtttttaacgtgcccgtttgtactgatgtatgaacttgtcaataaacacaattgtttgttaa

SEQ ID NO: 5017 - DNA, 908 bp, Homo sapiens
agagcgagctctggaggatagggagtgggggagggaggctcccgtggcagaacgagttgtgggctacggcgagccccgccgcgtccccgccggcgctagcgcaggtgtccaggcctgcggaaatccctggtggtctcggcggcctcctcccttggacactacagttgccatgggaacagttgggcattaacgggaaccagatcgtccacgagaccaactggggcccatcccatccatctcgccagttaaacgcctctggcgggcgtgggcctggcatttcttcgtggcttaggattttccccccctttttcgtgagcctttccttccgacgttgtaagaaactgtgcagggctagaaggtggggatgagggaaatggtgagagcaatacccagaggtaaaagctgcagacttcgctaggcagaagggtttctcgtcataatggctgtggaagggtcaaccattaccagccggatcaagaatctgttgagatctccatccatcaaactgcgcaggagtaaggcaggaaaccgacgagaggacctcagctccaaggtgaccttggagaaggtgctgggaattacagtgtctggaggcagaggacttgcctgtgacccccgatcaggtttagttgcttacccagcagggtgtgtggttgtgttgttcaatccccggaaacacaaacagcaccacatcctcaacagttccaggaaaaccatcactgcccttgccttctcccctgatggcaagtacttggtcactggagagagtgggcacatgcctgccgtgcgggtttgggacgtggcagagcacagccaggtggccgagctgcaggagcacaagtatggtgtggcttgtgtggccttctctcctagcgccaagtacattgtctctgtgggctaccagcatg

SEQ ID NO: 5018 - DNA, 5394 bp, Homo sapiens
ggagctgaaattgccgaacgcgatgcccgagggcgctgtgagcggggtggccttagctcgccgaggctggtcagtgagagggcatactgggaagccctctggagtgggaagacagtgccgctgttgagacaagacccaggactgggccggggactgtcccaaagggtttctcgtcataatggctgtggaagggtcaaccattaccagccggatcaagaatctgttgagatctccatccatcaaactgcgcaggagtaaggcaggaaaccgacgagaggacctcagctccaaggtgaccttggagaaggtgctgggaattacagtgtctggaggcagaggacttgcctgtgacccccgatcaggtttagttgcttacccagcagggtgtgtggttgtgttgttcaatccccggaaacacaaacagcaccacatcctcaacagttccaggaaaaccatcactgcccttgccttctcccctgatggcaagtacttggtcactggagagagtgggcacatgcctgccgtgcgggtttgggacgtggcagagcacagccaggtggccgagctgcaggagcacaagtatggtgtggcttgtgtggccttctctcctagcgccaagtacattgtctctgtgggctaccagcatgacatgatcgtcaacgtgtgggcctggaagaaaaacattgtggtggcctccaacaaggtgtccagtcgggtgacagcagtgtccttctctgaggattgcagctactttgtcactgcaggcaaccgacacatcaaattctggtatctcgatgacagcaagacctcaaaggtgaatgccactgtgcccttgctgggccgctcagggctgctgggagagctacggaacaacctattcactgatgtggcctgtggcagaggaaaaaaggcggacagtaccttctgcatcacgtcctcagggctgctgtgcgagttcagtgatcgaaggcttttggacaagtgggtggagctgaggaccacagtggcccactgcatctctgtgagccaagactacatcttctgtggctgtgctgatggcaccgtgcgccttttcaacccctctaacctgcacttccttagcaccttgccccgaccccatgctctggggacagacattgctagcgtcaccgaggccagtcgcctcttctctggagtggcgaatgccaggtatccagacaccattgccttgacctttgatcctactaatcagtggctgtcttgtgtgtacaacgatcatagcatttatgtttgggatgtgagggaccccaagaaagtgggcaaggtgtactcggctctgtatcattcttcctgcgtctggagtgtggaggtctaccccgaggtgaaggatagtaaccaggcctgcctgccccccagttcctttattacctgctcctcagacaacaccatccgcctgtggaacacagagagctccggggtgcatggctccaccctccaccgaaacatcctcagcagtgacctcattaaaatcatctatgtggatgggaacacccaggccctgctggacacagagctgcctggaggagacaaagctgatgcatccctgttggatccccgcgtgggcatccgctcggtgtgtgtcagccccaatggacagcatctagcatcaggggaccgtatgggcacacttagggtgcacgaacttcagtccctgagtgagatgctgaaggtggaggcccatgactctgagattctgtgcctggagtattctaagccagacacaggtctgaaactgctagcatcggcgagccgggaccggctgatccatgtgctggatgccgggcgggagtacagcctacagcagacgctggacgaacactcatcctccatcactgctgttaagtttgcagccagtgatgggcaagtccgcatgatcagctgtggagcagacaagagcatctacttccgcactgcgcagaagtctggagatggagtgcagttcacacggacacaccacgtggtgcggaagacgaccctctatgacatggatgtggagcccagctggaagtacacggctatcggctgccaggaccgaaatattcggatatttaacatcagcagtggaaagcagaagaagctgtttaaagggtcacagggtgaggacggcacactcattaaggtgcagacagacccctcagggatctacattgccaccagctgttctgacaagaatctctccatttttgacttctcctcaggcgagtgcgtggccaccatgtttggccactcagagattgtcactggcatgaaatttagtaatgattgtaaacatctcatctctgtgtctggggacagctgcatatttgtgtggcgcctgagctctgagatgaccatcagcatgaggcagcgtctggccgagttgcgccagcgtcagcggggcggcaagcagcaaggaccatcctctccccaaagggcttctggacccaaccggcaccaggccccatcaatgctgtctcctggaccggctctctcatcagacagtgacaaggagggagaagatgaggggactgaagaagaacttccagcactgcccgtccttgccaagagtaccaagaaggcactggcctcggtccccagcccagctttgccccgaagcctgtcccactgggagatgagtcgggcacaggagtccgtggggttcctggacccagctcctgcagccaacccaggacccagaagaagagggcgctgggttcagccaggtgtggaactgagcgttagatccatgctggatctgcggcagctggaaacactggccccaagcctgcaggaccctagccaggactcgctggccatcatcccatctggtcccaggaagcatgggcaggaggcccttgagacttcactcactagccagaatgaaaagccccctcggcctcaggcttcccaaccttgttcctatccccatattatccgattattgtcacaagaggaaggggtctttgcccaagatctggaacctgcacccattgaagatggtattgtctacccggagccgagtgacaaccccaccatggataccagtgagttccaagtgcaggctccagcccggggaactctgggaagagtgtacccaggcagcaggagctcagaaaagcacagccctgacagtgcctgctctgtggattacagcagcagctgcctttccagcccggagcaccccactgaagactctgagagcacggagcccctcagtgtggatggcatctcctcagaccttgaagagccagctgagggtgatgaagaagaggaagaagaggagggaggcatgggcccctatgggctacaggagggcagcccccagactccagaccaggagcagtttctaaaacagcactttgagactctggccagtggagctgctccaggggccccagtgcaggtcccagagaggtcagagtctcggagtatctcttcacgattcctgttgcaagtacagacccgcccactcagggaaccatccccatcctcctcaagcctggcactgatgtcgagaccagcccaggtgccacaggcatctgagccagcggtgagcctggagcagtgtgagcagctggtggcagagctccgcggcagcgtgcgccaggcagtgcggctctaccactcggtggctggctgcaagatgccctcagcagagcaaagtcggattgcccagctcctcagagacaccttctcttcagtgcgacaggagctggaagctgtggctggggcagtgctgtccagcccaggcagcagccctggggctgtgggagccgagcagacacaggccctgctggagcaatactcagaactgttgcttcgagccgtggaacggcgtatggaacgcaaactctgagttctggaagcctgtcccaagtgaatgaatgctccagcgattccaaactgcagcccctctgcccctcaccaaaacctgcggggctgcttggagtggaaagcagggagcagtgttcagaggcaaagcagccttcccagccgctcctcgtggggggcctgtatttattaatttatttccctgactgttgcctcacttccttggaactcctgcctccacagcccctccagtggcagggacaggtcttgggtctttgtcatcttggtgctgtgagaggtaggagggcagcctgccccatctaggaatctgggaagggctggccctctcttagaagccatttgaaattactgcagggattagctccctgtggtggagcatacacagggtactctggggtcgaggtgagaggtgatgtggtattcagtgcccgtcagccaactgtgggccttcacctctacctgcacttcccctctcacaccagctgcactcccgtggctgccagagcagggtggttttccccaatacctggagctcagaaaggcagagccatctggccctccagggtgtccccagccatcaggagacttgagttggtatttggacctgagcccgcacattccactcccattctccctccaagaggggcccagcattgtatttccctgtgaccccttactctcctggccagaacttgagccagctgtgggatgttgctgcaggacagtaagccctcacctgggcaaacatgaagctctggcctcctttcctcagccccttgttcttccctgtcctccaccctggaccccagccggctgctggagcccagaggccaccttctccctgcatcctgaatgatgcttagtcagaagcctgtgttggaacatccctcgtttacggggcgctggcctacctcctgaggacctcagccacagatgagatcacacgcatgcacgtgcacacatgtacacacacacacctacctgcacagcacgctgttgagtgttggttgctagagtatctggctggctgctgtgtgcctggtttcctcacatcctgcctcagcttcaccaccctggcttatgtggaacacctatcagggagcagaaaaggggtgcagtacactaagtgaacccagattctggattcttggtgtccacagcctagctgatacgagatagcccataggacacctggtttaggtagaaggagcctcctcaaaggcagtgctgggcacccacgggtgtgctggatactggagtttgagaggagggaggtgctggggccaaaggagacactagaaaagtggtagatgggacaggtaagtggcagaggtgaggggataagttagaatgtaaaagggcagtaattaggggtgagggaaaggagataggggaccctaggaggtagagtgggaccatgtcgtgaggcagttgaagagttgaggaaaggtttttctgggccctactgctcccctctgctgcaggtaagtcagagcagctttaccacagcttcaggccacgaga

SEQ ID NO: 5019 - DNA, 4362 bp, Homo sapiens
aaggggagggggaggagcggcgaaagcggaagccatgttggagtttcaccccgagcgaggggctgcgagggttctcctctccttgtgggtgtgaccaggttcggcgcggcggcgggccgcggggggcggggacgattggccgcttgtcgtcgtccgcagcggcgtgaggggagcggcggcggcggcggcggccgcagcgtggagccgggtgattgtgaccgccgggggagccgggagccggccgcggcgccctctctccgtgtggccccctgagcggcccccctcccctgcccgggagggaggcggggggcacctggggcccgccatgaaccccggcttcgatttgtcccgccggaacccgcaggaggacttcgagctgattcagcgcatcggcagcggcacctacggcgacgtctacaaggcacggaatgttaacactggtgaattagcagcaattaaagtaataaaattggaaccaggagaagactttgcagttgtgcagcaagaaattattatgatgaaagactgtaaacacccaaatattgttgcttattttggaagctatctcaggcgagataagctttggatttgcatggagttttgtggaggtggttctttacaggatatttatcacgtaactggacctctgtcagaactgcaaattgcatatgttagcagagaaacactgcagggattatattatcttcacagtaaaggaaaaatgcacagagatataaagggagctaacattctattaacggataatggtcatgtgaaattggctgattttggagtatctgcacagataacagctacaattgccaaacggaagtctttcattggcacaccatattggatggctccagaagttgcagctgttgagaggaaggggggttacaatcaactctgtgatctctgggcagtgggaatcactgccatagaacttgcagagcttcagcctcctatgtttgacttacacccaatgagagcattatttctaatgacaaaaagcaattttcagcctcctaaactaaaggataaaatgaaatggtcaaatagttttcatcactttgtgaaaatggcacttaccaaaaatccgaaaaaaagacctactgctgaaaaattattacagcatccttttgtaacacaacatttgacacggtctttggcaatcgagctgttggataaagtaaataatccagatcattccacttaccatgatttcgatgatgatgatcctgagcctcttgttgctgtaccacatagaattcactcaacaagtagaaacgtgagagaagaaaaaacacgctcagagataacctttggccaagtgaaatttgatccacccttaagaaaggagacagaaccacatcatgaacttcccgacagtgatggttttttggacagttcagaagaaatatactacactgcaagatctaatctggatctgcaactggaatatggacaaggacaccaaggtggttactttttaggtgcaaacaagagtcttctcaagtctgttgaagaagaattgcatcagcgaggacacgtcgcacatttagaagatgatgaaggagatgatgatgaatctaaacactcaactctgaaagcaaaaattccacctcctttgccaccaaagcctaagtctatcttcataccacaggaaatgcattctactgaggatgaaaatcaaggaacaatcaagagatgtcccatgtcagggagcccagcaaagccatcccaagttccacctagaccaccacctcccagattacccccacacaaacctgttgccttaggaaatggaatgagctccttccagttaaatggtgaacgagatggctcattatgtcaacaacagaatgaacatagaggcacaaacctttcaagaaaagaaaagaaagatgtaccaaagcctattagtaatggtcttcctccaacacctaaagtgcatatgggtgcatgtttttcaaaagtttttaatgggtgtcccttgaaaattcactgtgcatcatcatggataaacccagatacaagagatcagtacttgatatttggtgccgaagaagggatttataccctcaatcttaatgaacttcatgaaacatcaatggaacagctattccctcgaaggtgtacatggttgtatgtaatgaacaattgcttgctatcaatatctggtaaagcttctcagctttattcccataatttaccagggctttttgattatgcaagacaaatgcaaaagttacctgttgctattccagcacacaaactccctgacagaatactgccaaggaaattttctgtatcagcaaaaatccctgaaaccaaatggtgccagaagtgttgtgttgtaagaaatccttacacgggccataaatacctatgtggagcacttcagactagcattgttctattagaatgggttgaaccaatgcagaaatttatgttaattaagcacatagattttcctataccatgtccacttagaatgtttgaaatgctggtagttcctgaacaggagtaccctttagtttgtgttggtgtcagtagaggtagagacttcaaccaagtggttcgatttgagacggtcaatccaaattctacctcttcatggtttacagaatcagataccccacagacaaatgttactcatgtaacccaactggagagagataccatccttgtatgcttggactgttgtataaaaatagtaaatctccaaggaagattaaaatctagcaggaaattgtcatcagaactcacctttgatttccagattgaatcaatagtgtgcctacaagacagtgtgctagctttctggaaacatggaatgcaaggtagaagttttagatctaatgaggtaacacaagaaatttcagatagcacaagaattttcaggctgcttggatctgacagggtcgtggttttggaaagtaggccaactgataaccccacagcaaatagcaatttgtacatcctggcgggtcatgaaaacagttactgagaattgttgtgctttgacagttaactctagaaagaaagaacactaccactgcaacattaatggatgcttgaagctgtacaaaagctgcagtaacctgtcttcagttactttgtaatttattgtggcatgagataagatggggaaaattttgttttaagtggtatggatatatttagcatattgaaccacacaagtgcttaattcattgttatgtaatctttgtacatataggcagtattttttctgtgaaacttcatattgctgaagacatacactaagaatttatgtagataatgtacttttatgagatgtacaagtaagtgtcttatctgtacagatgtaaatgttgatgaaaatgcaattggggttaatattttaagaattctttagtatattcttgggtgtggctatattacaaaatgggatgctggcaatgaaacaatacatttaacactattgtatttttattatatgtaatttagtaatatgaatataaatcttgtaacttttaaaattgtaatggaggctgtaatcattttataatctttttaattttaatgcaagtacactggtgtttatatttgcacaaagtattgatatgtgatgtattaagtcacaaaagtaagctgtgacattgtctataagcatttggctccacaaatgtatttggattgttttctatgtgaagcaaaccaattataattaaccacatgttgtagtaactggtctttttatatttaagcagaatcctgtaagattgcttgtctttgcttaaaaacaatacctttgaacatttttgaatcacagaatagcggtaccatgatagaatactgcaattgtggtcagaattacagtatgcacaaagaattaattagcattattaaagagtcctcactaaacatttcatatgatcacactgaagaactgtaacattccatagagtgaagtggttcaaatttctcttggaatttttacttttgttggccttattttatgatccttttcatatttcttttgacttagagtattaatacatggccaaaataatttagttactacctcatacaaacaatataatggttactacacatcacaggaacttagttttggtttaagtcatttttgattgcttttttccaatggaatatgtatataccaggttttagcaaaatgcacacttttggctctttttggtatatgttctttatattttaatgtgagtatatacactaagaacaaactaaattgtgatttatgatcttcatttattttaatgataatggttttaaaatatgttcctgattgtacatattgtaaaataaacatgttttttaacatgctgttgtatagta

SEQ ID NO: 5020 - DNA, 4271 bp, Homo sapiens
gaggagcggcgaaagcggaagccatgttggagtttcaccccgagcgaggggctgcgagggttctcctctccttgtgggtgtgaccaggttcggcgcggcggcgggccgcggggggcggggacgattggccgcttgtcgtcgtccgcagcggcgtgaggggagcggcggcggcggcggcggccgcagcgtggagccgggtgattgtgaccgccgggggagccgggagccggccgcggcgccctctctccgtgtggccccctgagcggcccccctcccctgcccgggagggaggcggggggcacctggggcccgccatgaaccccggcttcgatttgtcccgccggaacccgcaggaggacttcgagctgattcagcgcatcggcagcggcacctacggcgacgtctacaaggcacggaatgttaacactggtgaattagcagcaattaaagtaataaaattggaaccaggagaagactttgcagttgtgcagcaagaaattattatgatgaaagactgtaaacacccaaatattgttgcttattttggaagctatctcaggcgagataagctttggatttgcatggagttttgtggaggtggttctttacaggatatttatcacgtaactggacctctgtcagaactgcaaattgcatatgttagcagagaaacactgcagggattatattatcttcacagtaaaggaaaaatgcacagagatataaagggagctaacattctattaacggataatggtcatgtgaaattggctgattttggagtatctgcacagataacagctacaattgccaaacggaagtctttcattggcacaccatattggatggctccagaagttgcagctgttgagaggaaggggggttacaatcaactctgtgatctctgggcagtgggaatcactgccatagaacttgcagagcttcagcctcctatgtttgacttacacccaatgagagcattatttctaatgacaaaaagcaattttcagcctcctaaactaaaggataaaatgaaatggtcaaatagttttcatcactttgtgaaaatggcacttaccaaaaatccgaaaaaaagacctactgctgaaaaattattacagcatccttttgtaacacaacatttgacacggtctttggcaatcgagctgttggataaagtaaataatccagatcattccacttaccatgatttcgatgatgatgatcctgagcctcttgttgctgtaccacatagaattcactcaacaagtagaaacgtgagagaagaaaaaacacgctcagagataacctttggccaagtgaaatttgatccacccttaagaaaggagacagaaccacatcatgaacttgatctgcaactggaatatggacaaggacaccaaggtggttactttttaggtgcaaacaagagtcttctcaagtctgttgaagaagaattgcatcagcgaggacacgtcgcacatttagaagatgatgaaggagatgatgatgaatctaaacactcaactctgaaagcaaaaattccacctcctttgccaccaaagcctaagtctatcttcataccacaggaaatgcattctactgaggatgaaaatcaaggaacaatcaagagatgtcccatgtcagggagcccagcaaagccatcccaagttccacctagaccaccacctcccagattacccccacacaaacctgttgccttaggaaatggaatgagctccttccagttaaatggtgaacgagatggctcattatgtcaacaacagaatgaacatagaggcacaaacctttcaagaaaagaaaagaaagatgtaccaaagcctattagtaatggtcttcctccaacacctaaagtgcatatgggtgcatgtttttcaaaagtttttaatgggtgtcccttgaaaattcactgtgcatcatcatggataaacccagatacaagagatcagtacttgatatttggtgccgaagaagggatttataccctcaatcttaatgaacttcatgaaacatcaatggaacagctattccctcgaaggtgtacatggttgtatgtaatgaacaattgcttgctatcaatatctggtaaagcttctcagctttattcccataatttaccagggctttttgattatgcaagacaaatgcaaaagttacctgttgctattccagcacacaaactccctgacagaatactgccaaggaaattttctgtatcagcaaaaatccctgaaaccaaatggtgccagaagtgttgtgttgtaagaaatccttacacgggccataaatacctatgtggagcacttcagactagcattgttctattagaatgggttgaaccaatgcagaaatttatgttaattaagcacatagattttcctataccatgtccacttagaatgtttgaaatgctggtagttcctgaacaggagtaccctttagtttgtgttggtgtcagtagaggtagagacttcaaccaagtggttcgatttgagacggtcaatccaaattctacctcttcatggtttacagaatcagataccccacagacaaatgttactcatgtaacccaactggagagagataccatccttgtatgcttggactgttgtataaaaatagtaaatctccaaggaagattaaaatctagcaggaaattgtcatcagaactcacctttgatttccagattgaatcaatagtgtgcctacaagacagtgtgctagctttctggaaacatggaatgcaaggtagaagttttagatctaatgaggtaacacaagaaatttcagatagcacaagaattttcaggctgcttggatctgacagggtcgtggttttggaaagtaggccaactgataaccccacagcaaatagcaatttgtacatcctggcgggtcatgaaaacagttactgagaattgttgtgctttgacagttaactctagaaagaaagaacactaccactgcaacattaatggatgcttgaagctgtacaaaagctgcagtaacctgtcttcagttactttgtaatttattgtggcatgagataagatggggaaaattttgttttaagtggtatggatatatttagcatattgaaccacacaagtgcttaattcattgttatgtaatctttgtacatataggcagtattttttctgtgaaacttcatattgctgaagacatacactaagaatttatgtagataatgtacttttatgagatgtacaagtaagtgtcttatctgtacagatgtaaatgttgatgaaaatgcaattggggttaatattttaagaattctttagtatattcttgggtgtggctatattacaaaatgggatgctggcaatgaaacaatacatttaacactattgtatttttattatatgtaatttagtaatatgaatataaatcttgtaacttttaaaattgtaatggaggctgtaatcattttataatctttttaattttaatgcaagtacactggtgtttatatttgcacaaagtattgatatgtgatgtattaagtcacaaaagtaagctgtgacattgtctataagcatttggctccacaaatgtatttggattgttttctatgtgaagcaaaccaattataattaaccacatgttgtagtaactggtctttttatatttaagcagaatcctgtaagattgcttgtctttgcttaaaaacaatacctttgaacatttttgaatcacagaatagcggtaccatgatagaatactgcaattgtggtcagaattacagtatgcacaaagaattaattagcattattaaagagtcctcactaaacatttcatatgatcacactgaagaactgtaacattccatagagtgaagtggttcaaatttctcttggaatttttacttttgttggccttattttatgatccttttcatatttcttttgacttagagtattaatacatggccaaaataatttagttactacctcatacaaacaatataatggttactacacatcacaggaacttagttttggtttaagtcatttttgattgcttttttccaatggaatatgtatataccaggttttagcaaaatgcacacttttggctctttttggtatatgttctttatattttaatgtgagtatatacactaagaacaaactaaattgtgatttatgatcttcatttattttaatgataatggttttaaaatatgttcctgattgtacatattgtaaaataaacatgttttttaa

SEQ ID NO: 5021 - DNA, 2564 bp, Homo sapiens
tttcagcctcctaaactaaaggataaaatgaaatggtcaaatagttttcatcactttgtgaaaatggcacttaccaaaaatccgaaaaaaagacctactgctgaaaaattattacagcatccttttgtaacacaacatttgacacggtctttggcaatcgagctgttggataaagtaaataatccagatcattccacttaccatgatttcgatgatgatgatcctgagcctcttgttgctgtaccacatagaattcactcaacaagtagaaacgtgagagaagaaaaaacacgctcagagataacctttggccaagtgaaatttgatccacccttaagaaaggagacagaaccacatcatgaacttcccgacagtgatggttttttggacagttcagaagaaatatactacactgcaagatctaatctgtgaactgtatcaattctattgacttcctgctgctttctcatcaggatctgcaactggaatatggacaaggacaccaaggtggttactttttaggtgcaaacaagagtcttctcaagtctgttgaagaagaattgcatcagcgaggacacgtcgcacatttagaagatgatgaaggagatgatgatgaatctaaacactcaactctgaaagcaaaaattccacctcctttgccaccaaagcctaagtctatcttcataccacaggaaatgcattctactgaggatgaaaatcaaggaacaatcaagagatgtcccatgtcagggagcccagcaaagccatcccaagttccacctagaccaccacctcccagattacccccacacaaacctgttgccttaggaaatggaatgagctccttccagttaaatggtgaacgagatggctcattatgtcaacaacagaatgaacatagaggcacaaacctttcaagaaaagaaaagaaagatgtaccaaagcctattagtaatggtcttcctccaacacctaaagtgcatatgggtgcatgtttttcaaaagtttttaatgggtgtcccttgaaaattcactgtgcatcatcatggataaacccagatacaagagatcagtacttgatatttggtgccgaagaagggatttataccctcaatcttaatgaacttcatgaaacatcaatggaacagctattccctcgaaggtgtacatggttgtatgtaatgaacaattgcttgctatcaatatctggtaaagcttctcagctttattcccataatttaccagggctttttgattatgcaagacaaatgcaaaagttacctgttgctattccagcacacaaactccctgacagaatactgccaaggaaattttctgtatcagcaaaaatccctgaaaccaaatggtgccagaagtgttgtgttgtaagaaatccttacacgggccataaatacctatgtggagcacttcagactagcattgttctattagaatgggttgaaccaatgcagaaatttatgttaattaagcacatagattttcctataccatgtccacttagaatgtttgaaatgctggtagttcctgaacaggagtaccctttagtttgtgttggtgtcagtagaggtagagacttcaaccaagtggttcgatttgagacggtcaatccaaattctacctcttcatggtttacagaatcagataccccacagacaaatgttactcatgtaacccaactggagagagataccatccttgtatgcttggactgttgtataaaaatagtaaatctccaaggaagattaaaatctagcaggaaattgtcatcagaactcacctttgatttccagattgaatcaatagtgtgcctacaagacagtgtgctagctttctggaaacatggaatgcaaggtagaagttttagatctaatgaggtaacacaagaaatttcagatagcacaagaattttcaggctgcttggatctgacagggtcgtggttttggaaagtaggccaactgataaccccacagcaaatagcaatttgtacatcctggcgggtcatgaaaacagttactgagaattgttgtgctttgacagttaactctagaaagaaagaacactaccactgcaacattaatggatgcttgaagctgtacaaaagctgcagtaacctgtcttcagttactttgtaatttattgtggcatgagataagatggggaaaattttgttttaagtggtatggatatatttagcatattgaaccacacaagtgcttaattcattgttatgtaatctttgtacatataggcagtattttttctgtgaaacttcatattgctgaagacatacactaagaatttatgtagataatgtacttttatgagatgtacaagtaagtgtcttatctgtacagatgtaaatgttgatgaaaatgcaattggggttaatattttaagaattctttagtatattcttgggtgtggctatattacaaaatgggatgctggcaatgaaacaatacatttaacactattgtatttttattatatgtaatttagtaatatgaatataaatcttgtaacttttaaaattgtaatggag

SEQ ID NO: 5022 - DNA, 1242 bp, Homo sapiens
tagaatgggttgaaccaatgcagaaatttatgttaattaagcacatagattttcctataccatgtccacttagaatgtttgaaatgctggtagttcctgaacaggagtaccctttagtttgtgttggtgtcagtagaggtagagacttcaaccaagtggttcgatttgagacggtcaatccaaattctacctcttcatggtttacagaatcagataccccacagacaaatgttactcatgtaacccaactggagagagataccatccttgtatgcttggactgttgtataaaaatagtaaatctccaaggaagattaaaatctagcaggaaattgtcatcagaactcacctttgatttccagattgaatcaatagtgtgcctacaagacagtgtgctagctttctggaaacatggaatgcaaggtagaagttttagatctaatgaggtaacacaagaaatttcagatagcaagaattttcaggctgcttggatctgacagggtcgtggttttggaaagtaggccaactgataaccccacagcaaatagcaatttgtacatcctggcgggtcatgaaaacagttactgagaattgttgtgctttgacagttaactctagaaagaaagaacactaccactgcaacattaatggatgcttgaagctgtacaaaagctgcagtaacctgtcttcagttactttgtaatttattgtggcatgagataagatggggaaaattttgttttaagtggtatggatatatttagcatattgaaccacacaagtgcttaattcattgttatgtaatctttgtacatataggcagtattttttctgtgaaacttcatattgctgaagacatacactaagaatttatgtagataatgtacttttatgagatgtacaagtaagtgtcttatctgtacagatgtaaatgttgatgaaaatgcaattggggttaatattttaagaattctttagtatattcttgggtgtggctatattacaaaatgggatgctggcaatgaaacaatacatttaacactattgtatttttattatatgtaatttagtaatatgaatataaatcttgtaacttttaaaattgtaatggaggctgtaatcattttataatctttttaattttaatgcaagtacactggtgtttatatttgcacaaagtattgatatgtgatgtattaagtcacaaaagtaagctgtgacattgtctataagcatttggct

SEQ ID NO: 5023 - DNA, 4005 bp, Homo sapiens
taattttctcattgttttcatgttttgagtaaggtagtttcacaactgatatgattcatttagcttttttaacaaagccaatattggttaatatgattgttgtggttaatatggttaataatgttctttttagtgacttcagatgaaagcaataaaacttggggaaggaacacagtctttcgacaagaagaatttgaggatgtaaaaaggaattttaagaaaaaaggttgtacctggggaccaaattccattcaaatgaaagatagaacagattgcaaagaaaggataagacctctctccgatggcaacagtccttggtcaactatcttaataaaaaatcagaaaaccatgcccttggcttcattgtttgtggaccagccagggtcctgtgaagagccaaaactttcccctgatggattagaacacagaaaaccaaaacaaataaaattgcctagtcaggcctacattgatctacctcttgggaaagatgctcagagagagaatcctgcagaagctgaaagctgggaggaggcagcctctgcgaatgctgccacagtctccattgagatgactcctacgaatagtctgagtagatccccccagagaaagaaaacggagtcagctctgtatgggtgcaccgtccttctggcatcggtggctctgggactggacctcagagagcttcataaagcacaggctgctgaagaaccgttgcccaaggaagagaagaagaaacgagagggaatcttccagcgggcttccaagtcccgcagaagcgccagtcctcccacaagcctgccatccacctgtggggaggccagcagcccaccctccctgccactgtcaagtgccctgggcatcctctccacaccttctttctccacaaagtgcctgctgcagatggacagtgaagatccactggtggacagtgcacctgtcacttgtgactctgagatgctcactccggatttttgtcccactgccccaggaagtggtcgtgagccagccctcatgccaagacttgacactgattgtagtgtatcaagaaacttgccgtcttccttcctacagcagacatgtgggaatgtaccttactgtgcttcttcaaaacatagaccgtcacatcacagacggaccatgtctgatggaaatccgaccccaactggtgcaactattatctcagccactggagcctctgcactgccactctgcccctcacctgctcctcacagtcatctgccaagggaggtctcacccaagaagcacagcactgtccacatcgtgcctcagcgtcgccctgcctccctgagaagccgctcagatctgcctcaggcttacccacagacagcagtgtctcagctggcacagactgcctgtgtagtgggtcgcccaggaccacatcccacccaattcctcgctgccaaggagagaactaaatcccatgtgccttcattactggatgctgacgtggaaggtcagagcagggactacactgtgccactgtgcagaatgaggagcaaaaccagccggccatctatatatgaactggagaaagaattcctgtcttaaactaagtgccttactgttgtttaagcatttttttaaggtgaacaaatgaacacaatgtatctacctttgaactgtttcatgctgctgtgttttcaaaagctgtggccatgttcctaaattagtaagatatatccagcttctcaaaaaatgtatatgattgctgttagccatgtctattgtttttcctctggattcttttcttataacttggaatacacaaaagtgtaaaacaagagatgtgcaccaatgaaaactatgctgggtcgaattaccttcagcacaatgttaatgtttttgttctcatttatgcctttgtccatttgcacacaacagaaattgtaatgagcttcactatttttgtttctttccttccttttttttcttttttcctttctttcctttttcttgtcttgtttcttgtttttttttcttgtagtttcttttcttaattgtcatttttgcaacaaaaagccaagaaagagctttagtttcttggcaagaataatgtgatattagtaagtaaaggtcttaaaagtctgacgactggaatagatataaagtcctgtttaaactacctaaccttggctgtgggccgataatgcatatgtccagttctcacttaaattatgcaatgatatttctctctgaggaaattatacggaatgtaacttataaaagctttactgaatataagttataagcattttattcattagaactccaaaatagatgttcaaagttcagtccttgccatttgactgagaccacatggtgtgccccttgagtgaggctaatctttaggtttttcctatagaaaacattcttcctccatcagtagccctttatttgatattcagaagtggaaagctttttcattctccagtagaacttttaaaaattgttacagatacctagctcttcacagatatcatgtactgtaaacagtcatgtgtcttaattttattttctctatttgagtgcataattatcctaataatcccaaagacactgacaactcaaggaacagcagtacagtactattagaagttaagtatgttgttgttatttcacatttcatttaattgtggataaatgttagacatctgttgaaataagctcatatggtggaaacgacaactatattatgaattattttcagaaatggatctttgaatagcagatcaggatttaaataataaaattatctatgaatcacttttatggtcatacatatatgatacaaatccagagttattggtgcagaaatggctacccgagagcttggtaaatttgccttggtttcttatgttaaatgtattgtgcttcccttctgtctctagaatgtggctcttcagaagacagacaatcgacatttaaatttttccaaacaatgaaaaactaaattaaaaacattgcttgatatttcatttaaaattgcaccttgcttaaggtttactgaataactgaaatgtcagcaatttaaaataaattcaattgtgtgataaaatatctcacctataatagaagaaaaggaaaatcatattatttggcaattttgcagcattgtggttgcctaacaggtatatccagcagatgagaaacagtatgaaaggattgtattaacatggtaagttttgccctaaggaaaacgatcttgcattctggattcttgcagcaaagtctcagatacttaatacgttttcttgttttatcatctgttctatgattcggcttcactttgtgtggttattgaattatgtaacagagatttggttttcccaaaatgttatcacatttgaaactatgattgctttgtgttcagtccttttggaacacgtagcttccagcttaagggtagagaaatatatacctaaaatcatcaatacatgaaagaaaaaggatggaaactatgtcctcagttttacttctaccaaaacatccctgtatgtgtgtgcatgtatgttggcgtgtgtgtgtgtgcatgcatattagtaaatgtgtgtttgcatgtgtgtgttggggagtgtatgtgatctgggtgtttgtttatctctgttattattcccctttagctttattttagtcaactctacattatgatgaatttcaaaatgaagctgtattaaaataattgtaatataacaattcaatctcacatgttactgcagatagttaacttttgctgcaatctattgtacatttgcaattttctgtgttagtaaacttagcagaatctggttatttatttttgtgtaggcttaatgttcactgaaagataagtcaattactgttagtaaaaaattaaggtactctcactgcagagatttaaggcctgggcctaatgtgctgtattatgaagccttgtgactgaaaaatatgtttacatatgttgtctatttttttaataaacttttatagctggtctatttgctcagt

SEQ ID NO: 5024 - DNA, 3910 bp, Homo sapiens
cagggcctgggcacgaccatggtgggacgtcgcccgcggcttcggggaccgctgcggcagcagaggcggctggccaggaacgcgggccgaggctggaccctttgggcagctagcccgtgatctctgccgtcaccgatcgcgattcctaccccctcgccttcccccggcgccgacggccacaccgccggacgatgcgcgcccgcggccgcccgggaggctgagcccagcttcccgctccgccttccccgcgcagctgcccccatggctttgcggggcgccgcgggagcgaccgacaccccggtgtcctcggccgggggagcccccggcggctcagcgtcctcgtcgtccacctcctcgggcggctcggcctcggcgggcgcggggctgtgggccgcgctctatgactacgaggctcgcggcgaggacgagctgagcctgcggcgcggccagctggtggaggtgctgtcgcaggacgccgccgtgtcgggcgacgagggctggtgggcaggccaggtgcagcggcgcctcggcatcttccccgccaactacgtggctccctgccgcccggccgccagccccgcgccgccgccctcgcggcccagctccccggtacacgtcgccttcgagcggctggagctgaaggagctcatcggcgctgggggcttcgggcaggtgtaccgcgccacctggcagggccaggaggtggccgtgaaggcggcgcgccaggacccggagcaggacgcggcggcggctgccgagagcgtgcggcgcgaggctcggctcttcgccatgctgcggcaccccaacatcatcgagctgcgcggcgtgtgcctgcagcagccgcacctctgcctggtgctggagttcgcccgcggcggagcgctcaaccgagcgctggccgctgccaacgccgccccggacccgcgcgcgcccggcccccgccgcgcgcgccgcatccctccgcacgtgctggtcaactgggccgtgcagatagcgcggggcatgctctacctgcatgaggaggccttcgtgcccatcctgcaccgggacctcaagtccagcaacattttgctacttgagaagatagaacatgatgacatctgcaataaaactttgaagattacagattttgggttggcgagggaatggcacaggaccaccaaaatgagcacagcaggcacctatgcctggatggcccccgaagtgatcaagtcttccttgttttctaagggaagcgacatctggagctatggagtgctgctgtgggaactgctcaccggagaagtcccctatcggggcattgatggcctcgccgtggcttatggggtagcagtcaataaactcactttgcccattccatccacctgccctgagccgtttgccaagctcatgaaagaatgctggcaacaagaccctcatattcgtccatcgtttgccttaattctcgaacagttgactgctattgaaggggcagtgatgactgagatgcctcaagaatcttttcattccatgcaagatgactggaaactagaaattcaacaaatgtttgatgagttgagaacaaaggaaaaggagctgcgatcccgggaagaggagctgactcgggcggctctgcagcagaagtctcaggaggagctgctaaagcggcgtgagcagcagctggcagagcgcgagatcgacgtgctggagcgggaacttaacattctgatattccagctaaaccaggagaagcccaaggtaaagaagaggaagggcaagtttaagagaagtcgtttaaagctcaaagatggacatcgaatcagtttaccttcagatttccagcacaagataaccgtgcaggcctctcccaacttggacaaacggcggagcctgaacagcagcagttccagtcccccgagcagccccacaatgatgccccgactccgagccatacagtgtgagctttctgcactgccacgggggctcctgtgttgacttctctcctttcacttgacttggattcaaattgagcagatgtgttttcatagcaggttgtagatgagtgtaggacatttcgtaggtgccacaactatttgagaaacaaaacttgagcataggttccttagtctaattttcttctactcacaaaaaatgaattttagatgctatgcagttggtgatgcgacctggccccggagtagaaagtgaaacaccacatctcgagacattctgttaaacacttgcacgcaacgttagcataacctaattctatcatcagccatttgtgtcagggtactttgaaaaatgaaatcaggaattcaggattacttctgtttctttctttgtttcgtgaggggaaaaaatttttgcttttcaggatttaactttaattcactttaggtttgaccaacctaatacttaaaaattccttgtagtgttttggttttagaacaagcattcatcctggaggagacagtacagacagctgattcgcctggcacctttgcattgtgagagtttcagttaggctatgaatcagaatgtagcggatgaaataaaattactaatttttttcaaaggtgagtccagataaacccctaaaagtaggctaagcgaaagaagaatgtgattaatgcgtatgtctgtaagtaatgtggtaattagcctaagtctgtggtaaaccattcatttggatcctctccttcctccaccaaacttaattccctgctgtttactcatccttatttggagaaaaaaaaaatccaaaagaaaattttgtctaatgaggcttgcatggaatctcatttttttttcctcttttgataatgaaaaccttggcaccagcagagatttcttttgcaagttctcggacaccaggatccccacagagaaactggatctaaatgaggctgtagttttagagcttaaaggactgtcatttattataactgatttggttttctgagaatgcattttgcataaaaccgtacctcaaaccttgcctttgcctaggcaaaggcctaattaacggagagagaaagggtcccaggctggtctcccagctccacgaagggatgagcagatgggacaccgtgccacccctgcttttgcctggccactcctctgccctctttcctgtgtcttcaccttctgctctggggaaaaccacctcacagaagccaggaagtggtactgggaaggcctggctgggcccaagatgtgtaccagttaaagtaaataatttgggacttcaaatgaattccaaccctccaaagttgaaatgcagccagcttagggaggcgcatccttggcgctccttctcagaagtaacatggtggaaaggttctaatcgagacagtccacacagggccagctttgtgtgtggcagctgttggctcaagttctccagcctggatgttgctcatcttcattgtgaccctgggtgctccaagaatgcctcttgtcttcatgtgtgtgcacacccccattcaattctgacagcctcattgagtggacccttttatgatccccaaatgcgggacagagaagttaccattaagctgacccaagttggtagctactaactggtgaagctggattcagacacatctgagtgtagatttcaccatccgtttccggcctcttagtacaggaaaagttcaatcaatgtggaaacaaaagagaaaccagaggagcaaatcaagaggggaaggaaagtaggaagggacgaaggtgaggagactaaagccgagagtgtagatagctctgggagtgtagatcagtcagtcagtcatatagccgagatgaacttgggtctaataacccccagctgaaagcttttccggttctgctgccctcacttaaatgaaaactgctgatccgtttatctgtcattctactgtaaaactcttttaataaaaagaatgaacag

SEQ ID NO: 5025 - DNA, 5809 bp, Homo sapiens
cagggcctgggcacgaccatggtgggacgtcgcccgcggcttcggggaccgctgcggcagcagaggcggctggccaggaacgcgggccgaggctggaccctttgggcagctagcccgtgatctctgccgtcaccgatcgcgattcctaccccctcgccttcccccggcgccgacggccacaccgccggacgatgcgcgcccgcggccgcccgggaggctgagcccagcttcccgctccgccttccccgcgcagctgcccccatggctttgcggggcgccgcgggagcgaccgacaccccggtgtcctcggccgggggagcccccggcggctcagcgtcctcgtcgtccacctcctcgggcggctcggcctcggcgggcgcggggctgtgggccgcgctctatgactacgaggctcgcggcgaggacgagctgagcctgcggcgcggccagctggtggaggtgctgtcgcaggacgccgccgtgtcgggcgacgagggctggtgggcaggccaggtgcagcggcgcctcggcatcttccccgccaactacgtggctccctgccgcccggccgccagccccgcgccgccgccctcgcggcccagctccccggtacacgtcgccttcgagcggctggagctgaaggagctcatcggcgctgggggcttcgggcaggtgtaccgcgccacctggcagggccaggaggtggccgtgaaggcggcgcgccaggacccggagcaggacgcggcggcggctgccgagagcgtgcggcgcgaggctcggctcttcgccatgctgcggcaccccaacatcatcgagctgcgcggcgtgtgcctgcagcagccgcacctctgcctggtgctggagttcgcccgcggcggagcgctcaaccgagcgctggccgctgccaacgccgccccggacccgcgcgcgcccggcccccgccgcgcgcgccgcatccctccgcacgtgctggtcaactgggccgtgcagatagcgcggggcatgctctacctgcatgaggaggccttcgtgcccatcctgcaccgggacctcaagtccagcaacattttgctacttgagaagatagaacatgatgacatctgcaataaaactttgaagattacagattttgggttggcgagggaatggcacaggaccaccaaaatgagcacagcaggcacctatgcctggatggcccccgaagtgatcaagtcttccttgttttctaagggaagcgacatctggagctatggagtgctgctgtgggaactgctcaccggagaagtcccctatcggggcattgatggcctcgccgtggcttatggggtagcagtcaataaactcactttgcccattccatccacctgccctgagccgtttgccaagctcatgaaagaatgctggcaacaagaccctcatattcgtccatcgtttgccttaattctcgaacagttgactgctattgaaggggcagtgatgactgagatgcctcaagaatcttttcattccatgcaagatgactggaaactagaaattcaacaaatgtttgatgagttgagaacaaaggaaaaggagctgcgatcccgggaagaggagctgactcgggcggctctgcagcagaagtctcaggaggagctgctaaagcggcgtgagcagcagctggcagagcgcgagatcgacgtgctggagcgggaacttaacattctgatattccagctaaaccaggagaagcccaaggtaaagaagaggaagggcaagtttaagagaagtcgtttaaagctcaaagatggacatcgaatcagtttaccttcagatttccagcacaagataaccgtgcaggcctctcccaacttggacaaacggcggagcctgaacagcagcagttccagtcccccgagcagccccacaatgatgccccgactccgagccatacagttgacttcagatgaaagcaataaaacttggggaaggaacacagtctttcgacaagaagaatttgaggatgtaaaaaggaattttaagaaaaaaggttgtacctggggaccaaattccattcaaatgaaagatagaacagattgcaaagaaaggataagacctctctccgatggcaacagtccttggtcaactatcttaataaaaaatcagaaaaccatgcccttggcttcattgtttgtggaccagccagggtcctgtgaagagccaaaactttcccctgatggattagaacacagaaaaccaaaacaaataaaattgcctagtcaggcctacattgatctacctcttgggaaagatgctcagagagagaatcctgcagaagctgaaagctgggaggaggcagcctctgcgaatgctgccacagtctccattgagatgactcctacgaatagtctgagtagatccccccagagaaagaaaacggagtcagctctgtatgggtgcaccgtccttctggcatcggtggctctgggactggacctcagagagcttcataaagcacaggctgctgaagaaccgttgcccaaggaagagaagaagaaacgagagggaatcttccagcgggcttccaagtcccgcagaagcgccagtcctcccacaagcctgccatccacctgtggggaggccagcagcccaccctccctgccactgtcaagtgccctgggcatcctctccacaccttctttctccacaaagtgcctgctgcagatggacagtgaagatccactggtggacagtgcacctgtcacttgtgactctgagatgctcactccggatttttgtcccactgccccaggaagtggtcgtgagccagccctcatgccaagacttgacactgattgtagtgtatcaagaaacttgccgtcttccttcctacagcagacatgtgggaatgtaccttactgtgcttcttcaaaacatagaccgtcacatcacagacggaccatgtctgatggaaatccgaccccaactggtgcaactattatctcagccactggagcctctgcactgccactctgcccctcacctgctcctcacagtcatctgccaagggaggtctcacccaagaagcacagcactgtccacatcgtgcctcagcgtcgccctgcctccctgagaagccgctcagatctgcctcaggcttacccacagacagcagtgtctcagctggcacagactgcctgtgtagtgggtcgcccaggaccacatcccacccaattcctcgctgccaaggagagaactaaatcccatgtgccttcattactggatgctgacgtggaaggtcagagcagggactacactgtgccactgtgcagaatgaggagcaaaaccagccggccatctatatatgaactggagaaagaattcctgtcttaaactaagtgccttactgttgtttaagcatttttttaaggtgaacaaatgaacacaatgtatctacctttgaactgtttcatgctgctgtgttttcaaaagctgtggccatgttcctaaattagtaagatatatccagcttctcaaaaaatgtatatgattgctgttagccatgtctattgtttttcctctggattcttttcttataacttggaatacacaaaagtgtaaaacaagagatgtgcaccaatgaaaactatgctgggtcgaattaccttcagcacaatgttaatgtttttgttctcatttatgcctttgtccatttgcacacaacagaaattgtaatgagcttcactatttttgtttctttccttccttttttttcttttttcctttctttcctttttcttgtcttgtttcttgtttttttttcttgtagtttcttttcttaattgtcatttttgcaacaaaaagccaagaaagagctttagtttcttggcaagaataatgtgatattagtaagtaaaggtcttaaaagtctgacgactggaatagatataaagtcctgtttaaactacctaaccttggctgtgggccgataatgcatatgtccagttctcacttaaattatgcaatgatatttctctctgaggaaattatacggaatgtaacttataaaagctttactgaatataagttataagcattttattcattagaactccaaaatagatgttcaaagttcagtccttgccatttgactgagaccacatggtgtgccccttgagtgaggctaatctttaggtttttcctatagaaaacattcttcctccatcagtagccctttatttgatattcagaagtggaaagctttttcattctccagtagaacttttaaaaattgttacagatacctagctcttcacagatatcatgtactgtaaacagtcatgtgtcttaattttattttctctatttgagtgcataattatcctaataatcccaaagacactgacaactcaaggaacagcagtacagtactattagaagttaagtatgttgttgttatttcacatttcatttaattgtggataaatgttagacatctgttgaaataagctcatatggtggaaacgacaactatattatgaattattttcagaaatggatctttgaatagcagatcaggatttaaataataaaattatctatgaatcacttttatggtcatacatatatgatacaaatccagagttattggtgcagaaatggctacccgagagcttggtaaatttgccttggtttcttatgttaaatgtattgtgcttcccttctgtctctagaatgtggctcttcagaagacagacaatcgacatttaaatttttccaaacaatgaaaaactaaattaaaaacattgcttgatatttcatttaaaattgcaccttgcttaaggtttactgaataactgaaatgtcagcaatttaaaataaattcaattgtgtgataaaatatctcacctataatagaagaaaaggaaaatcatattatttggcaattttgcagcattgtggttgcctaacaggtatatccagcagatgagaaacagtatgaaaggattgtattaacatggtaagttttgccctaaggaaaacgatcttgcattctggattcttgcagcaaagtctcagatacttaatacgttttcttgttttatcatctgttctatgattcggcttcactttgtgtggttattgaattatgtaacagagatttggttttcccaaaatgttatcacatttgaaactatgattgctttgtgttcagtccttttggaacacgtagcttccagcttaagggtagagaaatatatacctaaaatcatcaatacatgaaagaaaaaggatggaaactatgtcctcagttttacttctaccaaaacatccctgtatgtgtgtgcatgtatgttggcgtgtgtgtgtgtgcatgcatattagtaaatgtgtgtttgcatgtgtgtgttggggagtgtatgtgatctgggtgtttgtttatctctgttattattcccctttagctttattttagtcaactctacattatgatgaatttcaaaatgaagctgtattaaaataattgtaatataacaattcaatctcacatgttactgcagatagttaacttttgctgcaatctattgtacatttgcaattttctgtgttagtaaacttagcagaatctggttatttatttttgtgtaggcttaatgttcactgaaagataagtcaattactgttagtaaaaaattaaggtactctcactgcagagatttaaggcctgggcctaatgtgctgtattatgaagccttgtgactgaaaaatatgtttacatatgttgtctatttttttaataaacttttatagctggtctatttgctcagta

SEQ ID NO: 5026 - DNA, 1880 bp, Homo sapiens
agaaagcggctccagggagccagggcaccgtgagcctggtggttggcagctggagccacgtcggagggggaagtgtcgcagcattctctgcaggcatcacagacctgaggcagtggcctccggagggcactggacagaaacagccatccaagtggctgagtggagggaccctgctcaagtgcagctgcagtggccggggtttccctcaggtagggatcggggcgccttgtcgccgccagccacgtgtggcgtccggtacagtcagcagagtgcagggtgcgggcaccaggaaagggggcgcaggggaactcccgcgggcctcgcgtttgcaaacttctcgcctgggcaggaggcggtcgtgggaaagaaggtggaagagcgagctttttggaactgtgcacgggacagattggacgcacacccctcgggaggcgcgaaggcatggaaaatttgaagcatattatcacccttggccaggtcatccacaaacggtgtgaagagatgaaatactgcaagaaacagtgccggcgcctgggccaccgcgtcctcggcctgatcaagcctctggagatgctccaggaccaaggaaagaggagcgtgccctctgagaagttaaccacagccatgaaccgcttcaaggctgccctggaggaggctaatggggagatagaaaagttcagcaatagatccaatatctgcaggtttctaacagcaagccaggacaaaatactcttcaaggacgtgaacaggaagctgagtgatgtctggaaggagctctcgctgttacttcaggttgagcaacgcatgcctgtttcacccataagccaaggagcgtcctgggcacaggaagatcagcaggatgcagacgaagacaggcgagctttccagatgctaagaagagataatgaaaaaatagaagcttcactgagacgattagaaatcaacatgaaagaaatcaaggaaactttgaggcagtctttggaatcgtcctctgggaaatcgccactggagatatcccgtttcaaggtgaagaatgtgaagactggctcagccagtggctgtaattctgagaagatccgcaagctggtggctgtgaagcggcagcaggagccactgggtgaagactgcccttcagagctgcgggagatcattgatgagtgccgggcccatgatccctctgtgcggccctctgtggatgaaatcttaaagaaactctccaccttttctaagtagtgtatcaaaatctaaaccaaggagtctctggacaagaagctgggagaggcacaaactggacatctctctctctcatatccttcggcattgggttatctatgggtgcaaggagtgggcacgcttctctgttacaaatagaaaacgattccagtcatacaggacacatcccactccaaatgatatttccaaaaacatacctctgacagtaactttgatagatggtttgtcaaatgtatctttctgggtatccacacctcttggcaatgaaatttgcagctcctcccttccataaatgaagtctctttccccaccatttgaatctgggctggcactgtgacttgatttgatcaatagaatgtggaagaagtgactgtatgccagttccaagcctaggtttcaagaggccttataaatgtctgttggaaccttacccagccatgaacatgttgagtgagcatgctggagaatgagagaccacatgaagcagaaacatgctttcctagctgaagtcatactagcccaaccaacatggcagctaacacatgaatgaggccaatcaagaccagaagaaccactcaagcagatcccagcccaaattgcccattcacacaatcaggagctaaataaattactgttgtcttaacact

SEQ ID NO: 5027 - DNA, 2504 bp, Homo sapiens
agaaagcggctccagggagccagggcaccgtgagcctggtggttggcagctggagccacgtcggagggggaagtgtcgcagcattctctgcaggcatcacagacctgaggcagtggcctccggagggcactggacagaaacagccatccaagtggctgagtggagggaccctgctcaagtgcagctgcagtggccggggtttccctcaggtagggatcggggcgccttgtcgccgccagccacgtgtggcgtccggtacagtcagcagagtgcagggtgcgggcaccaggaaagggggcgcaggggaactcccgcgggcctcgcgtttgcaaacttctcgcctgggcaggaggcggtcgtgggaaagaaggtggaagagcgagctttttggaactgtgcacgggacagattggacgcacacccctcgggaggcgcgaaggcatggaaaatttgaagcatattatcacccttggccaggtcatccacaaacggtgtgaagagatgaaatactgcaagaaacagtgccggcgcctgggccaccgcgtcctcggcctgatcaagcctctggagatgctccaggaccaaggaaagaggagcgtgccctctgagaagttaaccacagccatgaaccgcttcaaggctgccctggaggaggctaatggggagatagaaaagttcagcaatagatccaatatctgcaggtttctaacagcaagccaggacaaaatactcttcaaggacgtgaacaggaagctgagtgatgtctggaaggagctctcgctgttacttcaggttgagcaacgcatgcctgtttcacccataagccaaggagcgtcctgggcacaggaagatcagcaggatgcagacgaagacaggcgagctttccagatgctaagaagagataatgaaaaaatagaagcttcactgagacgattagaaatcaacatgaaagaaatcaaggaaactttgaggcagtatttaccaccaaaatgcatgcaggagatcccgcaagagcaaatcaaggagatcaagaaggagcagctttcaggatccccgtggattctgctaagggaaaatgaagtcagcacactttataaaggagaataccacagagctccagtggccataaaagtattcaaaaaactccaggctggcagcattgcaatagtgaggcagactttcaataaggagatcaaaaccatgaagaaattcgaatctcccaacatcctgcgtatatttgggatttgcattgatgaaacagtgactccgcctcaattctccattgtcatggagtactgtgaactcgggaccctgagggagctgttggatagggaaaaagacctcacacttggcaagcgcatggtcctagtcctgggggcagcccgaggcctataccggctacaccattcagaagcacctgaactccacggaaaaatcagaagctcaaacttcctggtaactcaaggctaccaagtgaagcttgcaggatttgagttgaggaaaacacagacttccatgagtttgggaactacgagagaaaagacagacagagtcaaatctacagcatatctctcacctcaggaactggaagatgtattttatcaatatgatgtaaagtctgaaatatacagctttggaatcgtcctctgggaaatcgccactggagatatcccgtttcaaggctgtaattctgagaagatccgcaagctggtggctgtgaagcggcagcaggagccactgggtgaagactgcccttcagagctgcgggagatcattgatgagtgccgggcccatgatccctctgtgcggccctctgtggatgaaatcttaaagaaactctccaccttttctaagtagtgtatcaaaatctaaaccaaggagtctctggacaagaagctgggagaggcacaaactggacatctctctctctcatatccttcggcattgggttatctatgggtgcaaggagtgggcacgcttctctgttacaaatagaaaacgattccagtcatacaggacacatcccactccaaatgatatttccaaaaacatacctctgacagtaactttgatagatggtttgtcaaatgtatctttctgggtatccacacctcttggcaatgaaatttgcagctcctcccttccataaatgaagtctctttccccaccatttgaatctgggctggcactgtgacttgatttgatcaatagaatgtggaagaagtgactgtatgccagttccaagcctaggtttcaagaggccttataaatgtctgttggaaccttacccagccatgaacatgttgagtgagcatgctggagaatgagagaccacatgaagcagaaacatgctttcctagctgaagtcatactagcccaaccaacatggcagctaacacatgaatgaggccaatcaagaccagaagaaccactcaagcagatcccagcccaaattgcccattcacacaatcaggagctaaataaattactgttgtcttaacact

SEQ ID NO: 5028 - DNA, 2375 bp, Homo sapiens
gcgaggtggggtaggcgggcaaggcgggcgccgaggtttgcaaaggctcgcagcggccagaaacccggctccgagcggcggcggcccggcttccgctgcccgtgagctaaggacggtccgctccctctagccagctccgaatcctgatccaggcgggggccaggggcccctcgcctcccctctgaggaccgaagatgagcttcctcttcagcagccgctcttctaaaacattcaaaccaaagaagaatatccctgaaggatctcatcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtccagtcatgtctgcaggtccgagatatgaatatcactgggcagatggtactaatattaaaaagccaatcaaatgttctgcaccaaaatacattgactatttgatgacttgggttcaagatcagcttgatgatgaaactctttttccttctaagattggtgtcccatttcccaaaaactttatgtctgtggcaaagactattctaaagcgtctgttcagggtttatgcccatatttatcaccagcactttgattctgtgatgcagctgcaagaggaggcccacctcaacacctcctttaagcactttattttctttgttcaggagtttaatctgattgataggcgtgagctggcacctcttcaagaattaatagagaaacttggatcaaaagacagataaatgtttcttctagaacacagttacccccttgcttcatctattgctagaactatctcattgctatctgttatagactagtgatacaaactttaagaaaacaggataaaaagatacccattgcctgtgtctactgataaaattatcccaaaggtaggttggtgtgatagtttccgagtaagaccttaaggacacagccaaatcttaagtactgtgtgaccactcttgttgttatcacatagtcatacttggttgtaatatgtgatggttaacctgtagcttataaatttacttattattcttttactcatttactcagtcatttctttacaagaaaatgattgaatctgttttaggtgacagcacaatggacattaagaatttccatcaataatttatgaataagtttccagaacaaatttcctaataacacaatcagattggttttattcttttattttacgaataaaaaatgtatttttcagtatccttgagatttagaacatctgtgtcacttcagataacattttagtttcaagtttgtatggtagtgtttttatagataagatacgtctattttttcaaaattcatgattgcagtttaaatcatcatatgacgtgtgggtgggagcaaccaaagttatttttacagggactttattttttgatctttatttgagattgttttcatatctatctaaattattaggagtgtgtgtatcagaagtaattttttaatgtcttctaaggatggtcttccaggcttttaaactgaaaagcttaattcagatagtagcttttggctgagaaaaggaatccaaaatattaataaatttagatctcaaaaccactatttttattatttcattatttttcagaggccttaaaattctggataagagaatggaggaaaatactcagagtacttgattattttatttccttttattaaaaaattacttctatgtttttattgtctcttgagccttagttaagagtagtgtagaaatgcatgaacttcatcctaataaggataaaacttaaggaaaaccacaataaaccatgaaggtgtacacatcttataacacagataaagttttggtgtgctacctattcttgagagagtgagtgagtgtatgtgtttaaaggaaacaaaatgggagaaataagttttaaaaaaatcctcattttgttaatattcaaaagatggactgagcttccacttgggttttatcttgttttaattgtttttgtatcaaaacttgaaattcctctatttctattgggatataaaagccttccccttcagtgaagaaaacatttattttttatttgattcctaggatttagtaaactctagctgtctatttaaaatgtactgaggcacaacaagtattatactggaagacttgccaaactggcaaagctttaagttcatcagcattctatgtggttcagagctgtgatttttgcaaagtattttaccaacctcctcgatggctttgataaaggttagatttgatgttttttttt

SEQ ID NO: 5029 - DNA, 1605 bp, Homo sapiens
atgttgttctacctcagcagccgctcttctaaaacattcaaaccaaagaagaatatccctgaaggatctcatcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtccagtcatgtctgcaggtccgagatatgaatatcactgggcagatggtactaatattaaaaagccaatcaaatgttctgcaccaaaatacattgactatttgatgacttgggttcaagatcagcttgatgatgaaactctttttccttctaagattggtgagttaacattgtcgaagtattctttctttttttaaaattttattttattaatataaatagagttgggggggtttgctgtgttgtccaggttggtctcaaactcctggcctcaagtgatcctcctgccttggcctcccacagtgctgggattacaggtttgagccaccgtatccagcctgtttctctttttgaatgataaatctgctctttttaacattgttatacttgtagagactgccaaattctcctccaaaaagtttgtaccaacatgtactccccccagccctgtttgtgtttgccagtgtttcttcaccaacactggttattactcattttttaatattttctaatttggttaaatttctgttttaatatgcatttaaaaaatgttgatgagattgagcattttagcctttttgtttgttttattgatcattgtgtgttttctgtttatatctttcatctatttctgtgtaaaggatattagcgctttgtcgtatgtgttgtatatctttttccccgggttaccttttgtctcattttgttcatggagtatttttgctgtacacaaccttactattttgtcctattatatcttttatgacttgattttaatataacaattagaaagcttttccctgcttcaagattataaaaatatttattcatgttttctttttttatttttttattttttgagacagagtctcactctgttgcccaggctggagtgcagcggcacaatcttggctcactgcaatctccacctcccaggttcaagcagttctcatgcctcagtccctgggtagctgggactacaggcacatgccaccatgcccagctaatttttgtatttttagtagagatggggtttcaccatgttggccaggctggtcttgaacgcctgacctcaagtgatctacctgccttggcatcccaaagtgttgggattacaggcatgagccaccacgcctggctgggaagttttttttccctgaatgctacattaatttttttccaaatggaaatactagtcagtttgtcccattaccatttattaaacacatttgccttttctcccctgattatcttatgtgcacaacaaattgccatatatttttgcatgttttagtctctttatctgttcctatagaaattccacacgttggtgactgtggctctgcatctgttag

SEQ ID NO: 5030 - DNA, 1207 bp, Homo sapiens
aattcagacgctccctcgtttcaccagccttggccagcccttgcctctggaaagggggcagctgtttgtctctgccaggcgtcccattggccagggagtgaggctggagggcccggcagcaggcatttgcgagtgctggccagccggcaccccgccccgcttctcctccccaccttcccgtcgcccactcatgctgggagaccactgcagtctccctgaagaccaagcccggcccggccagtccctgcaaagtggactctgctgcaaaatggtgcttcaggctgtcagcaaagtgctcaggaagtccaaagccaagcctaatggcaagaagcccgctgcggaggagaggaaggcctacctggagcctgagcacaccaaggccaggatcaccgacttccagttcaaggagctggtggtgctgccccgcgagattgaccttaacgagtggctggccagcaacaccacgacgtttttccaccacatcaacctgcagtatagcaccatctccgagttctgcacaggagagacgtgtcagacgatggccgtgtgcaacacacagtactactggtatgacgagcgggggaagaaggtcaagtgcacggccccacagtacgttgacttcgtcatgagctccgtgcagaagctggtgacggatgaggacgtgttccccacaaaatacggcagagaattccccagctcctttgagtccctggtgaggaagatctgcagacacctgttccacgtgctggcacacatctactgggcccacttcaaggagacgctggccctggagctgcacggacacttgaacacgctctacgtccacttcatcctctttgctcgggagttcaacctgctggaccccaaagagaccgccatcatggacgacctcaccgaggtgctatgcagcggggccggcggggtccacagtgggggcagtggggatggggccggcagcgggggcccgggagcacagaaccacgtgaaggagagatgagccccccgggccggacaggggcacacgtgtgcaaagagacggtggtgtgtgttctctcctgcatctgcgtgtgcacacatgtgctgggcacgcgtgtggtgaggtctgagagggccccgggctgcactggtgtgggctgcacaggcacagacgcagacggccccggccgtgtcctgtggccccctgtcggatggatgcgtgccgtttgta

SEQ ID NO: 5031 - DNA, 3329 bp, Homo sapiens
agttgggtaccgggaggggcgaaggcgggcggcagaggcgatcagaagtttccaagggtcacttgtgtctcgtccgtgggaagaccgggggagcccagaaggccttggtgtggaattctgagagctgattcctgccttgtcttctccactgttcctggaggaatccgagaagagcagagcggagggagccccagacacggtccgcgggagagctgtggggcttggtgagtgtttcgtggcctctcgggttggtcagcacccccagccagctggcccaggacccctctacagaagtccaggagagcaggcgtcaccaagatgtccaaccccttcctgaagcaagtcttcaacaaggacaagacattccgccccaagcgcaagtttgagccaggcacccagcgcttcgagctgcacaagaaggcgcaggcgtcgctgaacgccgggctggacctgcggctggccgtgcagttgcccccgggcgaggacctgaacgactgggtggctgttcacgtggtggacttctttaaccgcgtcaacctcatctacggcaccatcagcgacggctgcacggagcagtcctgccccgtcatgtcggggggccccaagtatgagtaccgctggcaggatgagcataagttccggaagcccacggcactctccgcgcccaggtacatggacctgctgatggactggatcgaggcgcagatcaacaacgaggacctcttccccaccaacgttggcactccgtttcccaagaacttcctgcagacggtgcggaagatcctgtcgcggctgttccgcgtgttcgtgcacgtctacatccaccactttgaccgcatcgcgcagatgggctccgaggcccacgtgaacacctgctacaagcacttctactatttcgtcaaggagttcggcctcatcgacaccaaggagctggagccactgaaagaaatgaccgcccggatgtgccactgagagccccgcgggtctcccggtgcccgaaccgccgctggggcctcggagacttggaggaggacgctctggaaccatcatcccgcttctctccggcctgagcatctcagggagaccaggggccgagccgctgagcaggtgttggtcctcaggagctccaaccccggacggcagatgccttcctcagtctcgagcctcagtctcccgtctgggactaaaacgtgaactctgtaattctatgtgttactagcaaccggaaaagcccactgtgtttttaaaccacttccactttccaggaggctggatggcttccagggtcactccttgccctgggtggctcccaggctcctggaacttctgcctccacctcgctggggagcccccagggctgctgtggccacagccctgcctgggcctgtctctcaagggcacccagcttgctcggcctcctacatgtctcccgttggggaggcaagaggctgaggggcttccgagcccctgagagcggacatctcctcccgcaggcctttactccgcactccccactggcagccgctggtgtctcttcacacagaggcacaacctggacccaggcagcctctttcctccctccccaatctcttccatttttctacagatttttttttttttggtcatactagagacaggggtctcgctgaactcctggcctccagtgatcctccatcctcggcctcccaaagtgctggaatcacaggggtgagccaccgcacccagccctctctcttcctcaatgcactctgcttcttccgttcttccgaaacattcagctgactgtatccagggcttcctggactcctgggaccccacgtcctgcaccccggcttctgactcatttcctaagggcccctttgtgtatcataaagggtttgatttttatagtcacatttacaaccatcttgagatttttattttttttgaacggagtctcccactgtcgcccagactggagtccagtggcacaatctcggctcactgcatcctccacctcctgggttcaagtgattctcctgcttcagcctcccaagtagctgggattacaggtgtgcgccaccacgcccaggaaattattgtagttttagtagagacaagatttcaccatgttggccaggctggtctcaaactcctgacttcaggtgatccgcctaccttggcctccaaaagtgctgggattacaggcatgagctactgcacccggcctaaccaggctggagtgcagtggtgggatctcggctcactgcaagctccgcctcccagattcacgccattctcctgcctcagcctccccagcagctgggactacaggcacccaccgtcacacccggctaatttttttgtattttagtagagacagggtttcaccgtgttagccaggatggtcttgatctcctgaccttgtgatccaccagcctcagcctcccaaagtgctgggattacaggcgtgagccactgtgcccggccaagaatttttttatcgataacatagtgagctctctgcctcttcggaacgatgtccactttgcttatgatcaacccaagcaggactcttctctccctggacgcctctcccctggtctggaatcttccagttctgccagaattggcctttcccagatgctgcaaacttccagttgaacccctttttctgtgtggcccctggggctgcgagaccaaaatccatgagttctgtgtaccctagacctttggaaggtgagagcagggccctgagaaaaggcagccacctcctctccctggctgaacccctgccaccctactcctcaccagaattgtcagtggcctttcaccacagtggtccttcctgcctgagccctgcactgtcccagaccacacagaagtctggtcacctctgggcgcctgggatggtcaccgaagagaagcacgctgtccccgtctctcctggcttctgccagaaaatcgaacaagtgcaattaacacactgttactgccgaagcctgaaactcccaggacttgtccttgatccttccagaaaccaccaggtccggcacttggagccccccggagagggacctcccagccgagccctcaaagaactccatgaaatcaggaactgcttgatgaaatgtatctccttgtacctggaagatgaagcccaaacacccacacctctgtctcccccagggctcgggatgtctccagcagcccggccacgcagcttcccaggtgggctcggggaggtgggagcagggaccatctctgtcccctccaccctcactccatccacctcggagaccaccctcccccagccagatacggaataaaactacagacgcagacgtcgg

SEQ ID NO: 5032 - DNA, 6454 bp, Homo sapiens
gtgcatgagggggctgctccggagcgacggcggctgcagctggagccaggcgctcgcccgtccgccggttggctcgccgggacctcgcgcaccggcggcagagtcccttgcgtggattggcaagcgacgccccacctgccccgagctcaccattttctttcgcgctggctgcagctgacccggcgaagggagccgaccgggccctgggctggaggtaaaaccccacggaaagaacatgaggttcccttggaaatcattcaagaggaagatggaaggggctgtttagaagagcttaaaagctacaggctgtaagactggggcctgagtgctggcagtggaaaacactgttgggctgtgatctctccctgaaaagttccaggtgccttttcgcttcctgcaaaagaaaggaagcgaaagagaagaccatgtccatagccctgaagcaggtattcaacaaggacaagaccttccgacccaagaggaaatttgaacctggcacacagaggtttgagctgcacaaacgggctcaggcatccctcaactcgggtgtggacctgaaggcggctgtgcagttgcccagtggggaggaccagaatgactgggtggcagtacatgtggtggacttcttcaatcggatcaacctcatctatggcaccatctgtgagttctgcaccgagcggacctgtcctgtgatgtcagggggccccaaatatgagtatcggtggcaggatgatctcaagtataagaagccaacagcgctgccagctccccagtacatgaaccttcttatggattggattgaggttcagatcaacaacgaggaaatatttccaacatgcgtgggtgttcccttcccaaagaacttccttcagatctgcaagaagatcctgtgccgccttttccgggtctttgtccacgtctatatccaccacttcgaccgggtcattgtgatgggtgcagaggcccatgtcaacacctgctacaaacacttctattactttgtcacagagatgaacctcatagaccgcaaggagctagagcctttgaaagaaatgacgagcaggatgtgtcactaatgctccacctcaccctttggaagaaaggaaagctgtttcctcctggtgccctgagcgggcaggaggtggaccaccctggctgaaatgacacacctactcccaggaacagcagaggtggaggcaagcagtgactcctgagagacattccccactcactttgtgtgctcttaaccttctgagtgctgctagcccagacctgtggacgaggcagaccacaacgtgaaagaaggaccagccccttgaccgttctggctggggaattgtccacgaggaagcctctgcacttccacacatggcacagttctgcctgtgacctgccgcctaagctttactggaattcaggttttgagactgagatgcgtgttcgtatttttccacttatctgtcttgtcagctggccgacttctctgtgattggttttttaagtgccgggtgaattttggacctctggatgtgcagcaagtttttatgcaataagccttcctttcaggtctctaaaagctcctgctctgatctgtggtttaacactgtgcagggctgtggagctctgagacacctgaacccctacccatcccctgcacctccctactctccctgccgaggcgtccatagcatttccctaataaatagttttatcagggacactccatggggtggcttgtctctgccccaaacagggtcttcacgttctaactgcagggaagagactggttactagcgtaaagctgacaagttaccagttcacctgatcagaatgtattttttataaccaccatcattccttgtctcttcagtggaagatattctttcctgtttcccagaagagagaaataaaagtcctaaataactaagaatgatcagcgggagcgttgggcatgattactgcagtgtttgttctttattaaagacagggagtcgtggctgtctctacataatactaacatttcagtgaaaaaagtacaattggttatttggtacgtgtagatttaacacccagacggctgacttgtaaccctccccactagccttctgagcatttaaacccagccgtcattctctccccactccacgctccccactcctctgccacgttatgttacggcacaaaattaatttctgcccctgtgattgggccacggttgccaaggtaacagtggagctggagctaacttccttctttcatcctttccaatttttctattccagaagacagtcagaataatgcattctgtactacatcctgccttttgaaacctaaatgagttttcgttgatgaaatgttgccttctctgattcattcacaaaactgtggtggttctgaccacctgtgacgaggggggtcataatacttccagtgatccttttaatttagcaaaatatttgtcggtggagggaagtagataagaatgtattagtgtattttaaagtaataatgattaaagaataactaaatgactctgattttgttttatcaatcataatgtgttaaagccctctgtggctgccacaaaagactagaatcatgaaatctttgtccaagctaagaaagggctgtctctgtgggtacagtggcattctctgttgacctaaccaagcagcctgaaccttgctttgtgtctcgtaaaggtcatctcacggaatccaattgctgctacctcaccatgttgctgtgccctggtcaacaataaacatacttttgtcccccttcctaagtaactttgagaggacaagataggcaaagttttttccctacatctcttttggccaaaagaatatctgaccatcacagagatccagagaacagaaacaagagcccctaagtcccagcctctgcaatacacagttaccagatgggaatgcagcacagtggcacagagaggtaactacggagcccatgccctggaggaactctgtagctgtgcatcatggaacgccacaggatttttacattaaaaagttgaatatgttcctgcatttcagcagtgcataatcgagcaggaggctggaatctggagacctttgttattcattctttttaaggttattttttattaactgtgcatatgaaatttccactcaatttaaaaatccaaatctttttaagcttcttggaagaatttcctcctgcttatattgttaattgcactaatgaactcttctagggtaaattctggcaaactaccctttttttttttttaatcacagaatattcctgttcccacagaactttggcacattctgaagaaaatctctgcagtcaatttttatctcctctgcttgactgcatctaactgttcatctctgttataaatggagcttcagccctctgggtcagagactgacaaccctccttcttcttcctaacctgtcctactctccttctttttctgctttcattttaattttgggaaattttaaagtaaaagtttcaaagttgaaagattatagtgagtacccttatgtcctttagtgcatcagttgttaatgttttgccttgttttcttttcttccttttttttttttaagagaaggggtctctccctattttacccaagctggccttgaaccccttgcctcaagtgagcttcaaccttagcctcctgagtagccaggactatggcatgtaccaccgcacctgcctcacattttctttctcactgtaaatacacattcttattcttgaaccttctgaaaataagttgcagacatcatgaaaatgtaaaatacttcatcatattctttcttttaataagagcattgtcctataaatctgcaatattttcacgcccatgaaactgaacactgatactgcataaatctaatatatgatccatattcaaaattctccagttgtccccaaaatatcctttatagctgtttatttttaaatccaggatccaatcaagaattatacgttatatgtagttgtcattctcttttgtttcctttaattgattagagttgcccttttgtgtgtgtctgagtggtgggtggtggggtggtgtttgtgtatgatgtgcagtgtgtgtgtgtgtggtgtgtctttcatgacactgacattattaaagagttcaggcaagtttgtggaatgtcccacaatctagacttttttactgattgtttcctcattacgagatacaggttacattttttttcccaagactgctacatgtgtgatgttgtttccttactactgcctcacctcaggaagcacataatgtctacttgtctcttttctgatattaggactgatcaggtgttgtctgcctgatccaatcattatcaagttccataattcattattaagctctgaaattcaggacacatacatttatagagtgtgaggctgtgcatacgtacattcatcccttaatgttctcaaggaggcccaggatccccaaaatattataagcattgcagtcagatgatatagcactagcaaagcattcatccctttccatataacaggagggaggggaagaaggaagtttccatgtgcaggcaatacgtgagagcatgggcaagtgaggatttgtatgctccctgtagccagaggtgaaatattcaacgcttttattttttctcccgtcttcaatgacctcccatttggacccatagtttatttatagagagcacacactccctaattgtcagatggtttttttgggaaaactcttagatagtacagtgagttgtgaccctccaaaggatcacaagtacataaacagatacaaagtatttatgtggtattaaaatttcatggtgatggtgcaagggagagatgattaggaagaaaatgtcttacacggctgtaattgagaaatactgatctagagtcatttcctgcttcttaaattgttcgttttctcttccctgggtattttctcatttccaaagacccagagtctcagagccaggttaagtggaagaaactttgagaggtttcttaatcaattccttctatctctcaaaccatgccagtaacttccttggtgaaaaaatctatactcctctcacagttcttcgggcatggaaattctatagcattctttggtataaccaacccactgaaccctccacaacatcttgaattccattcaactcgagctgaagtattctttttgagtttcagtatatcttttctagtgtcccacttttagaaaggtccaaagatgatatataataagtgaaaatacaattaatcagagctttatttgcatatccattaaatatctgaaggctattaccagttgtgcttcagcctcctttcccttgcaattctcccagggtggcatcctctacggagtcttgttgctccattgttgaccactgatgtaactcaacgtgaaaccttcccaaagctctccacatcactctctgttatggctgtgaccagcagtgaacatgaaaagaacttatttcatgccttctccaaactatattgtttctttgctaagtccagacctgctttttctacatttataggttttctattttaatcgccatgcaaaattctttatcatactcaatcattttggtttatcttcctgacttcttacctttaacatccctgttaaagattacactgttgttgtttcaaaaaaaaaaaaaaaaaaaccttaattggcaaaacattaagggacttgaatagaattacacttatctttttgtgctgatttatgtcaatccatcattctggttattgatggaagcaaattgcttcctatgttctctaaaccttatgtcccttccatactccatgagtaccacactgggagaaaacaaaagcaaaaagattgtgggaaaagtatagccattatctttgaggaaatgtgtaccaaggcacaatcattaaaaggagttggaggcatcatttggttgacactgttgtcattcttgttctgatcattttggaccttgaagaaattggtgattctctcctagaattagacaaacaaagtgtgtttggaaataatgattgttttcctgccttaaaaaatatattaacagaaagcttttataacaggctgtttccctctggacaggtattaattctgagtaagaattttcagtgactacataaggatttgtgtaacttatgaaggaagagtccatttctaatcaaataattcgcctgttttactagcttatagtgatctgatttcagaattttcctgtatcttttttacatacatcagaaaaagaaatgtttactatatttttggttccatttatgattgtattaagcatttgactataaggaaaactaacaattaaatcaattagaaaagcaacataaaattaaatgatatttaggaaatcagttatatgtgagcttgggtattcaaatgtcacaaataaaaagcatataaccatta

SEQ ID NO: 5033 - DNA, 2800 bp, Homo sapiens
agtgtgagggattttggaagcacttgccccaagcagagtttaaaatggagatggcaaatgaagcgcagaaatctctttgctctggaaactggggtcccaccctggggacttctttgggtgagaagtcgaagagtcgggatggatgagatgacctttcacatctggtatcctcaggtccgagcccctggacagcagccccaggcccagctggccatggccctgtgcctgaagcaggtgttcgccaaggacaagacgttccggccgcggaagcgctttgagccgggcacacagcgctttgagctgtacaagaaggcacaggcctctctcaagtcgggcctggacctgcgcagtgtggtgaggctaccacccggggagaacatcgacgactggatcgccgtgcacgtggtggacttcttcaaccgcatcaacctcatctacggcactatggcggagcgctgcagtgagaccagctgcccggtcatggccggcgggccccgctacgagtaccgctggcaggacgagcgccagtaccggcggcccgccaagctctctgcgccgcgctatatggcattgctcatggactggatcgaaggcctcatcaacgacgaagaggtctttcccacgcgtgttggagttcccttccctaagaacttccagcaggtctgcaccaagatcctgacccgcctcttccgagtctttgtccatgtctacatccaccacttcgatagcatcctcagcatgggggcagaggcgcacgtcaacacctgctacaagcacttctactacttcatccgcgagttcagtctggtggaccagcgggagctggagccactgagggagatgacagagcggatctgccactgagcccaggtctggacttttttggccatcagatggacgatctgaacatagggtggctggcagaggggacccccaggagcctgaaggaatctgaaggcactggaatcactccacacacccaaagcctctggacttctggttctcaggagtctgcctacctgtcgccctgaccgcttgtggatggagaaggggagagcatctaggcaggcaaacagaagggaagtggagttaaacctctggcatgaagtctgggagtagggtaggctagggggtttcttctatgacacttgacccttccatgctggttcccaagcctattggaggaatgtgggtgtggccgaggtgatggcaagaaaggtgcaagaaagtgagcagtctgcctgtgagtgagcacagatgccggggtgtgtgtgtgtgtgtgtgattttcactgtggggtgtgtctgtgagagctagctgccttacccctccttggcacatagtaggccttccataaatgttggatggatggataaatagattgggaccatcagaccatgggaccatcagaccatgaccactgtaggagtgatgacagctcagcgtccccactcagtgtatctgaccatgtgtgtaagtgcacaaaaatgtggttgtagatgttgctctacattcaaaccttccaggctacactcttccatcagcatgagtcctggagagctgggggaacgtaggaagaggagccttgccttgagttcctaaaccgacccactgcagacacaggctctgattctcttacccagagatgcccatgagctgacattttactcatccctctgcctccaagaaggcctgtattatacgtgtcctcctgggggttggagatgatccctcaagtacacaaaggtcccctggcccttcatctgggaatcatatactccactctagctcccagaatctacagacctggctcctcggatctgaagcccagcacaaaataatctccccgtccaaggagcttgtggaacttgaattgggaactttggagtcttgtctcccatcccagcacattgaggatgtagttggtgaatggactcttccaggcatggagatcctccatcctaaaagtacctgcctccttcccagccatccctgacacattccagccagttggatctcacagcacagctatccacagggagactgggatgttcacgcagcactccattactcagtacctccatacccagccctatacgcagacccacaggtggggaaactgaggcaggaacagggttctgccctcccagagcctccactctgggatgccagaatggaaagccagagggaacctgagaatcatccagtcttactgtctcaatgtacatacggggaaactgaagccaggagaagaagagggagaaactgtccagggcctcacagggaggcattcatggagctggagaaaccagggatcctgaccgcagggcccatcaattgctacatagagatacacatggaaagagggtttaacagaccctctctaggacacaactgtttctgctttgagcaataatttctaacctgaggccaacatgtcccactgccccttgggttggctggggttgtttcctgagccaagcatccaatatcatgccccactcaatggcctagaagctgcctgtactttggggaaacagatggagctcttgggcccagccagctgggcctgggacttctgcctctgccgcctccagagtggcctggcagctttgccagaggctgtggagcgagggtagtaggagcttttcccagagtgctgtgacttgcatgatggattctaggctgtggcaagggctgatttctgggatagggggagggttggaaaatttatttttatgaaacagagggaagactttattgttgttatttttggtaaaataaaaggcaaactaaagca

SEQ ID NO: 5034 - DNA, 2822 bp, Homo sapiens
ccgtggccgcggcgtggcggggccggggcggagctggcgtcgcccggggcaggagggcagccgcggccggcaggacaggcagacggacaggctgacaggagagagaacaggcactgcgggacctgcaggagaaaggcgatcctgtggctgggaatgtgaccccacggccagaagaggacccggtatcctcaggtccgagcccctggacagcagccccaggcccagctggccatggccctgtgcctgaagcaggtgttcgccaaggacaagacgttccggccgcggaagcgctttgagccgggcacacagcgctttgagctgtacaagaaggcacaggcctctctcaagtcgggcctggacctgcgcagtgtggtgaggctaccacccggggagaacatcgacgactggatcgccgtgcacgtggtggacttcttcaaccgcatcaacctcatctacggcactatggcggagcgctgcagtgagaccagctgcccggtcatggccggcgggccccgctacgagtaccgctggcaggacgagcgccagtaccggcggcccgccaagctctctgcgccgcgctatatggcattgctcatggactggatcgaaggcctcatcaacgacgaagaggtctttcccacgcgtgttggagttcccttccctaagaacttccagcaggtctgcaccaagatcctgacccgcctcttccgagtctttgtccatgtctacatccaccacttcgatagcatcctcagcatgggggcagaggcgcacgtcaacacctgctacaagcacttctactacttcatccgcgagttcagtctggtggaccagcgggagctggagccactgagggagatgacagagcggatctgccactgagcccaggtctggacttttttggccatcagatggacgatctgaacatagggtggctggcagaggggacccccaggagcctgaaggaatctgaaggcactggaatcactccacacacccaaagcctctggacttctggttctcaggagtctgcctacctgtcgccctgaccgcttgtggatggagaaggggagagcatctaggcaggcaaacagaagggaagtggagttaaacctctggcatgaagtctgggagtagggtaggctagggggtttcttctatgacacttgacccttccatgctggttcccaagcctattggaggaatgtgggtgtggccgaggtgatggcaagaaaggtgcaagaaagtgagcagtctgcctgtgagtgagcacagatgccggggtgtgtgtgtgtgtgtgtgattttcactgtggggtgtgtctgtgagagctagctgccttacccctccttggcacatagtaggccttccataaatgttggatggatggataaatagattgggaccatcagaccatgggaccatcagaccatgaccactgtaggagtgatgacagctcagcgtccccactcagtgtatctgaccatgtgtgtaagtgcacaaaaatgtggttgtagatgttgctctacattcaaaccttccaggctacactcttccatcagcatgagtcctggagagctgggggaacgtaggaagaggagccttgccttgagttcctaaaccgacccactgcagacacaggctctgattctcttacccagagatgcccatgagctgacattttactcatccctctgcctccaagaaggcctgtattatacgtgtcctcctgggggttggagatgatccctcaagtacacaaaggtcccctggcccttcatctgggaatcatatactccactctagctcccagaatctacagacctggctcctcggatctgaagcccagcacaaaataatctccccgtccaaggagcttgtggaacttgaattgggaactttggagtcttgtctcccatcccagcacattgaggatgtagttggtgaatggactcttccaggcatggagatcctccatcctaaaagtacctgcctccttcccagccatccctgacacattccagccagttggatctcacagcacagctatccacagggagactgggatgttcacgcagcactccattactcagtacctccatacccagccctatacgcagacccacaggtggggaaactgaggcaggaacagggttctgccctcccagagcctccactctgggatgccagaatggaaagccagagggaacctgagaatcatccagtcttactgtctcaatgtacatacggggaaactgaagccaggagaagaagagggagaaactgtccagggcctcacagggaggcattcatggagctggagaaaccagggatcctgaccgcagggcccatcaattgctacatagagatacacatggaaagagggtttaacagaccctctctaggacacaactgtttctgctttgagcaataatttctaacctgaggccaacatgtcccactgccccttgggttggctggggttgtttcctgagccaagcatccaatatcatgccccactcaatggcctagaagctgcctgtactttggggaaacagatggagctcttgggcccagccagctgggcctgggacttctgcctctgccgcctccagagtggcctggcagctttgccagaggctgtggagcgagggtagtaggagcttttcccagagtgctgtgacttgcatgatggattctaggctgtggcaagggctgatttctgggatagggggagggttggaaaatttatttttatgaaacagagggaagactttattgttgttatttttggtaaaataaaaggcaaactaaagcagcca

SEQ ID NO: 5035 - DNA, 5725 bp, Homo sapiens
tgtcaggcgggctcctctgggtcctacgaccttcctggccctgggagctggtttgaggttgcagggaagccgggggtgggcgtgggtggctgcgcgccgcgaggagagcgtggagtcttcgcctctactttttctcttcgacctctgtcctagagagagtcccaggatggattctgggttcaaactggggccatcctctggcccagatcctgggccaggcccaaggagtggtagatgtagcctagcagggggctaaatatcagaaacaggtagggtcagcctgctgtcttcatttgagaagcccagatccgcacccagggaacgagcaaggcactgccactccaggagtgaaaggatagccatcactgggaaatgggggctaggacggggaacggcagtggttcagggagagacagaggttctgtgacagatagaaactcagtgagggcatgggggtggggagtgaagggagttaaccctgtggctagaagagcacctgccctgcacccaccccctgagcttacattttcctggaaagagacccaggccttgaagttccacaggagtaaggtggaactctagctcactggtcaggacaccccagttgctgtgcggagtcagtgtgttggggacaggaagcaggttgggctgtttggtggagaagatgcttccactgtccctccactcccctcctcttctctgtctccaccagaccattgatgagccagtgcaggaaaatggtcttttactcttggtcatgagctgagccccaccttatcccagttcccagttctgcttgtaacttgctatgtggacacaggctcctcaagtcctctttttaggcctcagtttcctcatctgggcctcagtttccccatctgtacaagtgagttgggccagctgatctatcagggctattttaactctaagattctagtctaagctttccttaaagcctgaacactgactttgtgccaggccttgtcctaagctgggggtgggttggggatggagtggagactgcaatgaccaaaagcagcctctacccaaggagaaggagatctgagttcaggagaggaggctgtgggaggaggtagcagccaatctgaggatgtgtggtcaggcaggtggagggataagaaaacatgcagaggcaaaagagtgggggcgtgttcaggaatcaggaagaagcccagggtggttggtgtggggaggtgggaagtggggcaggaaaggtaggacaaggtgctgaatgccagggtgggggcctatttctaactgtcataaagggggccatgcaatgtggggagcccaggagccccgcctaattgcagtgtgagggattttggaagcacttgccccaagcagagtttaaaatggagatggcaaatgaagcgcagaaatctctttgctctggaaactggggtcccaccctggggacttctttgggtgagaagtcgaagagtcgggatggatgagatgacctttcacatctgtgagtttttttcaagagaacaagttcctgctgaatggcctgtttctactctccaagctgctctcattttaccagactgcccccatcctggcctgcctttgtgggttcaaggaaggacctttgtctcaaacagctccccagctagtttgacttcttgccagaagtaatacccctccccgaaatatgtgccatccctttgcttttacccaggtgtcacctggttcccaccctcccttccccaatcctgtcccagggttaccagagatgtgagaaaggacagtgctccagcgtcagaggtcaagcccaggctttggccataagcaagcctcagggtagggctaaaggctagagtcagggctcacacttgccagagcccaggtcagaggtcagccaggaaccagaatgcaattcttagcttatactcagccttagtgctcagtctaggggcaggggcagtgtgcttagtgggtggctaaattctagttttggtaggtacatgggtctgcatttcccagtagctcacacactcacagttgagatgagatgactcaggtcttagaaacctagctatagcagagtgacccaggacctggatgggctaaatccatggtgatacaggggtcacccagtaagccagtggtagagctgggactagaacccaggactcctgcctctgagcctagggccctgatcactgtctcccaaaatttgttctgaatctgggatccttaaattctaggaggcaaagtaaatttgcctgagctctagatgggccctcctgggtgcatctgactatactcttctacctcccagtgccaggcacatagtagttgctagaggaatgtctactgagtgtcaggtgcaacgggaggagccagtggcttgttcagatttggggctggaggaggctggcttgaggggaaggatctccagctgttgtcagaggaagcgacgccctcattggcctgccgccctccccctcctccagtgcttgcagccacactcagaagccgcccagctggcagcgggagggccctttcctctttcagggtgaaaaaaaaggaaaggacatttttggtagaaaagttccctgctgctccctgggaatccccggtggccggatggactacgggatatcccagaggaagccgaaagccacccccgacccccctccaccctgcccccagcacaatgctgcgaggctctcccacgttgcaccagctggccaagggggctcccagaggtcatctcgtccaagcccctgtctgctggtgggcctgcagggagcctctgcgacctctctcgtgaccaacagcaagtctgaggggcacctgtttagagcccaggcccagctctgcaatgaaagcagaaaagagacaaagcaagatgggaggactgtgggggcttagcaagggggactaacatagcctggaaagagggcggggcactggacctaggggctgaggacttagattccaggcagaggatgcagaggttgagcaaaggctgagaggtgacagggaaatgatgaattgggaagtcagagcccagatgataaggccttgaccgccagctcccctatgcccttgtccctggcagggtatcctcaggtccgagcccctggacagcagccccaggcccagctggccatggccctgtgcctgaagcaggtgttcgccaaggacaagacgttccggccgcggaagcgctttgagccgggcacacagcgctttgagctgtacaagaaggcacaggcctctctcaagtcgggcctggacctgcgcagtgtggtgaggctaccacccggggagaacatcgacgactggatcgccgtgcacgtggtggacttcttcaaccgcatcaacctcatctacggcactatggcggagcgctgcagtgagaccagctgcccggtcatggccggcgggccccgctacgagtaccgctggcaggacgagcgccagtaccggcggcccgccaagctctctgcgccgcgctatatggcattgctcatggactggatcgaaggcctcatcaacgacgaagaggtctttcccacgcgtgttggagttcccttccctaagaacttccagcaggtctgcaccaagatcctgacccgcctcttccgagtctttgtccatgtctacatccaccacttcgatagcatcctcagcatgggggcagaggcgcacgtcaacacctgctacaagcacttctactacttcatccgcgagttcagtctggtggaccagcgggagctggagccactgagggagatgacagagcggatctgccactgagcccaggtctggacttttttggccatcagatggacgatctgaacatagggtggctggcagaggggacccccaggagcctgaaggaatctgaaggcactggaatcactccacacacccaaagcctctggacttctggttctcaggagtctgcctacctgtcgccctgaccgcttgtggatggagaaggggagagcatctaggcaggcaaacagaagggaagtggagttaaacctctggcatgaagtctgggagtagggtaggctagggggtttcttctatgacacttgacccttccatgctggttcccaagcctattggaggaatgtgggtgtggccgaggtgatggcaagaaaggtgcaagaaagtgagcagtctgcctgtgagtgagcacagatgccggggtgtgtgtgtgtgtgtgtgattttcactgtggggtgtgtctgtgagagctagctgccttacccctccttggcacatagtaggccttccataaatgttggatggatggataaatagattgggaccatcagaccatgggaccatcagaccatgaccactgtaggagtgatgacagctcagcgtccccactcagtgtatctgaccatgtgtgtaagtgcacaaaaatgtggttgtagatgttgctctacattcaaaccttccaggctacactcttccatcagcatgagtcctggagagctgggggaacgtaggaagaggagccttgccttgagttcctaaaccgacccactgcagacacaggctctgattctcttacccagagatgcccatgagctgacattttactcatccctctgcctccaagaaggcctgtattatacgtgtcctcctgggggttggagatgatccctcaagtacacaaaggtcccctggcccttcatctgggaatcatatactccactctagctcccagaatctacagacctggctcctcggatctgaagcccagcacaaaataatctccccgtccaaggagcttgtggaacttgaattgggaactttggagtcttgtctcccatcccagcacattgaggatgtagttggtgaatggactcttccaggcatggagatcctccatcctaaaagtacctgcctccttcccagccatccctgacacattccagccagttggatctcacagcacagctatccacagggagactgggatgttcacgcagcactccattactcagtacctccatacccagccctatacgcagacccacaggtggggaaactgaggcaggaacagggttctgccctcccagagcctccactctgggatgccagaatggaaagccagagggaacctgagaatcatccagtcttactgtctcaatgtacatacggggaaactgaagccaggagaagaagagggagaaactgtccagggcctcacagggaggcattcatggagctggagaaaccagggatcctgaccgcagggcccatcaattgctacatagagatacacatggaaagagggtttaacagaccctctctaggacacaactgtttctgctttgagcaataatttctaacctgaggccaacatgtcccactgccccttgggttggctggggttgtttcctgagccaagcatccaatatcatgccccactcaatggcctagaagctgcctgtactttggggaaacagatggagctcttgggcccagccagctgggcctgggacttctgcctctgccgcctccagagtggcctggcagctttgccagaggctgtggagcgagggtagtaggagcttttcccagagtgctgtgacttgcatgatggattctaggctgtggcaagggctgatttctgggatagggggagggttggaaaatttatttttatgaaacagagggaagactttattgttgttatttttggtaaaataaaaggcaaact

SEQ ID NO: 5036 - DNA, 2363 bp, Homo sapiens
gggagaaacaatcctaacgtccctttctctcacttgaaatgaactgctagctggctcggacggagaggcccagagtccagggctgttctgtgtgggactctagactcggaggaggcgcccaggcccctagaaggcggcgccggatgaggcaatcgcggacccgggtcaggacctgcccacggctctgctgggactaggagcccagaaccagtccctcggcgccgcaggcggccaaacgctaaggactacatttcccacaatgcaccccgggggcgggccgagtcgggctgagcggctggagctgggccttggccgcgagaggccggcgaaagctatcttcctgcaccggcggccgggtgagggcggtgggagggagcggtgcctgcgctgtggccatgtctgtgtacgcagggggccggggccccgcgaagctgtgccctcaggccggccccggccggacacccttacccctccatgggtccggcagagggcagtgaccggcaccttctgtgcgtcctggactcctctgagaaacaggagagctcaaaggatggctactgacatgcagaggaagagaagcagcgaatgccttgatggcacattgactccttctgatggacagagtatggagagagctgagagccccacaccaggaatggcccagggaatggagccaggtgcgggccaggagggtgccatgttcgtccatgcccgttcctacgaggacctgactgagtcagaggatggggcagcttctggggacagccacaaggagggtaccaggggtcccccgccgctgcctacagacatgcgccagatcagccaggactttagcgagctaagcacccagctgacgggtgtggcccgggacctgcaggaggagatgctgccaggaagctctgaggattggctggaacccccaggggcagttgggcgaccagccacagagccccccagggagggcacaaccgagggggatgaggaggatgccacggaggcatggcgcctgcaccagaagcatgtctttgtgctgagtgaggcagggaagcctgtgtactcccgctatgggtctgaggaggcactttccagcactatgggtgttatggtggccctggtgtccttcctggaggcagacaagaacgccatccgctccatccatgcagatggctacaaggtagtattcgtgcgccggagcccgctggtgctagtggcggtggctcgtacgcggcagtcggcacaagagctggcgcaggagctgctctacatctactaccagatcctaagccttcttaccggtgcgcagctgagccacatcttccagcagaagcagaactatgatttgcggcgcctactctcgggctcagagcgcatcaccgacaacctgctgcagctcatggcacgagaccccagcttcctgatgggggcggcacggtgcctgcccctggcggcggccgtgcgcgacactgtgagcgccagcctgcagcaggcgcgtgcgcgcagcctggtcttctccatcctgctggcccgcaaccagctcgtggcactcgtgcgccgaaaggaccaatttctgcaccccatcgacctgcacctgctcttcaacctcattagttcctcctcgtcctttcgcgagggcgaggcctggacgcccgtgtgcctgcccaaattcaacgcagccggcttcttccacgcacacatctcttacctagagcctgacactgacctctgcctgctgcttgtctccactgaccgtgaggacttctttgcagtctctgactgccgccgccgcttccaggagcgccttcgcaagcgcggagcccacctggccctgcgagaggcactgcgcacaccctactacagcgttgcccaagtgggcatccctgacctgcgtcacttcctctataagtcaaagagctcgggactcttcaccagccctgagattgaggccccatacaccagtgaagaggagcaggagcggctgctgggcctctaccagtacttgcacagtcgtgcccacaatgcctctcgcccactcaagaccatttactacacgggccccaacgagaacctcctggcctgggtgacaggcgcctttgagctctacatgtgttacagccccctggggaccaaggcgtcagccgtcagtgccatccataagctgatgcgctggatccgcaaagaggaagaccgcctcttcattctcacgcccctcacctattgatgggaatgtgtgcgggctcagccttcctggacacactaggtgtgggaagccataggagcctccagatgggggctggcctctcttgcccagccagcgggcagggactgtgggttggtgaatgcattaaagtgctttggggaagaca

SEQ ID NO: 5037 - DNA, 1617 bp, Homo sapiens
acaatgcaccccgggggcgggccgagtcgggctgagcggctggagctgggccttggccgcgagaggccggcgaaagctatcttcctgcaccggcggccgggtgagggcggtgggagggagcggtgcctgcgctgtggccatgtctgtgtacgcagggggccggggccccgcgaagctgtgccctcaggccggccccggccggacacccttacccctccatgggtccggcagagggcagtgaccggcaccttctgtgcgtcctggactcctctgagaaacaggagagctcaaaggatggctactgacatgcagaggaagagaagcagcgaatgccttgatggcacattgactccttctgatggacagagtatggagagagctgagagccccacaccaggaatggcccagggaatggagccagatggctacaaggtagtattcgtgcgccggagcccgctggtgctagtggcggtggctcgtacgcggcagtcggcacaagagctggcgcaggagctgctctacatctactaccagatcctaagccttcttaccggtgcgcagctgagccacatcttccagcagaagcagaactatgatttgcggcgcctactctcgggctcagagcgcatcaccgacaacctgctgcagctcatggcacgagaccccagcttcctgatgggggcggcacggtgcctgcccctggcggcggccgtgcgcgacactgtgagcgccagcctgcagcaggcgcgtgcgcgcagcctggtcttctccatcctgctggcccgcaaccagctcgtggcactcgtgcgccgaaaggaccaatttctgcaccccatcgacctgcacctgctcttcaacctcattagttcctcctcgtcctttcgcgagggcgaggcctggacgcccgtgtgcctgcccaaattcaacgcagccggcttcttccacgcacacatctcttacctagagcctgacactgacctctgcctgctgcttgtctccactgaccgtgaggacttctttgcagtctctgactgccgccgccgcttccaggagcgccttcgcaagcgcggagcccacctggccctgcgagaggcactgcgcacaccctactacagcgttgcccaagtgggcatccctgacctgcgtcacttcctctataagtcaaagagctcgggactcttcaccagccctgagattgaggccccatacaccagtgaagaggagcaggagcggctgctgggcctctaccagtacttgcacagtcgtgcccacaatgcctctcgcccactcaagaccatttactacacgggccccaacgagaacctcctggcctgggtgacaggcgcctttgagctctacatgtgttacagccccctggggaccaaggcgtcagccgtcagtgccatccataagctgatgcgctggatccgcaaagaggaagaccgcctcttcattctcacgcccctcacctattgatgggaatgtgtgcgggctcagccttcctggacacactaggtgtgggaagccataggagcctccagatgggggctggcctctcttgcccagccagcgggcagggactgtgggttggtgaatgcattaaagtgctttggggaa

SEQ ID NO: 5038 - DNA, 4046 bp, Homo sapiens
gactcggctaatggcgtcggcgagtcttaggggcctggggagctggcgctgaagcttcttgccaggttggctggtgacacccggtgtggctgggccccgcggcagcggagggacctgcccgccttgtgggtttctcggccagagtcggcggagcctagcgggacggtgcgactgcggggggcgcctccgagaaaagccagaggtgttgcggggaagctgctgggggacgctcgagcaggctccgggttcgcagcccagggcccaagaagcgggctgctgaaggaccagagacaccgggagggagctgcctgtggccctaaggagctgaccgtgccagagcttgtttgtacctctcggaaattggctgggaccttggaggatcatgtccggcaccagcagccccgaggcggtgaagaagctgctggagaatatgcagagcgacttgcgcgccttgtcactggagtgcaagaagaaattcccacctgtcaaagaggctgctgaatcaggaataataaaagttaaaacaattgctgcacgaaacactgaaattttggcagcactgaaagagaacagctcagaggttgtacagccttttttaatgggttgtggaaccaaggaaccgaagatcactcagctatgtttggctgctattcagagactcatgtcacatgaagtcgtgtctgagactgcagctggaaatataattaacatgctttggcagctaatggagaatagtcttgaagaacttaagctacttcaaacagttcttgttcttttaacaaccaatacagtagttcatgatgaggcactttctaaggcaatcgttctttgttttcgactacacttcacaaaagataatattacaaataatacagctgctgctacagtgcgacaagttgttactgttgtttttgagaggatggttgctgaagatgaacgacacagagatattatagaacaaccagtactggtacaaggaaatagtaacagaagatctgtcagtaccctcaaaccttgtgctaaagatgcatatatgcttttccaggatctttgtcagttggttaatgctgatgctccttattggctagtgggcatgacagaaatgactcggacgtttggcctcgaattacttgagtcagtcctcaatgattttccgcaggtctttttacaacaccaagaatttagtttcctcctcaaagaaagggtatgtcctcttgtgataaagctcttttctccaaatataaagttcagacaaggttccagcacctcatcttctccagcaccagttgaaaaaccatattttcctatctgcatgcgtttgctgagagtagtatctgttctgattaagcagttttacagtcttttggtaactgaatgtgagatatttctgtcacttctggtgaaatttctggatgcagataaaccacagtggctacgagctgttgcggtggaatcaatacacagattctgtgtgcagcctcaactattaaggtcattttgtcagtcctatgatatgaaacagcattctaccaaggtttttcgtgatattgtaaatgcactgggatcttttatacagtccttgtttcttgtcccccctactggaaatcctgcaacaagcaaccaagctggaaacaataatttaggtggctcagtctcagcaccagctaactcaggaatggtggggattggtggaggtgttactttgctaccagcatttgaatataggggaacctggatacctattctgacaatcacagttcaaggcagtgctaaagccacctacttagaaatgttggacaaagttgagcctccaactatacctgaaggttacgccatgtctgtggcattccattgtttgctagaccttgttcgtggaatcacaagtatgattgaaggagagctaggagagcttgaaacagaatgtcaaaccaccactgaagaaggttcttcaccaacacagtcgacagaacagcaggatttacagtcaacatcagaccaaatggataaggaaattgttagtagggctgtttgggaagaaatggtgaatgcctgctggtgtggtcttcttgctgcactctcactccttcttgatgccagcacagatgaagctgccactgagaatattttaaaagctgaactgactatggctgctctttgtggaagactgggccttgtaacttcaagagatgcctttataactgcaatatgcaaaggttccctgcctccccattatgctcttactgtattgaataccaccactgcagctacactttccaacaaatcatattccgttcagggccaaagtgttatgatgataagtccatcaagtgaatctcaccaacaagttgtggcagtgggtcaacctttagcagtccagcctcaagggacagtaatgctgacttccaaaaatatccagtgtatgaggactttacttaacttggcgcattgccatggggctgttcttggaacatcatggcaacttgtcttggcaactcttcagcatcttgtgtggattctgggattaaagcctagtagtggcggtgccttgaaacctgggagagctgtagaaggacccagtacagttccttttaaggatttcatgcagccaccagcatccagagttcaaaatggagaatcttgaccggctacaatatatttgaaagcaggaagatagtctaaaaaatgtttgctcctaattgagtcttctgtgagaaggacatttcttactgcagataattcttggcagctgttgttggcctcctttaaattctacttacctgagttcagtaattcatattacaggcttgcacatcaacaaaggctcctgaatgaacagcagtgtaaggctttaataaattaaactgatgggagggataattaacactacagtatacatgctaccatatctccagttggtgatttaaagtgagcttatgtacagtttgtggtgtatgtgttaatgatgtactttttaaaaagaaagaagagatatttcaattcagtcagatttattagtctggtgtttttgcaccctttttcaagtacaaaatcgtactagaattttatgcaagatggtactgtaacattccatattatctataaccagcctttgttaacaaagggaactgatatacttgtgtgtataataaatggtacagttctgtataaaatagtgcatttatttaaattttaaaagtattgataatgttaaatgcttaaagctctatttattattaatacaaaattgtttgcttacatttttacttataatttgccttcatatgtggcggataagctcaccatatgatcatgcagttagcttcatgcttattttaaatgtattattagtgaccattaaacatctgaccagtaaggtcatgtgaacacagcagcaaatagtttatgatttgctgattttggagctttgaaatataggttcttaatacattgatacatattgtagcactatgacttcatcatacctcatttctttaaacagctctccaagctttcactgaagtctgtctgttttttatattggctgtctggattttaaagacttttcatattttatatttctactgattttgtttcccctaacaacatttgtcactgtctttgaattatgacccaggcaagatgatttcagattttctaaaatcttgcctgtgaggttttgttcatatcagtgcttcattttgtaatgtcttctcaagaaaaatacctatgttaactcacaagtataaaatatgtgtgtattataaaacaatgaaaagtgtatttttggagatagtcaagcatttagaagtgcagtgaacttgctgtcacggagtaaaatgctaattatgtttcactttcctagcctagtgaaaaagaaaagtgctcttgagtacaataccttaattatttcttaaaatactgactttgacctagctcactgtattttttatttaatggattatggattacagtatttttcttctgagttaaattttcataatttatgtgaagacacaaagatgtttaaaacaatgattattcataag

SEQ ID NO: 5039 - DNA, 5422 bp, Homo sapiens
attgtgggcgactcggctaatggcgtcggcgagtcttaggggcctggggagctggcgctgaagcttcttgccaggttggctggtgacacccggtgtggctgggccccgcggcagcggagggacctgcccgccttgtgggtttctcggccagagtcggcggagcctagcgggacggtgcgactgcggggggcgcctccgagaaaagccagaggtgttgcggggaagctgctgggggacgctcgagcaggctccgggttcgcagcccagggcccaagaagcgggctgctgaaggaccagagacaccgggagggagctgcctgtggccctaaggagctgaccgtgccagagcttgtttgtacctctcggaaattggctgggaccttggaggatcatgtccggcaccagcagccccgaggcggtgaagaagctgctggagaatatgcagagcgacttgcgcgccttgtcactggagtgcaagaagaaattcccacctgtcaaagaggctgctgaatcaggaataataaaagttaaaacaattgctgcacgaaacactgaaattttggcagcactgaaagagaacagctcagaggttgtacagccttttttaatgggttgtggaaccaaggaaccgaagatcactcagctatgtttggctgctattcagagactcatgtcacatgaagtcgtgtctgagactgcagctggaaatataattaacatgctttggcagctaatggagaatagtcttgaagaacttaagctacttcaaacagttcttgttcttttaacaaccaatacagtagttcatgatgaggcactttctaaggcaatcgttctttgttttcgactacacttcacaaaagataatattacaaataatacagctgctgctacagtgcgacaagttgttactgttgtttttgagaggatggttgctgaagatgaacgacacagagatattatagaacaaccagtactggtacaaggaaatagtaacagaagatctgtcagtaccctcaaaccttgtgctaaagatgcatatatgcttttccaggatctttgtcagttggttaatgctgatgctccttattggctagtgggcatgacagaaatgactcggacgtttggcctcgaattacttgagtcagtcctcaatgattttccgcaggtctttttacaacaccaagaatttagtttcctcctcaaagaaagggtatgtcctcttgtgataaagctcttttctccaaatataaagttcagacaaggttccagcacctcatcttctccagcaccagttgaaaaaccatattttcctatctgcatgcgtttgctgagagtagtatctgttctgattaagcagttttacagtcttttggtaactgaatgtgagatatttctgtcacttctggtgaaatttctggatgcagataaaccacagtggctacgagctgttgcggtggaatcaatacacagattctgtgtgcagcctcaactattaaggtcattttgtcagtcctatgatatgaaacagcattctaccaaggtttttcgtgatattgtaaatgcactgggatcttttatacagtccttgtttcttgtcccccctactggaaatcctgcaacaagcaaccaagctggaaacaataatttaggtggctcagtctcagcaccagctaactcaggaatggtggggattggtggaggtgttactttgctaccagcatttgaatataggggaacctggatacctattctgacaatcacagttcaaggcagtgctaaagccacctacttagaaatgttggacaaagttgagcctccaactatacctgaaggttacgccatgtctgtggcattccattgtttgctagaccttgttcgtggaatcacaagtatgattgaaggagagctaggagagcttgaaacagaatgtcaaaccaccactgaagaaggttcttcaccaacacagtcgacagaacagcaggatttacagtcaacatcagaccaaatggataaggaaattgttagtagggctgtttgggaagaaatggtgaatgcctgctggtgtggtcttcttgctgcactctcactccttcttgatgccagcacagatgaagctgccactgagaatattttaaaagctgaactgactatggctgctctttgtggaagactgggccttgtaacttcaagagatgcctttataactgcaatatgcaaaggttccctgcctccccattatgctcttactgtattgaataccaccactgcagctacactttccaacaaatcatattccgttcagggccaaagtgttatgatgataagtccatcaagtgaatctcaccaacaagttgtggcagtgggtcaacctttagcagtccagcctcaagggacagtaatgctgacttccaaaaatatccagtgtatgaggactttacttaacttggcgcattgccatggggctgttcttggaacatcatggcaacttgtcttggcaactcttcagcatcttgtgtggattctgggattaaagcctagtagtggcggtgccttgaaacctgggagagctgtagaaggacccagtacagttctaacaacagcagtgatgacagatttaccagtgatttccaatatactttcaagattgtttgaaagctcacagtatcttgatgatgtatcactgcatcatttaataaatgcactttgctccttgtctctagaagcaatggatatggcctatggaaataataaggaaccatctctttttgctgttgccaaattgttagaaactggtttagttaatatgcaccgaatagaaattctgtggagacctctgactggccatctacttgagaaggtctgccagcatccaaactctcgaatgagagaatggggagcagaagctttaacttctcttattaaagcaggattaacatttaaccatgatcctccactctcacaaaaccagaggctgcagttgcttttattgaacccgttaaaggagatgtccaatattaatcatccagatattcgactcaagcagttagaatgcgtgttgcagattctgcagagtcagggagacagtcttgggcctggatggccattagtgcttggagtcatgggagcaatcagaaatgatcaaggagaatccttgatacgaactgcattccagtgtcttcagttggttgtgacagattttctaccaacaatgccttgtacttgcctgcaaatagttgtagatgttgcaggtagctttggcctccataaccaagaactcaatattagtttaacttcaataggtttattgtggaatatttcagattattttttccaaagaggggaaactattgaaaaagaactaaataaggaagaggcagcacagcaaaagcaggcagaagagaaaggagttgttttaaatcggccattccaccctgcaccgccatttgattgcttgtggttatgtctttatgcaaaattgggtgaactatgtgtggatccccgtcctgctgtcaggaagagtgcagggcaaactctgttttctacaattggtgcgcatggaactttattacagcattcaacctggcacactgttatctggaaggtactctttcatctactggacagagttcgagagtcctctaccactgcagacaaagaaaagattgagtctggaggtggcaatattctcattcatcattcaagggacaccgccgagaagcaatgggctgagacgtgggtattaacattggctggagtagcaaggatcttcaacactagaagatatttgctgcagcctttaggagatttttcaagagcttgggatgttcttcttgaccatatacagtcagcagcactcagcaaaaacaatgaagtatctctggctgctctgaaaagcttccaggaaattttacagattgtgtcccctgtcagagactcagataagcctgagacaccacctgtagttaatgtacctgtgcctgttcttatagggcccatatcaggcatgagcaggccatttgtaagaacagattccattggagaaaaactaggaagatatagtagctctgagccacccattgttactgatgagcttgaagatttgaatctatggtgggctgcgtggaatacctggtatagaattggatctgaaagtactaagcctcctattacttttgataaactaacttttattcctagccagccttttcttacagctttaattcagatatttccagctctctaccaacacataaaaactggtttcaatatggatgacttgcaaaagttgggagtcatattgcacagtgctatttcagtcccaataagttcagatgcatccccttttattcttccatcttataccgaagcagttttgacaagtttacaggaagctgtacttacagctttagatgttctccaaaaggccatttgtgtaggaccagaaaacatgcagataatgtatccagctatatttgaccagttgttggcatttgtagaattttcctgtaaacctccacagtatggacagctggaaacaaagcacattgcaaatgcaaaatataatcagatccaactatttgcaccggcggaatgggtagccttgaattatgtgccgtttgctgaaaggtctttagaagtagttgtggatttataccaaaaaacagcgtgtcacaaagcagtggtgaatgagaaagtgctccagaatattattaagactcttagggttcctctcagtttgaagtattcctgcccttctgaaagcacatggaaactagcagtatcctctctcctcagagttctttctattgggctacctgttgcccggcagcatgcttcttctggaaaatttgacagtatgtggccagaactagccaatacttttgaagattttctctttactaaaagcatacctccagataatctctctattcaagagtttcaaagaaatgaaaatattgatgtcgaggtagttcaacttatcagcaatgagatactaccttatgccaattttattcctaaggaatttgttggtcaaataatgacaatgcttaacaagggctcaatacattctcagtcatcttcatttacagaagcagagattgatattcgtttgagagaggaattttctaaaatgtgttttgaaacattactccagttttccttcagtaataaagtcacaacacctcaagaaggctacatctcacgaatggcactctcagtgcttttaaagaggtcccaagatgtactacatcgctatatagaggatgaaagattaagtggtaaatgccctcttccaaggcaacaagtaacagaaattatatttgttttaaaagcagtcagtactcttattgattcacttaagaaaactcagcctgagaatgcttgtatcagcctatttggaataccaccctacttttaa

SEQ ID NO: 5040 - DNA, 8406 bp, Homo sapiens
attgtgggcgactcggctaatggcgtcggcgagtcttaggggcctggggagctggcgctgaagcttcttgccaggttggctggtgacacccggtgtggctgggccccgcggcagcggagggacctgcccgccttgtgggtttctcggccagagtcggcggagcctagcgggacggtgcgactgcggggggcgcctccgagaaaagccagaggtgttgcggggaagctgctgggggacgctcgagcaggctccgggttcgcagcccagggcccaagaagcgggctgctgaaggaccagagacaccgggagggagctgcctgtggccctaaggagctgaccgtgccagagcttgtttgtacctctcggaaattggctgggaccttggaggatcatgtccggcaccagcagccccgaggcggtgaagaagctgctggagaatatgcagagcgacttgcgcgccttgtcactggagtgcaagaagaaattcccacctgtcaaagaggctgctgaatcaggaataataaaagttaaaacaattgctgcacgaaacactgaaattttggcagcactgaaagagaacagctcagaggttgtacagccttttttaatgggttgtggaaccaaggaaccgaagatcactcagctatgtttggctgctattcagagactcatgtcacatgaagtcgtgtctgagactgcagctggaaatataattaacatgctttggcagctaatggagaatagtcttgaagaacttaagctacttcaaacagttcttgttcttttaacaaccaatacagtagttcatgatgaggcactttctaaggcaatcgttctttgttttcgactacacttcacaaaagataatattacaaataatacagctgctgctacagtgcgacaagttgttactgttgtttttgagaggatggttgctgaagatgaacgacacagagatattatagaacaaccagtactggtacaaggaaatagtaacagaagatctgtcagtaccctcaaaccttgtgctaaagatgcatatatgcttttccaggatctttgtcagttggttaatgctgatgctccttattggctagtgggcatgacagaaatgactcggacgtttggcctcgaattacttgagtcagtcctcaatgattttccgcaggtctttttacaacaccaagaatttagtttcctcctcaaagaaagggtatgtcctcttgtgataaagctcttttctccaaatataaagttcagacaaggttccagcacctcatcttctccagcaccagttgaaaaaccatattttcctatctgcatgcgtttgctgagagtagtatctgttctgattaagcagttttacagtcttttggtaactgaatgtgagatatttctgtcacttctggtgaaatttctggatgcagataaaccacagtggctacgagctgttgcggtggaatcaatacacagattctgtgtgcagcctcaactattaaggtcattttgtcagtcctatgatatgaaacagcattctaccaaggtttttcgtgatattgtaaatgcactgggatcttttatacagtccttgtttcttgtcccccctactggaaatcctgcaacaagcaaccaagctggaaacaataatttaggtggctcagtctcagcaccagctaactcaggaatggtggggattggtggaggtgttactttgctaccagcatttgaatataggggaacctggatacctattctgacaatcacagttcaaggcagtgctaaagccacctacttagaaatgttggacaaagttgagcctccaactatacctgaaggttacgccatgtctgtggcattccattgtttgctagaccttgttcgtggaatcacaagtatgattgaaggagagctaggagagcttgaaacagaatgtcaaaccaccactgaagaaggttcttcaccaacacagtcgacagaacagcaggatttacagtcaacatcagaccaaatggataaggaaattgttagtagggctgtttgggaagaaatggtgaatgcctgctggtgtggtcttcttgctgcactctcactccttcttgatgccagcacagatgaagctgccactgagaatattttaaaagctgaactgactatggctgctctttgtggaagactgggccttgtaacttcaagagatgcctttataactgcaatatgcaaaggttccctgcctccccattatgctcttactgtattgaataccaccactgcagctacactttccaacaaatcatattccgttcagggccaaagtgttatgatgataagtccatcaagtgaatctcaccaacaagttgtggcagtgggtcaacctttagcagtccagcctcaagggacagtaatgctgacttccaaaaatatccagtgtatgaggactttacttaacttggcgcattgccatggggctgttcttggaacatcatggcaacttgtcttggcaactcttcagcatcttgtgtggattctgggattaaagcctagtagtggcggtgccttgaaacctgggagagctgtagaaggacccagtacagttctaacaacagcagtgatgacagatttaccagtgatttccaatatactttcaagattgtttgaaagctcacagtatcttgatgatgtatcactgcatcatttaataaatgcactttgctccttgtctctagaagcaatggatatggcctatggaaataataaggaaccatctctttttgctgttgccaaattgttagaaactggtttagttaatatgcaccgaatagaaattctgtggagacctctgactggccatctacttgaggtctgccagcatccaaactctcgaatgagagaatggggagcagaagctttaacttctcttattaaagcaggattaacatttaaccatgatcctccactctcacaaaaccagaggctgcagttgcttttattgaacccgttaaaggagatgtccaatattaatcatccagatattcgactcaagcagttagaatgcgtgttgcagattctgcagagtcagggagacagtcttgggcctggatggccattagtgcttggagtcatgggagcaatcagaaatgatcaaggagaatccttgatacgaactgcattccagtgtcttcagttggttgtgacagattttctaccaacaatgccttgtacttgcctgcaaatagttgtagatgttgcaggtagctttggcctccataaccaagaactcaatattagtttaacttcaataggtttattgtggaatatttcagattattttttccaaagaggggaaactattgaaaaagaactaaataaggaagaggcagcacagcaaaagcaggcagaagagaaaggagttgttttaaatcggccattccaccctgcaccgccatttgattgcttgtggttatgtctttatgcaaaattgggtgaactatgtgtggatccccgtcctgctgtcaggaagagtgcagggcaaactctgttttctacaattggtgcgcatggaactttattacagcattcaacctggcacactgttatctggaaggtactctttcatctactggacagagttcgagagtcctctaccactgcagacaaagaaaagattgagtctggaggtggcaatattctcattcatcattcaagggacaccgccgagaagcaatgggctgagacgtgggtattaacattggctggagtagcaaggatcttcaacactagaagatatttgctgcagcctttaggagatttttcaagagcttgggatgttcttcttgaccatatacagtcagcagcactcagcaaaaacaatgaagtatctctggctgctctgaaaagcttccaggaaattttacagattgtgtcccctgtcagagactcagataagcctgagacaccacctgtagttaatgtacctgtgcctgttcttatagggcccatatcaggcatgagcaggccatttgtaagaacagattccattggagaaaaactaggaagatatagtagctctgagccacccattgttactgatgagcttgaagatttgaatctatggtgggctgcgtggaatacctggtatagaattggatctgaaagtactaagcctcctattacttttgataaactaacttttattcctagccagccttttcttacagctttaattcagatatttccagctctctaccaacacataaaaactggtttcaatatggatgacttgcaaaagttgggagtcatattgcacagtgctatttcagtcccaataagttcagatgcatccccttttattcttccatcttataccgaagcagttttgacaagtttacaggaagctgtacttacagctttagatgttctccaaaaggccatttgtgtaggaccagaaaacatgcagataatgtatccagctatatttgaccagttgttggcatttgtagaattttcctgtaaacctccacagtatggacagctggaaacaaagcacattgcaaatgcaaaatataatcagatccaactatttgcaccggcggaatgggtagccttgaattatgtgccgtttgctgaaaggtctttagaagtagttgtggatttataccaaaaaacagcgtgtcacaaagcagtggtgaatgagaaagtgctccagaatattattaagactcttagggttcctctcagtttgaagtattcctgcccttctgaaagcacatggaaactagcagtatcctctctcctcagagttctttctattgggctacctgttgcccggcagcatgcttcttctggaaaatttgacagtatgtggccagaactagccaatacttttgaagattttctctttactaaaagcatacctccagataatctctctattcaagagtttcaaagaaatgaaaatattgatgtcgaggtagttcaacttatcagcaatgagatactaccttatgccaattttattcctaaggaatttgttggtcaaataatgacaatgcttaacaagggctcaatacattctcagtcatcttcatttacagaagcagagattgatattcgtttgagagaggaattttctaaaatgtgttttgaaacattactccagttttccttcagtaataaagtcacaacacctcaagaaggctacatctcacgaatggcactctcagtgcttttaaagaggtcccaagatgtactacatcgctatatagaggatgaaagattaagtggtaaatgccctcttccaaggcaacaagtaacagaaattatatttgttttaaaagcagtcagtactcttattgattcacttaagaaaactcagcctgagaatgttgatggaaatacctgggcacaagtaattgccttatacccaactttagtagaatgcatcacctgttcttcttcagaagtctgttctgcacttaaagaggcactagttccttttaaggatttcatgcagccaccagcatccagagttcaaaatggagaatcttgaccggctacaatatatttgaaagcaggaagatagtctaaaaaatgtttgctcctaattgagtcttctgtgagaaggacatttcttactgcagataattcttggcagctgttgttggcctcctttaaattctacttacctgagttcagtaattcatattacaggcttgcacatcaacaaaggctcctgaatgaacagcagtgtaaggctttaataaattaaactgatgggagggataattaacactacagtatacatgctaccatatctccagttggtgatttaaagtgagcttatgtacagtttgtggtgtatgtgttaatgatgtactttttaaaaagaaagaagagatatttcaattcagtcagatttattagtctggtgtttttgcaccctttttcaagtacaaaatcgtactagaattttatgcaagatggtactgtaacattccatattatctataaccagcctttgttaacaaagggaactgatatacttgtgtgtataataaatggtacagttctgtataaaatagtgcatttatttaaattttaaaagtattgataatgttaaatgcttaaagctctatttattattaatacaaaattgtttgcttacatttttacttataatttgccttcatatgtggcggataagctcaccatatgatcatgcagttagcttcatgcttattttaaatgtattattagtgaccattaaacatctgaccagtaaggtcatgtgaacacagcagcaaatagtttatgatttgctgattttggagctttgaaatataggttcttaatacattgatacatattgtagcactatgacttcatcatacctcatttctttaaacagctctccaagctttcactgaagtctgtctgttttttatattggctgtctggattttaaagacttttcatattttatatttctactgattttgtttcccctaacaacatttgtcactgtctttgaattatgacccaggcaagatgatttcagattttctaaaatcttgcctgtgaggttttgttcatatcagtgcttcattttgtaatgtcttctcaagaaaaatacctatgttaactcacaagtataaaatatgtgtgtattataaaacaatgaaaagtgtatttttggagatagtcaagcatttagaagtgcagtgaacttgctgtcacggagtaaaatgctaattatgtttcactttcctagcctagtgaaaaagaaaagtgctcttgagtacaataccttaattatttcttaaaatactgactttgacctagctcactgtattttttatttaatggattatggattacagtatttttcttctgagttaaattttcataatttatgtgaagacacaaagatgtttaaaacaatgattattcataagaaatcatgatggtctcagtattattttagtgtattggaaggtctttgatcttaatagaatttataaatttcagcttctccagaataatcataaaactgcaaaaagatattataattgagtcatgattgagatacagttttgaggctattataattgtataattatttaatttgcattatctgtaaaatgtagtaaggtctttgaggggatattttttatttacatgaattactgaatttctattttattatttcacctaaaattaaggtaaaatatggcatttcataagttctgctttcagcattttccttaaagttgtaaaaaatcaagctatgtacttattttctatatttgggtgtgttaaattgaggattagaaaaatccacataatcactgataaagcattgaaacagaataacccaagggtagtgtaccgattcagtaacatgttaaaaatattgctatgcatttattcaaaggaaaatggtctgttcttgagaaataaaagatcagttgcaattaggataattaaatagttaaatatgagtcaagtgtatgcaatatacatttatatgaaccaaagcttgctttatcaggaccatgccctacagttcaaaacataaacatagtgaatgtgttaatatcatataataaggtaataaatgccagtcttagtgtgaagcaagtgggtggcccccttggtagtataattggacaggattttcctccagaatatttcctgtcaccctccaagagtcactacagtaattgattgctggcatggaacacattgcccttgtcttgttagtatgaattgggttctccagtgactagaagaactggggtgtgtgaaagtattcgatgccaggagattcaaaaaggaagctctcaaagataagatcattttatggcacaattgagtctataaccagccctttaagcagtagtaaaaatgtcctttgtcatacttactagaaatactatgagttttttttttttttttcatttgagacggagtctcgctctgtcacccaggctggaatgcagtggcacgatcttggctcactgcaacctctgcttcccgggttcaagcagtttcctgcttcagacttccaagtagctgggattacagacatgccaccatgccaggctaatttttttaatatttttagtagagatggggtttcaccattttggccattctagtcttgaactcctgacctcaggtgatctgcccgccttggcctcccaaagtgctgacattacaggcctgagccactgcgcccagccaataccatgagttttaagcctcacatcgtcacttgctgtcactgccagtgcctgttttattcatattgctggacaacagacatatgccaccaattgtatgattaataaagtctttttctggccattttgtccattataaaggaaataaactaattgttaacttgca

SEQ ID NO: 5041 - DNA, 6130 bp, Homo sapiens
gggcgactcggctaatggcgtcggcgagtcttaggggcctggggagctggcgctgaagcttcttgccaggttggctggtgacacccggtgtggctgggccccgcggcagcggagggacctgcccgccttgtgggtttctcggccagagtcggcggagcctagcgggacggtgcgactgcggggggcgcctccgagaaaagccagaggtgttgcggggaagctgctgggggacgctcgagcaggctccgggttcgcagcccagggcccaagaagcgggctgctgaaggaccagagacaccgggagggagctgcctgtggccctaaggagctgaccgtgccagagcttgtttgtacctctcggaaattggctgggaccttggaggatcatgtccggcaccagcagccccgaggcggtgaagaagctgctggagaatatgcagagcgacttgcgcgccttgtcactggagtgcaagaagaaattcccacctgtcaaagaggctgctgaatcaggaataataaaagttaaaacaattgctgcacgaaacactgaaattttggcagcactgaaagagaacagctcagaggttgtacagccttttttaatgggttgtggaaccaaggaaccgaagatcactcagctatgtttggctgctattcagagactcatgtcacatgaagtcgtgtctgagactgcagctggaaatataattaacatgctttggcagctaatggagaatagtcttgaagaacttaagctacttcaaacagttcttgttcttttaacaaccaatacagtagttcatgatgaggcactttctaaggcaatcgttctttgttttcgactacacttcacaaaagataatattacaaataatacagctgctgctacagtgcgacaagttgttactgttgtttttgagaggatggttgctgaagatgaacgacacagagatattatagaacaaccagtactggtacaaggaaatagtaacagaagatctgtcagtaccctcaaaccttgtgctaaagatgcatatatgcttttccaggatctttgtcagttggttaatgctgatgctccttattggctagtgggcatgacagaaatgactcggacgtttggcctcgaattacttgagtcagtcctcaatgattttccgcaggtctttttacaacaccaagaatttagtttcctcctcaaagaaagggtatgtcctcttgtgataaagctcttttctccaaatataaagttcagacaaggttccagcacctcatcttctccagcaccagttgaaaaaccatattttcctatctgcatgcgtttgctgagagtagtatctgttctgattaagcagttttacagtcttttggtaactgaatgtgagatatttctgtcacttctggtgaaatttctggatgcagataaaccacagtggctacgagctgttgcggtggaatcaatacacagattctgtgtgcagcctcaactattaaggtcattttgtcagtcctatgatatgaaacagcattctaccaaggtttttcgtgatattgtaaatgcactgggatcttttatacagtccttgtttcttgtcccccctactggaaatcctgcaacaagcaaccaagctggaaacaataatttaggtggctcagtctcagcaccagctaactcaggaatggtggggattggtggaggtgttactttgctaccagcatttgaatataggggaacctggatacctattctgacaatcacagttcaaggcagtgctaaagccacctacttagaaatgttggacaaagttgagcctccaactatacctgaaggttacgccatgtctgtggcattccattgtttgctagaccttgttcgtggaatcacaagtatgattgaaggagagctaggagagcttgaaacagaatgtcaaaccaccactgaagaaggttcttcaccaacacagtcgacagaacagcaggatttacagtcaacatcagaccaaatggataaggaaattgttagtagggctgtttgggaagaaatggtgaatgcctgctggtgtggtcttcttgctgcactctcactccttcttgatgccagcacagatgaagctgccactgagaatattttaaaagctgaactgactatggctgctctttgtggaagactgggccttgtaacttcaagagatgcctttataactgcaatatgcaaaggttccctgcctccccattatgctcttactgtattgaataccaccactgcagctacactttccaacaaatcatattccgttcagggccaaagtgttatgatgataagtccatcaagtgaatctcaccaacaagttgtggcagtgggtcaacctttagcagtccagcctcaagggacagtaatgctgacttccaaaaatatccagtgtatgaggactttacttaacttggcgcattgccatggggctgttcttggaacatcatggcaacttgtcttggcaactcttcagcatcttgtgtggattctgggattaaagcctagtagtggcggtgccttgaaacctgggagagctgtagaaggacccagtacagttctaacaacagcagtgatgacagatttaccagtgatttccaatatactttcaagattgtttgaaagctcacagtatcttgatgatgtatcactgcatcatttaataaatgcactttgctccttgtctctagaagcaatggatatggcctatggaaataataaggaaccatctctttttgctgttgccaaattgttagaaactggtttagttaatatgcaccgaatagaaattctgtggagacctctgactggccatctacttgaggtctgccagcatccaaactctcgaatgagagaatggggagcagaagctttaacttctcttattaaagcaggattaacatttaaccatgatcctccactctcacaaaaccagaggctgcagttgcttttattgaacccgttaaaggagatgtccaatattaatcatccagatattcgactcaagcagttagaatgcgtgttgcagattctgcagagtcagggagacagtcttgggcctggatggccattagtgcttggagtcatgggagcaatcagaaatgatcaaggagaatccttgatacgaactgcattccagtgtcttcagttggttgtgacagattttctaccaacaatgccttgtacttgcctgcaaatagttgtagatgttgcaggtagctttggcctccataaccaagaactcaatattagtttaacttcaataggtttattgtggaatatttcagattattttttccaaagaggggaaactattgaaaaagaactaaataaggaagaggcagcacagcaaaagcaggcagaagagaaaggagttgttttaaatcggccattccaccctgcaccgccatttgattgcttgtggttatgtctttatgcaaaattgggtgaactatgtgtggatccccgtcctgctgtcaggaagagtgcagggcaaactctgttttctacaattggtgcgcatggaactttattacagcattcaacctggcacactgttatctggaaggtactctttcatctactggacagagttcgagagtcctctaccactgcagacaaagaaaagattgagtctggaggtggcaatattctcattcatcattcaagggacaccgccgagaagcaatgggctgagacgtgggtattaacattggctggagtagcaaggatcttcaacactagaagatatttgctgcagcctttaggagatttttcaagagcttgggatgttcttcttgaccatatacagtcagcagcactcagcaaaaacaatgaagtatctctggctgctctgaaaagcttccaggaaattttacagattgtgtcccctgtcagagactcagataagcctgagacaccacctgtagttaatgtacctgtgcctgttcttatagggcccatatcaggcatgagcaggccatttgtaagaacagattccattggagaaaaactaggaagatatagtagctctgagccacccattgttactgatgagcttgaagatttgaatctatggtgggctgcgtggaatacctggtatagaattggatctgaaagtactaagcctcctattacttttgataaactaacttttattcctagccagccttttcttacagctttaattcagatatttccagctctctaccaacacataaaaactggtttcaatatggatgacttgcaaaagttgggagtcatattgcacagtgctatttcagtcccaataagttcagatgcatccccttttattcttccatcttataccgaagcagttttgacaagtttacaggaagctgtacttacagctttagatgttctccaaaaggccatttgtgtaggaccagaaaacatgcagataatgtatccagctatatttgaccagttgttggcatttgtagaattttcctgtaaacctccacagtatggacagctggaaacaaagcacattgcaaatgcaaaatataatcagatccaactatttgcaccggcggaatgggtagccttgaattatgtgccgtttgctgaaaggtctttagaagtagttgtggatttataccaaaaaacagcgtgtcacaaagcagtggtgaatgagaaagtgctccagaatattattaagactcttagggttcctctcagtttgaagtattcctgcccttctgaaagcacatggaaactagcagtatcctctctcctcagagttctttctattgggctacctgttgcccggcagcatgcttcttctggaaaatttgacagtatgtggccagaactagccaatacttttgaagattttctctttactaaaagcatacctccagataatctctctattcaagagtttcaaagaaatgaaaatattgatgtcgaggtagttcaacttatcagcaatgagatactaccttatgccaattttattcctaaggaatttgttggtcaaataatgacaatgcttaacaagggctcaatacattctcagtcatcttcatttacagaagcagagattgatattcgtttgagagaggaattttctaaaatgtgttttgaaacattactccagttttccttcagtaataaagtcacaacacctcaagaaggctacatctcacgaatggcactctcagtgcttttaaagaggtcccaagatgtactacatcgctatatagaggatgaaagattaagtggtaaatgccctcttccaaggcaacaagtaacagaaattatatttgttttaaaagcagtcagtactcttattgattcacttaagaaaactcagcctgagaatgcttgtatcagcctatttggaataccaccctacttttaaaccttgtttttaatctcttaaagttgatggaaatacctgggcacaagtaattgccttatacccaactttagtagaatgcatcacctgttcttcttcagaagtctgttctgcacttaaagaggcactagttccttttaaggatttcatgcagccaccagcatccagagttcaaaatggagaatcttgaccggctacaatatatttgaaagcaggaagatagtctaaaaaatgtttgctcctaattgagtcttctgtgagaaggacatttcttactgcagataattcttggcagctgttgttggcctcctttaaattctacttacctgagttcagtaattcatattacaggcttgcacatcaacaaaggctcctgaatgaacagcagtgtaaggctttaataaattaaactgatgggagggataattaacactacagtatacatgctaccatatctccagttggtgatttaaagtgagcttatgtacagtttgtggtgtatgtgttaatgatgtactttttaaaaagaaagaagagatatttcaattcagtcagatttattagtctggtgtttttgcaccctttttcaagtacaaaatcgtactagaattttatgcaagatggtactgtaacattccatattatctataaccagcctttgttaacaaagggaactgatatacttgtgtgtataataaatggtacagttctgtataaaa

SEQ ID NO: 5042 - DNA, 2940 bp, Homo sapiens
ggtcccggacggtcgccgccagctgcgagtggaagtgagcgagggctagtcccggaccgccgggccaggggtccggcggcagcagacgggtaccgtggcggccaaaaaaatgctcctgtaccgaggggcccccgccggccctggcgcgccgggctgcgggctggcccggcccggcggcggcccgcaggccttcgggatccgcctgagcacgatgagcccccgctacctccagagcaactccagcagccacacgcgacccttcagtgccatcgcggagctgctagataatgctgtagatccagatgtatctgccaggacggtctttatagatgttgaggaggtcaagaataaatcttgtttgacctttaccgatgatggatgtgggatgacacctcataaactacaccgaatgctcagctttggctttacagataaagtaataaagaagagccagtgtcccattggggtctttggtaatggtttcaagtcaggctccatgcggctaggaaaggacgcccttgtcttcaccaagaatgggggtactctcactgttggacttctatcacagacctatctggaatgtgtccaggcccaggcagttattgtaccaattgttccattcaaccagcaaaacaaaaaaatgattattaccgaggattcattgcccagcctagaagccatcttgaactattccattttcaaccgtgaaaatgacctgctggcccagtttgatgccatcccaggcaaaaaaggcactcgtgttctcatttggaacatccgcagaaataaaaatggaaaatctgagttggactttgatacagatcaatatgacatcctggtatcagactttgacacagaagaaaaaatgactggcggtgttacctctgagctaccagaaacagaatattctttaagggcattttgtggtattctatacatgaagccacgcatgaaaatttttctgcgtcaaaagaaggtgactacccagatgattgccaagagcctggccaatgtagaatatgatacatataaacctaccttcacaaataagcaggtgagaatcacctttgggttctcttgcaagaatagtaaccagtttggaataatgatgtatcataacaaccgactcataaaatcttttgagaaggtggggtgccaggtgaagccaactcgtggagaaggtgtaggagtaattggagtcattgagtgcaatttcctaaaacctgcctacaacaaacaagactttgagtataccaaggagtaccggctaacaataaatgcccttgcccagaagctcaatgcttactggaaggaaaaaacatctcaagataattttgagacctcaactgtagccaggccaataccgaaggttcctgaccagacatgggttcagtgtgatgagtgtcttaaatggagaaagcttcctgggaagattgatccatccatgttacctgcaagatggttttgttattataattcccatccaaagtacaggagatgctctgttccagaggaacaagaactcactgatgaagacctgtgcttgagcaaagctaagaaacaagaacaaactgttgaggagaagaagaagatgcctatggaaaatgagaaccaccaggtattcagtaatccaccaaagatccttactgttcaagaaatggctggattgaataacaagacaattggatatgagggaattcatagccctagtgtgcttccttctggtggagaagaaagcagatcaccatctcttcaacttaagcctctggattccagtgttttacagttttccagtaagtacaaatggatcctaggtgaagaaccggtggagaaacgaagaaggctccagaatgagatgacaacaccttctctagattattccatgcctgctccttacaggagggtagaagcacctgttgcctacccagaaggggagaacagccatgataaatcgagttctgagagaagtacaccaccataccttttcccagaatacccagaagcaagcaagaatacaggtcagaatagggaggtttcaattctgtatccaggggccaaagaccaacgccaggggtccctgcttcctgaagaattagaagatcagatgccaagattggtggcagaagaatctaacagaggtagcacaaccataaacaaagaagaagtcaacaagggaccttttgtagctgttgtgggtgttgccaaaggtgttagagattcaggagctcccattcagctgatcccttttaacagagaggagcttgctgagagacgaaaagcagttgaatcctggaacccagtgccttattctgtggcctctgctgcaatccctgctgcagccattggggagaaagcaagaggctatgaggagagcgaaggtcataatacaccaaagttgaagaaccagagagagctggaagaattgaagagaaccacagaaaaattggaacgtgttttggctgaaaggaatttgttccagcaaaaggtggaggagctggaacaggagaggaatcactggcagtctgaattcaagaaagtccaacatgaattggtgatctacagtacccaggaggcggaaggcttgtactggagcaagaaacacatgggttatcgccaagctgaattccagattctgaaagctgagctggaaagaaccaaagaggaaaagcaagagttaaaagagaaactgaaggaaacagagacacacctggaaatgctgcagaaggctcagggctttggcaaagcttacgcggctacgtatccacgtcagctatctccttacttctgtcctccctcacttggagcttcgtgagatcgggtatgactcagaacaagtggatgggatcctgtacacggtgctggaggcaaatcacatactggattgagcaccagactgtatacccttctcttctcttatcttctgtctgttctcttttctct

SEQ ID NO: 5043 - DNA, 3834 bp, Homo sapiens
atatttctgtacggcccagaggcagcccgggcagtcgccgggtcggtagaggtgctgacagggcggagccgccgcttgcctcagccggcctcacccctcccgcccgggacaggtggctggagcgcgctccgcctccgccagctgcgagtgggagcgagggagggccggtcccggacggtcgccgccagctgcgagtggaagtgagcgagggctagtcccggaccgccgggccaggggtccggcggcagcagacgggtaccgtggcggccaaaaaaatgctcctgtaccgaggggcccccgccggccctggcgcgccgggctgcgggctggcccggcccggcggcggcccgcaggccttcgggatccgcctgagcacgatgagcccccgctacctccagagcaactccagcagccacacgcgacccttcagtgccatcgcggagctgctagataatgctgtagatccagatgtatctgccaggacggtctttatagatgttgaggaggtcaagaataaatcttgtttgacctttaccgatgatggatgtgggatgacacctcataaactacaccgaatgctcagctttggctttacagataaagtaataaagaagagccagtgtcccattggggtctttggtaatggtttcaagtcaggctccatgcggctaggaaaggacgcccttgtcttcaccaagaatgggggtactctcactgttggacttctatcacagacctatctggaatgtgtccaggcccaggcagttattgtaccaattgttccattcaaccagcaaaacaaaaaaatgattattaccgaggattcattgcccagcctagaagccatcttgaactattccattttcaaccgtgaaaatgacctgctggcccagtttgatgccatcccaggcaaaaaaggcactcgtgttctcatttggaacatccgcagaaataaaaatggaaaatctgagttggactttgatacagatcaatatgacatcctggtatcagactttgacacagaagaaaaaatgactggcggtgttacctctgagctaccagaaacagaatattctttaagggcattttgtggtattctatacatgaagccacgcatgaaaatttttctgcgtcaaaagaaggtgactacccagatgattgccaagagcctggccaatgtagaatatgatacatataaacctaccttcacaaataagcaggtgagaatcacctttgggttctcttgcaagaatagtaaccagtttggaataatgatgtatcataacaaccgactcataaaatcttttgagaaggtggggtgccaggtgaagccaactcgtggagaaggtgtaggagtaattggagtcattgagtgcaatttcctaaaacctgcctacaacaaacaagactttgagtataccaaggagtaccggctaacaataaatgcccttgcccagaagctcaatgcttactggaaggaaaaaacatctcaagataattttgagacctcaactgtagccaggccaataccgaaggttcctgaccagacatgggttcagtgtgatgagtgtcttaaatggagaaagcttcctgggaagattgatccatccatgttacctgcaagatggttttgttattataattcccatccaaagtacaggagatgctctgttccagaggaacaagaactcactgatgaagacctgtgcttgagcaaagctaagaaacaagaacaaactgttgaggagaagaagaagatgcctatggaaaatgagaaccaccaggtattcagtaatccaccaaagatccttactgttcaagaaatggctggattgaataacaagacaattggatatgagggaattcatagccctagtgtgcttccttctggtggagaagaaagcagatcaccatctcttcaacttaagcctctggattccagtgttttacagttttccagtaagtacaaatggatcctaggtgaagaaccggtggagaaacgaagaaggctccagaatgagatgacaacaccttctctagattattccatgcctgctccttacaggagggtagaagcacctgttgcctacccagaaggggagaacagccatgataaatcgagttctgagagaagtacaccaccataccttttcccagaatacccagaagcaagcaagaatacaggtcagaatagggaggtttcaattctgtatccaggggccaaagaccaacgccaggggtccctgcttcctgaagaattagaagatcagatgccaagattggtggcagaagaatctaacagaggtagcacaaccataaacaaagaagaagtcaacaagggaccttttgtagctgttgtgggtgttgccaaaggtgttagagattcaggagctcccattcagctgatcccttttaacagagaggagcttgctgagagacgaaaagcagttgaatcctggaacccagtgccttattctgtggcctctgctgcaatccctgctgcagccattggggagaaagcaagaggctatgaggagagcgaaggtcataatacaccaaagttgaagaaccagagagagctggaagaattgaagagaaccacagaaaaattggaacgtgttttggctgaaaggaatttgttccagcaaaaggtggaggagctggaacaggagaggaatcactggcagtctgaattcaagaaagtccaacatgaattggtgatctacagtacccaggaggcggaaggcttgtactggagcaagaaacacatgggttatcgccaagctgaattccagattctgaaagctgagctggaaagaaccaaagaggaaaagcaagagttaaaagagaaactgaaggaaacagagacacacctggaaatgctgcagaaggctcaggtctcctaccggaccccagagggagatgacctagaaagggctttggcaaagcttacgcggctacgtatccacgtcagctatctccttacttctgtcctccctcacttggagcttcgtgagatcgggtatgactcagaacaagtggatgggatcctgtacacggtgctggaggcaaatcacatactggattgagcaccagactgtatacccttctcttctcttatcttctgtctgttctcttttctctccctccctcacgtctctctctctctctctctctctctctctctctctctctcaccctcacctttatgccttatatagagaatctctgtgtaaatcctggctcataatcagtctcctttttatcagttttggtgtggagaaagaggccagtttaaataggctttcaagagtctagggtcagaaaagcaatagtcactaagctaggtgacctgaaagctttaattttcatgacctggatatgtggtctattgtatatctttttctgaaatggtttgtattcatttaggttagatcaatcagcagatattgggtccggtataccaggtattattttggggtaagctaacaagtacaactcatgtttgcagccttcgaagatgtaacaatctcgttggaaacataagacatacatcacattatacacaaaagtgtatgatatgtacaactgagtggtacagatatgacatggaagatctgggggaggaagttcaaggaaggcaccacaccagaaatgggacctaaattaaggcttaaagaatgagcatggccacactgtcagtgagtgttctttaggtggtaggactatggttgatatttttcttcttcctatcttcctgcctttttcagattttcaatattaaacttgttattcttacattggaaaaaaataaattgtttttaaaaagatcaa

SEQ ID NO: 5044 - DNA, 3562 bp, Homo sapiens
atatttctgtacggcccagaggcagcccgggcagtcgccgggtcggtagaggtgctgacagggcggagccgccgcttgcctcagccggcctcacccctcccgcccgggacaggtggctggagcgcgctccgcctccgccagctgcgagtgggagcgagggagggccggtcccggacggtcgccgccagctgcgagtggaagtgagcgagggctagtcccggaccgccgggccaggggtccggcggcagcagacgggtaccgtggcggccaaaaaaatgctcctgtaccgaggggcccccgccggccctggcgcgccgggctgcgggctggcccggcccggcggcggcccgcaggccttcgggatccgcctgagcacgatgagcccccgctacctccagagcaactccagcagccacacgcgacccttcagtgccatcgcggagctgctagataatgctgtagatccagatgtatctgccaggacggtctttatagatgttgaggaggtcaagaataaatcttgtttgacctttaccgatgatggatgtgggatgacacctcataaactacaccgaatgctcagcagatgaggttgattactctccctgtggcttcctgaactagagtgtgtgaagcacgagtaacaatggtggaatgctgtggaggagggaaagggctccaaactataaaaatggaaaacaaattcatgtggttgtagttacccttaaataaaaatggaaaatctgagttggactttgatacagatcaatatgacatcctggtatcagactttgacacagaagaaaaaatgactggcggtgttacctctgagctaccagaaacagaatattctttaagggcattttgtggtattctatacatgaagccacgcatgaaaatttttctgcgtcaaaagaaggtgactacccagatgattgccaagagcctggccaatgtagaatatgatacatataaacctaccttcacaaataagcaggtgagaatcacctttgggttctcttgcaagaatagtaaccagtttggaataatgatgtatcataacaaccgactcataaaatcttttgagaaggtggggtgccaggtgaagccaactcgtggagaaggtgtaggagtaattggagtcattgagtgcaatttcctaaaacctgcctacaacaaacaagactttgagtataccaaggagtaccggctaacaataaatgcccttgcccagaagctcaatgcttactggaaggaaaaaacatctcaagataattttgagacctcaactgtagccaggccaataccgaaggttcctgaccagacatgggttcagtgtgatgagtgtcttaaatggagaaagcttcctgggaagattgatccatccatgttacctgcaagatggttttgttattataattcccatccaaagtacaggagatgctctgttccagaggaacaagaactcactgatgaagacctgtgcttgagcaaagctaagaaacaagaacaaactgttgaggagaagaagaagatgcctatggaaaatgagaaccaccaggtattcagtaatccaccaaagatccttactgttcaagaaatggctggattgaataacaagacaattggatatgagggaattcatagccctagtgtgcttccttctggtggagaagaaagcagatcaccatctcttcaacttaagcctctggattccagtgttttacagttttccagtaagtacaaatggatcctaggtgaagaaccggtggagaaacgaagaaggctccagaatgagatgacaacaccttctctagattattccatgcctgctccttacaggagggtagaagcacctgttgcctacccagaaggggagaacagccatgataaatcgagttctgagagaagtacaccaccataccttttcccagaatacccagaagcaagcaagaatacaggtcagaatagggaggtttcaattctgtatccaggggccaaagaccaacgccaggggtccctgcttcctgaagaattagaagatcagatgccaagattggtggcagaagaatctaacagaggtagcacaaccataaacaaagaagaagtcaacaagggaccttttgtagctgttgtgggtgttgccaaaggtgttagagattcaggagctcccattcagctgatcccttttaacagagaggagcttgctgagagacgaaaagcagttgaatcctggaacccagtgccttattctgtggcctctgctgcaatccctgctgcagccattggggagaaagcaagaggctatgaggagagcgaaggtcataatacaccaaagttgaagaaccagagagagctggaagaattgaagagaaccacagaaaaattggaacgtgttttggctgaaaggaatttgttccagcaaaaggtggaggagctggaacaggagaggaatcactggcagtctgaattcaagaaagtccaacatgaattggtgatctacagtacccaggaggcggaaggcttgtactggagcaagaaacacatgggttatcgccaagctgaattccagattctgaaagctgagctggaaagaaccaaagaggaaaagcaagagttaaaagagaaactgaaggaaacagagacacacctggaaatgctgcagaaggctcagggctttggcaaagcttacgcggctacgtatccacgtcagctatctccttacttctgtcctccctcacttggagcttcgtgagatcgggtatgactcagaacaagtggatgggatcctgtacacggtgctggaggcaaatcacatactggattgagcaccagactgtatacccttctcttctcttatcttctgtctgttctcttttctctccctccctcacgtctctctctctctctctctctctctctctctctctctctcaccctcacctttatgccttatatagagaatctctgtgtaaatcctggctcataatcagtctcctttttatcagttttggtgtggagaaagaggccagtttaaataggctttcaagagtctagggtcagaaaagcaatagtcactaagctaggtgacctgaaagctttaattttcatgacctggatatgtggtctattgtatatctttttctgaaatggtttgtattcatttaggttagatcaatcagcagatattgggtccggtataccaggtattattttggggtaagctaacaagtacaactcatgtttgcagccttcgaagatgtaacaatctcgttggaaacataagacatacatcacattatacacaaaagtgtatgatatgtacaactgagtggtacagatatgacatggaagatctgggggaggaagttcaaggaaggcaccacaccagaaatgggacctaaattaaggcttaaagaatgagcatggccacactgtcagtgagtgttctttaggtggtaggactatggttgatatttttcttcttcctatcttcctgcctttttcagattttcaatattaaacttgttattcttacattggaaaaaaataaattgttttt

SEQ ID NO: 5045 - DNA, 1593 bp, Homo sapiens
cgagttgacggctgcgactccattttgtaggccgcttatttgtgtgcatccacggcgattcttcccgcagagttgtgaagcgaaaggcttacaattaaaaggaagaaaaaaaaataaagataattcgggagtacaattgacaaagcgtgtgggtcgctcagcctccagcagtaactgctgatctccagttcttggagggttccggtgagaagaacgcccctactgcggtactgaggaagcggcaggaggagatgcggcccctggacatagacgaggtggaagcgcctgaggaagtggaggtgctggagcccgaggaggatttcgagcagttcctgctcccggtcatcaacgagatgcgcgaggacatcgcgtctcttatacgcgagcacgggcgggcgtacctgcggaccaggagcaagctgtgggagatggacaatatgcttatccagatcaaaacgcaggtggaggcctcggaggagagcgccctcaatcacgtgcagcacccgagtggcgaagccgacgagagagtgtcggagttgtgcgagaaggctgaggagaaagccaaggagattgcgaagatggcagagatgctggtcgagctcgtctggcgaatagagagaagcgagtcttcttgaaggaggagatcggtggttcacagctgaggactgtagtcaactggtaaggatgaactgacaccttgaggaaactgaaacagcttgtcattttctctgttttgtttttgtatgttttttaccccgatgtaacagtctcccttatggtcagtgattgatgacctcgatatggatttagattatcaaatgtgtttggttttggaaatataacttttgtcaaagaaatactctcagaagagaaatggggcttaattaagttgtttttgtggtcacgtttattcttgttacttcgctgtgtttttgaaatgttgggcatggcctcgtattttgctgttacctttgtgacctgattgttttttggaacacgtcaagacgtgggatcagaatcttccaactttagaggtgcaatggaagacactacgctacttggttgagcctggtgaagaatgtattaatgagactgctttgcataaaactgggaagaaagagaagacagttggagatggaagatggttttgtatatattttggaactttagttcctctgtgagacgaaagaggagagctatgttttgtggcacattgtctgatatatattgtgtaacctgtcaggtgagttgatttagacaacatagctgaccttttatgacaaggcagtttgaatagggactattgtaataccctcacacattataggggcatcagagaatggcatggaagagacagtctacagagagctttaagaggccggagaaaggaaaagacattatcagggcctggaaagtctcttccagttcatcagggtagtagacctgtcagattggaggtcaaagtcaaaagtataataagtgttaatttgccttgaaaaacaaagacctaaaaagccttttttaagaaataaattttttgttcacatgaccaaagcccctcctgtgtgtgttaataaaagaatcataaacaaa

SEQ ID NO: 5046 - DNA, 1648 bp, Homo sapiens
ctctggctccgggcccggctagcttcgctccagagattgcgcgggctcagggactaggcccgtggccacacccccccttgcgacaaagaccaatggaagcgggcgttgctggtcgctaagagaaccctcggcggcaagatggcagcggcgggcgagggcaccccgagctcccgcgggccgcgtcgggacccgcctaggcggccgccccggaacggtcacgggaagttgttatttaaagatggcagttattacgaaggggcgtttgtggacggagagatcacgggagaaggccgccggcactgggcctggtcaggagacaccttctctggacagtttgttctgggagagcctcaaggctacggcgtcatggagtacaaagccggcggatgttatgaaggggaggtctcccacggcatgcgggaaggacacgggtttctggtggaccgggatggacaagtgtaccagggctccttccatgacaacaagaggcacggccctgggcagatgctctttcagaacggtgacaagtacgacggcgactgggtccgggaccggcgtcagggacacggggtgctgcgctgcgccgacggctccacctacaagctctgatccacccatctatagtaggagaaactcaaggagacatcggctgctacccaggcaccatgagctcagggttggtgaggcccctccgggagacctgttctccctctcgacagcagcttcttctgacggaaaataagaacagcggatcccaaagcagagaaggctcctcttccacagggacaggagccacgcggctcaggccggtcccggaagccacagaggtcctgggccacgagcacccccaccagcctgtgacgcctcagccatctccgtcccccacactcctagtttacagcttactgctcgacctcccaggacccgagggcttgggcaggccccacacgtcctccagaacatcctcggtgggagacggagcagacagagtagaggccacacgtgtgtgtgcacatcagagtgtctcctacccatgttggcagcagcgcggccctccgggcatccctggctgtatcagctgcgccgtgagtgttggctgtctcacacgccagctttcccggagttgccgctgggtgccgagcacctgctcactgcacggagcaggtggctccttctgggcggctttgcctgccgcagtccccgagcctcctctcctcagctgggcgtgtgtgggaatgcccaaccgggggcctccacggggcctatagcctccacgtttgggcctactgcccttggacccaggggtcacagtccaggaagcctgggccagtgggggactcctggggtgcatgtaacactgagaatcatgtagataatttggggtgtttgagcacgcatggcctgtggggagtctggccggcttgcctcatgtggaccccccaccaccctggggcagaggagggggccggctgttggggccgtcatggaagcactagggttacactagggcaggccccatgtcccctctggaactcctcacagttcacaccttgaagcccaggcacttgcgatgggaccagcgaggtcaaatgcaggacccctggtcctcactgttaccatgaagtgatgcaaatggccggtcttcaga

SEQ ID NO: 5047 - DNA, 1498 bp, Homo sapiens
gacagcggcggaaacgcgcacaggcgcagctgcgtcctctggctccgggcccggctagcttcgctccagagattgcgcgggctcagggactaggcccgtggccacacccccccttgcgacaaagaccaatggaagcgggcgttgctggtcgctaagagaaccctcggcggcaagatggcagcggcgggcgagggcaccccgagctcccgcgggccgcgtcgggacccgcctaggcggccgccccggaacggttatggtgtctacgtatacccaaattccttctttcgatatgaaggagaatggaaagcagggaggaagcacggtcacgggaagttgttatttaaagatggcagttattacgaaggggcgtttgtggacggagagatcacgggagaaggccgccggcactgggcctggtcaggagacaccttctctggacagtttgttctgggagagcctcaaggctacggcgtcatggagtacaaagccggcggatgttatgaaggggaggtctcccacggcatgcgggaaggacacgggtttctggtggaccgggatggacaagtgtaccagggctccttccatgacaacaagaggcacggccctgggcagatgctctttcagaacggtgacaagtacgacggcgactgggtccgggaccggcgtcagggacacggggtgctgcgctgcgccgacggctccacctacaagggacagtggcacagcgacgtcttcagtggactgggcagcatggcccactgctcaggggtcacctattatgggttgtggatcaatggccacccagcagaacaagctacgaggatcgtgatcttgggtccggaggtgatggaagtggcccaagggtctcccttctcggtgaacgttcagctgctgcaggaccacggggaaattgccaagagcgagagcggccgggtcctgcagatctcagcgggcgtcagatacgtgcagctgtcagcctactctgaggtcaactttttcaaagtggacagagacaaccaagagacactcatccagaccccatttgggttcgaatgcatcccttatcctgtgtccagccccgcagctggggtgccggggcccagagctgccaagggaggggcagaagccgacgtgcccctgcccaggggagacctggagctgcatttgggtgccctccatggccaggaggacacccctggtggcctgcttgggagctcactcttctaggatcagacgagtctccttccagacaacagctgtgagaggaccagcaagcgcaggcgtcattcatcatataaaagagcatgcaggcatcccaggtggggcagcagggcccggcgccactccacgggaggccaaggcggccaagcctcaggccaacaggcccacggggggcccggcccgcgcccccttgtctgccttcacctcagttgatagaagcagttccacaccgcataggtggaatagctctcatatttctgcataaaaatacttactg

SEQ ID NO: 5048 - DNA, 1798 bp, Homo sapiens
gacagcggcggaaacgcgcacaggcgcagctgcgtcctctggctccgggcccggctagcttcgctccagagattgcgcgggctcagggactaggcccgtggccacacccccccttgcgacaaagaccaatggaagcgggcgttgctggtcgctaagagaaccctcggcggcaagatggcagcggcgggcgagggcaccccgagctcccgcgggccgcgtcgggacccgcctaggcggccgccccggaacggttatggtgtctacgtatacccaaattccttctttcgatatgaaggagaatggaaagcagggaggaagcacggtcacgggaagttgttatttaaagatggcagttattacgaaggggcgtttgtggacggagagatcacgggagaaggccgccggcactgggcctggtcaggagacaccttctctggacagtttgttctgggagagcctcaaggctacggcgtcatggagtacaaagccggcggatgttatgaaggggaggtctcccacggcatgcgggaaggacacgggtttctggtggaccgggatggacaagtgtaccagggctccttccatgacaacaagaggcacggccctgggcagatgctctttcagaacggtgacaagtacgacggcgactgggtccgggaccggcgtcagggacacggggtgctgcgctgcgccgacggctccacctacaagggacagtggcacagcgacgtcttcagtggactgggcagcatggcccactgctcaggggtcacctattatgggttgtggatcaatggccacccagcagaacaagctacgaggatcgtgatcttgggtccggaggtgatggaagtggcccaagggtctcccttctcggtgaacgttcagctgctgcaggaccacggggaaattgccaagagcgagagcggccgggtcctgcagatctcagcgggcgtcagatacgtgcagctgtcagcctactctgaggtcaactttttcaaagtggacagagacaaccaagagacactcatccagaccccatttgggttcgaatgcatcccttatcctgtgtccagccccgcagctggggtgccggggcccagagctgccaagggaggggcagaagccgacgtgcccctgcccaggggagacctggagctgcatttgggtgccctccatggccaggaggacacccctggtggcctgcttgccaggggacatgcgccccattgtcccggggcctgtcagcgagtggagcagggctgtgccgagttcacagatgtcctcctggggccgcccccgcctgggtaccaccccttcctgttcctggacagcctccacaagaaggcaggcggcagatccagaggcggcctgcaccccagggggacaccacccacggcacaggagcctcctggaggcagcaggcctgaggggagagccacggaggagcaggctgcggcagcacacctaggggagtacgtgctcatgatccgcgacgtgaccaccccgccgttcctggggcgcaggctgcccccggccttcaaacacctgcgggtcgtagcgaagagggctggccagccaccccatgtcctggaagaaggccctgaagcctcaagcagctggcaggccgcccacagctgcaccccagagccgccagcgcctcggtgaggccccgtgtccacaggaggccacctcggtgtgaatggaaggaaacgctgcctctgcttgcgtgactctgctccccgattctccagagccccgtggttgctggcttgaataaaatgctcagtggcggcta

SEQ ID NO: 5049 - DNA, 582 bp, Homo sapiens
actgccaccacccggctccccctgttgagagtggactccgtgcgtgtgtcccccaggaacggtgacaagtacgacggcgactgggtccgggaccggcgtcagggacacggggtgctgcgctgcgccgacggctccacctacaagggacagtggcacagcgacgtcttcagtggactgggcagcatggcccactgctcaggggtcacctattatgggttgtggatcaatggccacccagcagaacaagctacgaggatcgtgatcttgggtccggaggtgatggaagtggcccaagggtctcccttctcggtgaacgttcagctgctgcaggaccacggggaaattgccaagaatggagtttcactcttgctgtccaggctggagtgcagtggtgcaatgtcggctctccgcaacctccgcctcccgcgttcaagtgattctgccttggcctcctgagtagctgggattacaggcatgtgccatcatgccccactaattttgtattttgagtagagatggggtttcgccatgttggtcaggctggtctcgaactcccgacctcaggtgatcagcccgccccag

SEQ ID NO: 5050 - DNA, 626 bp, Homo sapiens
gtcacgggaagttgttatttaaagatggcagttattacgaaggggcgtttgtggacggagagatcacgggagaaggccgccggcactgggcctggtcaggagacaccttctctggacagtttgttctgggagagcctcaaggctacggcgtcatggagtacaaagccggcggatgttatgaaggggaggtctcccacggcatgcgggaaggacacgggtttctggtggaccgggatggacaagtgtaccagggctccttccatgacaacaagaggcacggccctgggcagatgctctttcagaacggtgacaagtacgacggcgactgggtccgggaccggcgtcagggacacggggtgctgcgctgcgccgacggctccacctacaagctctgatccacccatctatagtaggagaaactcaaggagacatcggctgctacccaggcaccatgagctcagggttggtgaggcccctccgggagacctgttctccctctcgacagcaggtgtgttttctgcaaaccgtgtctcctgccttgcagccagtattccttaatgcaaagctctatgaagaacctttttttaaaaatgcattctagaaaaaaatgcattcctgaaaataaa

SEQ ID NO: 5051 - DNA, 741 bp, Homo sapiens
attcgcttccgggtgagaggtgcccggtcgccccagcaaccaagtcgcacctggagctgtcctagcgcctagttctctcccggccgcagagctggccgcccagggggagtcgcagagtttggaagatctctctaacacctctcggccaacttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaaatggggcaaagtatactggaaatttcaatgaaaatagggtggaaggtgaaggggaatatactgatatccaaggactagaatggagtggtaactttcattttacagctgctccagacctgaaattaaagcttcacatgtagatgtgatgttaaattaaagttgaaatgtagtaattgaagcttttagttgtaaggaaagcaacttaatctgttatttgaaatgacttcatacactacccctataagtttgccaataaaaccatcacctgcttacacctttttgaactttatattcattgtcttacaattagtttaaaataaatgacatgattcaa

SEQ ID NO: 5052 - DNA, 648 bp, Homo sapiens
cctggagctgtcctagcgcctagttctctcccggccgcagagctggccgcccagggggagtcgcagagtttggaagatctctctaacacctctcggccaacttcagaagtgtataagatcagctttatctttccaaatggagacaagtatgtttttctcctctgtttagatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaaatggggcaaagtatactggaaatttcaatgaaaatagggtggaaggtgaaggggaatatactgatatccaaggactagaatggagtggtaactttcattttacagctgctccagacctgaaattaaagcttcacatgtagatgtgatgttaaattaaagttgaaatgtagtaattgaagcttttagttgtaaggaaagcaacttaatctgttatttgaaatgacttcatacactacccctataagtttgccaataaaaccatcacctgctta

SEQ ID NO: 5053 - DNA, 750 bp, Homo sapiens
gccccagcaaccaagtcgcacctggagctgtcctagcgcctagttctctcccggccgcagagctggccgcccagggggagtcgcagagtttggaagatctctctaacacctctcggccaagtgagtgtccctcctcctaacgacccgggcagagaagagctcctttaagtcgaactagcgtggagtcagaacctgcttggctcccggtaactcctgtggggcttcagaagtgtataagatcagctttatctttccaaatggagacaagtatgatggtgactgtacaagaacatcttctggaatctacgagagaaatggaataggtattcataccactcctaatgggattgtctacacaggaagctggaaagatgacaagatgaatggttttggaagacttgagcatttttcaggagcagtatatgaaggacaatttaaggataatatgtttcatggactggggacttacacattcccaaatggggcaaagtatactggaaatttcaatgaaaatagggtggaaggtgaaggggaatatactgatatccaaggactagaatggagtggtaactttcattttacagctgctccagacctgaaattaaagcttcacatgtagatgtgatgttaaattaaagttgaaatgtagtaattgaagcttttagttgtaaggaaagcaacttaatctgttatttgaaatgacttcatacactacccctataagtttgccaataaaaccatcacctgctt

SEQ ID NO: 5054 - DNA, 1427 bp, Homo sapiens
agtccagcactaaaggatccccactaagggctgttcacctgccccagggactcagaacacacatgactctccccacttgagctcaggatcccggcattacacggggcgcgctgagccccagatgtccctaacccctttccagcaccctccagccttgcagaagcagccaccatgccagtctctaagtgcccaaaaaagtcggagtccctgtggaaggggtgggaccggaaggcccagaggaacggcctgcggagccaggtatacgctgtgaatggcgactactatgtgggcgagtggaaggacaacgtgaaacacgggaaaggaacacaggtctggaagaagaaaggagccatctatgagggggactggaagtttgggaagcgagacggctacggcaccctcagccttcctgaccaacagacaggaaagtgcaggagagtctactcaggctggtggaaaggtgataagaaatcgggttatgggatccagtttttcggacccaaggagtattatgagggtgactggtgtggcagccagcgcagcgggtggggccgcatgtattacagcaacggcgacatctacgagggacagtgggagaacgacaagcccaacggggagggcatgctgcgcctgaagaacgggaaccgctacgagggctgctgggagagaggcatgaagaacggggcggggcgtttcttccatctggaccacggccagctgtttgaaggcttctgggtggacaatatggccaaatgcgggacgatgatcgactttggccgtgacgaggcccctgagcccactcagttccccattcctgaggtcaaaatcctagaccctgatggtgtgctggcggaggccttggccatgttcaggaagacagaggaaggagattgatgccagagaacacaaacgcttcaggagaaattcaagcctgtgtcacccgatcgctcagaccagtgcggctctggctggaggagtcagcagcagctccaggcatgaccccggcaccctcatagggcccctcactacccccagcactgggtcatttcttgccaataggaaggctggtgcttctctcccaggctgtcctcgggaccctcttcattctctgatctcatcctggaatgcatgagaataaagaataaccaagtggtataagcctgggcctatgggataaggatggggcactcgagggggctcagcagggctttcaggtttagaagagggaagacctgccttggctgggctgcctgggtttagcttgggggagtaagggcaggtcttaggccgggtgcagtggctcattcctgtaatcccagaacttgggaggccaaggtaagaggactgcctgaggccaggagttcgagaccagcttaggcaacatagcaagaccctgactctacaaaaaaaaattttaaaatataaaa

SEQ ID NO: 5055 - DNA, 2315 bp, Homo sapiens
cggcgtcaagtggggcaatcgctggtggaggtggcggagagcaaggtggcagccgggagcccatcagaggaaaagtccgaggcgctggaaccctgcgtccaggcgtgacggtcatcccgaaaggccggccccagtttcatccttttatcctgtaatctgtcaccatgaccctgacaaaaggttccttcacctactccagtggggaggaatatcgtggcgagtggaaggagggccgcaggcatggttttggtcaactgatgtttgcagatggtggcacctacctgggtcattttgagaatgggctctttaatggctttggggtattgaccttctcagatggttcaaggtatgagggggagtttgcccagggcaagtttaatggcgtcggagtcttcattcgatatgacaacatgacctttgagggggaatttaaaaatggcagagtagatggttttggcctgctgactttccctgatggttctcatggaatcccccgcaatgaaggtctctttgagaacaacaagctgctgcgacgtgagaagtgttctgccattgttcagcgggcccagagcgcctccaagtcagccagaaatctcactgcctgacagcgcagtgggcaccagctgataagtattgggtaaagccagtgcccctgttgttgattcgaggtgaacaaatgaatcagagctgagatgagttgacaatgacagtggagcagaggccttgtatgtgccctgtcacctgccattccagaactggaccacagaaaagtgctgaggatgctggccagcagaccctgcagcagtcattggtggttctgtctttccctaacccttatgtgctggaggacagaggagccacctcttctcactggttgatactctgttcctaagacctcaggttacccagtgtagcctgctgtgacccttctgcttcattttctgccaagtgatacagaaccttcgttctgctgctttggggacaggtgatcctagccccagcttagggccagtgctctgtgccactctggagaaatagggaaaagataggggtggctcagtacagcagccctgtgaaagtcaaggccagagcttttcttttttaatttttttattattattattattattttattttttatttttgagatggagttttactctcgcccaggctagagtgcagtggcatgatctcagctcactgcaacttctgcctcccaggttcaagcaattcccctgcctcagcttcctgagtagctgggactacaggagcgcgccaccacacccagctaatttttgtatttttttttagtagagacggggtttcaccatattggccaggctggtctcaaactcctgacctcgtgatccacccgccttggtctcccaaagtgctgggattacaggcgtgagccaccacgctcagcctttaattttattattataaaaaattgagccagggtcttgctatgtggctcaggctcatctcaaaatcctgggctcaagtgatcctcctgcctgggcctgccaaagtgctaggattgcaggtgtgagccactgtgcctggctggcagagcttttccatatgttactcctcatgctggttggaatcatggctgcaggcttccacttggtctgatcagactggtattcattcctgcctatgtccccgtgaaggattcggtaagagtgctatttcctcctccctttagaagacaggctgtcttctttcatcaacttagagcagataatccccatgtgtgcctctctccttccttagatggggaacaggatccctttttgggacaatcaagaaaaaaactcatgtaaacagtaatcttattacttgtatttgtgactaactccagggaaaagggtagaatatttaggccacttcaggcactaccatggagtgaactgaattcatacggatggcttgggctgacacagtttcttcccagtggaccaataaatcagactcacccgaacccctggggttttggtagaattggacctactctaggactgtggggaactaaaggagcatttggctcactgtagctcttctatcatgagccttgaccgtcaggccgcaatcagaccttactgatgggatctctgcagtttattacgtaggcctcccgttaccctggtacccaaatacgtcccccacctctagctccctagcctcacattgaatgtctcttcaacagcagattgtggtggaagttatagccgtgtgcctctatttattctctgaattgtactgtagaaaaaggtgtttataaagaataaagaaatcaccagaactgccta

SEQ ID NO: 5056 - DNA, 2323 bp, Homo sapiens
atggcgtggagccgggctgggccaatgcggagtggcgttgctcccggttgcctaggtaacagccaatgggcagcgggaattgtacccagtgcggtcgcccaggatggcggcgtcaagtggggcaatcgctggtggaggtggcggagagcaaggtggcagccgggagcccatcagaggaaaagtccgaggcgctggaaccctgcgtccaggcgtgacggtcatcccgaaaggccggccccaggccgcaggcatggttttggtcaactgatgtttgcagatggtggcacctacctgggtcattttgagaatgggctctttaatggctttggggtattgaccttctcagatggttcaaggtatgagggggagtttgcccagggcaagtttaatggcgtcggagtcttcattcgatatgacaacatgacctttgagggggaatttaaaaatggcagagtagatggttttggcctgctgactttccctgatggttctcatggaatcccccgcaatgaaggtctctttgagaacaacaagctgctgcgacgtgagaagtgttctgccattgttcagcgggcccagagcgcctccaagtcagccagaaatctcactgcctgacagcgcagtgggcaccagctgataagtattgggtaaagccagtgcccctgttgttgattcgaggtgaacaaatgaatcagagctgagatgagttgacaatgacagtggagcagaggccttgtatgtgccctgtcacctgccattccagaactggaccacagaaaagtgctgaggatgctggccagcagaccctgcagcagtcattggtggttctgtctttccctaacccttatgtgctggaggacagaggagccacctcttctcactggttgatactctgttcctaagacctcaggttacccagtgtagcctgctgtgacccttctgcttcattttctgccaagtgatacagaaccttcgttctgctgctttggggacaggtgatcctagccccagcttagggccagtgctctgtgccactctggagaaatagggaaaagataggggtggctcagtacagcagccctgtgaaagtcaaggccagagcttttcttttttaatttttttattattattattattattttattttttatttttgagatggagttttactctcgcccaggctagagtgcagtggcatgatctcagctcactgcaacttctgcctcccaggttcaagcaattcccctgcctcagcttcctgagtagctgggactacaggagcgcgccaccacacccagctaatttttgtatttttttttagtagagacggggtttcaccatattggccaggctggtctcaaactcctgacctcgtgatccacccgccttggtctcccaaagtgctgggattacaggcgtgagccaccacgctcagcctttaattttattattataaaaaattgagccagggtcttgctatgtggctcaggctcatctcaaaatcctgggctcaagtgatcctcctgcctgggcctgccaaagtgctaggattgcaggtgtgagccactgtgcctggctggcagagcttttccatatgttactcctcatgctggttggaatcatggctgcaggcttccacttggtctgatcagactggtattcattcctgcctatgtccccgtgaaggattcggtaagagtgctatttcctcctccctttagaagacaggctgtcttctttcatcaacttagagcagataatccccatgtgtgcctctctccttccttagatggggaacaggatccctttttgggacaatcaagaaaaaaactcatgtaaacagtaatcttattacttgtatttgtgactaactccagggaaaagggtagaatatttaggccacttcaggcactaccatggagtgaactgaattcatacggatggcttgggctgacacagtttcttcccagtggaccaataaatcagactcacccgaacccctggggttttggtagaattggacctactctaggactgtggggaactaaaggagcatttggctcactgtagctcttctatcatgagccttgaccgtcaggccgcaatcagaccttactgatgggatctctgcagtttattacgtaggcctcccgttaccctggtacccaaatacgtcccccacctctagctccctagcctcacattgaatgtctcttcaacagcagattgtggtggaagttatagccgtgtgcctctatttattctctgaattgtactgtagaaaaaggtgtttataaagaataaagaaatcaccagaactgcc

SEQ ID NO: 5057 - DNA, 2270 bp, Homo sapiens
ctcttgggctcaagcctcccgcactcctgagctcaagccgcggcctcccgaagtgctgggattacagatgtgagccactgcgcctggccagtttcatccttttatcctgtaatctgtcaccatgaccctgacaaaaggttccttcacctactccagtggggaggaatatcgtggcgagtggaaggagggccgcaggcatggttttggtcaactgatgtttgcagatggtggcacctacctgggtcattttgagaatgggctctttaatggctttggggtattgaccttctcagatggttcaaggtatgagggggagtttgcccagggcaagtttaatggcgtcggagtcttcattcgatatgacaacatgacctttgagggggaatttaaaaatggcagagtagatggttttggcctgctgactttccctgatggttctcatggaatcccccgcaatgaaggtctctttgagaacaacaagctgctgcgacgtgagaagtgttctgccattgttcagcgggcccagagcgcctccaagtcagccagaaatctcactgcctgacagcgcagtgggcaccagctgataagtattgggtaaagccagtgcccctgttgttgattcgaggtgaacaaatgaatcagagctgagatgagttgacaatgacagtggagcagaggccttgtatgtgccctgtcacctgccattccagaactggaccacagaaaagtgctgaggatgctggccagcagaccctgcagcagtcattggtggttctgtctttccctaacccttatgtgctggaggacagaggagccacctcttctcactggttgatactctgttcctaagacctcaggttacccagtgtagcctgctgtgacccttctgcttcattttctgccaagtgatacagaaccttcgttctgctgctttggggacaggtgatcctagccccagcttagggccagtgctctgtgccactctggagaaatagggaaaagataggggtggctcagtacagcagccctgtgaaagtcaaggccagagcttttcttttttaatttttttattattattattattattttattttttatttttgagatggagttttactctcgcccaggctagagtgcagtggcatgatctcagctcactgcaacttctgcctcccaggttcaagcaattcccctgcctcagcttcctgagtagctgggactacaggagcgcgccaccacacccagctaatttttgtatttttttttagtagagacggggtttcaccatattggccaggctggtctcaaactcctgacctcgtgatccacccgccttggtctcccaaagtgctgggattacaggcgtgagccaccacgctcagcctttaattttattattataaaaaattgagccagggtcttgctatgtggctcaggctcatctcaaaatcctgggctcaagtgatcctcctgcctgggcctgccaaagtgctaggattgcaggtgtgagccactgtgcctggctggcagagcttttccatatgttactcctcatgctggttggaatcatggctgcaggcttccacttggtctgatcagactggtattcattcctgcctatgtccccgtgaaggattcggtaagagtgctatttcctcctccctttagaagacaggctgtcttctttcatcaacttagagcagataatccccatgtgtgcctctctccttccttagatggggaacaggatccctttttgggacaatcaagaaaaaaactcatgtaaacagtaatcttattacttgtatttgtgactaactccagggaaaagggtagaatatttaggccacttcaggcactaccatggagtgaactgaattcatacggatggcttgggctgacacagtttcttcccagtggaccaataaatcagactcacccgaacccctggggttttggtagaattggacctactctaggactgtggggaactaaaggagcatttggctcactgtagctcttctatcatgagccttgaccgtcaggccgcaatcagaccttactgatgggatctctgcagtttattacgtaggcctcccgttaccctggtacccaaatacgtcccccacctctagctccctagcctcacattgaatgtctcttcaacagcagattgtggtggaagttatagccgtgtgcctctatttattctctgaattgtactgtagaaaaaggtgtttataaagaataaagaaatcaccagaactgcc

SEQ ID NO: 5058 - DNA, 705 bp, Homo sapiens
atagtgatgccgtatccactgagactccggatcctaacagctggaagctaaaaacaggcgccatggagtacacagggagcaaatatatcggggaatatgtagatgggaggatggagggcaaagccaagtacatcctccctaccgaaacaatatatgttggggaaatgaaggatggcatgtttcacggcgagggaaccctgtacttccccagcggaagccaatacgacgccatttgggaaaacggattggccataaagggcacatatacgttctcagatgggctgcactatgatgagaaaaactggcattactgcgacggctatgatcggaggttttacacagagatcctcaatggcttgaagcctgcaggtatggctcaactcaccaatatggacccacctagaaaaatccccaagggctattacgattgtggagacggcttctataacccagtcacgagggtagtcaaggactataggaaccgctttctaagaaacgcagatgatgacgagcatgagtggatcacccgtacctgtcgaaagggctaggatgagatcgtgggtcacaggcccgagccgtgaactctgtggctgcctccaccagaggtttccatctgccctactagcattggctgccctgggggacgggctgtagttctagaacctgattttaactcaggaataaagactttctgcggtcagtggc

SEQ ID NO: 5059 - DNA, 366 bp, Homo sapiens
gtgagaggtctgaacagtgatgtccagttcaaggatggagggcaaagccaagtacatcctccctaccgaaacaatatatgttggggaaatgaaggatggcatgtttcacggcgagggaaccctgtacttccccagcggaagccaatacgacgccatttgggaaaacggattggccataaagggcacatatacgttctcagatgggctgcactatgatgagaaaaactggcattactgcgacggctatgatcggaggttttacacagagatcctcaatggcttgaagcctgcaggtatggctcaactcaccaatatggacccacctagaaaaatccccaagggctattacgattgtggagacggctt

SEQ ID NO: 5060 - DNA, 1543 bp, Homo sapiens
ctccggatcctaacagctggaagctaaaaacaggcgccatggagtacacagggagcaaatatatcggggaatatgtagatgggaggatggagggcaaagccaagtacatcctccctaccgaaacaatatatgttggggaaatgaaggatggcatgtttcacggcgagggaaccctgtacttccccagcggaagccaatacgacgccatttgggaaaacggattggccataaagggcacatatacgttctcagatgggctgcactatgatgagaaaaactggcattactgcgacggctatgatcggaggttttacacagagatcctcaatggcttgaagcctgcaggtatggctcaactcaccaatatggacccacctagaaaaatccccaagggctattacgattgtggagacggcttctataacccagtcacgagggtagtcaaggactataggaaccgctttctaagaaacgcaggtaggtttcttccgacactgcagcacgttttctcttcacccacatatgagtatgtgcatctgtatgtacaaatgtatgcacacacttgatgagaaagaagcttttgctgatagaagatgaaagttgattacctggatgttttattttttggacttctcgtggctggcaaatctgtacatagtcctagagtgaggtaaaagcacattcgtggtctagcagtgacggcacataaatgtcgcactgaaaggattaaggtacttatttttgtatgcattccttcgattttaatgggcacctactatatgctagacactgtgcttggtgttgggggaaaagcagagcaaagctggacacagccccccttccttgtggagcttgcattctaaaagtggcagagaagtactataaacagttaattgtatcatggaacaaacacaatgaagggaaaaacatggtcctgtgggaagggaaagtaggggccccagagaggtgggacggatgctgtgggagcacaaataaggggtatcaaatcccgaagcggttagtcagagaaggtttcaaggaggaaatgacttctaagctgagacctgaagaataactgggagttgaccacaaggcctggggagagggtttcccagcgagaggaaatggcacaggcaacggcctagaggggagtgatcccttgaggtgcaagaaggttggttcatcctttagccaggggagtaggtaccttggaggatccagaacctcagtttggtgagtcaacacaaggctgatcagactgagaagaacccatttacagtgaccaaactcacaggagatcaatacacaaataatagaacattttcctttaatgcagtgattcctaaacttatccttttctgaagtcacactcccactaggaatatcaaaagatacggaccctcttgccagaaaaatgtccaatgcatgcacacacacacacacgtgcacccacacgcgcacatgcatacacacacacattttgcagatagtcttaaggggtgaatggtccctctaaagacctaggtcaagaaaccttgctcta

SEQ ID NO: 5061 - DNA, 1566 bp, Homo sapiens
cggggcggggccgcgtgacgtgccgggaagccggagtctagagctccgggcgcggggaggcgcggccatggcagctccggagccgctgtccccggcgggcggtgcgggcgaggaggcgccggaggaggacgaggacgaagcggaggccgaggaccctgagcggccgaatgcgggagcgggcggtggacgcagtggcggcggcggcagtagcgtcagcggaggaggcggcggcggcggggccggggcggggggctgcggcgggcccgggggcgcgctcaccaggcgcgcggtcacactgcgggtgctcctcaaagacgcgctgctggagcctggcgccggggtgctgtccatctactacctggggaagaagttcctgggcgacctgcagccagacggaaggatcatgtggcaggagaccgggcagaccttcaactcacccagcgcctgggccacccactgcaagaagctggtgaaccctgccaagaagtcgggctgtggctgggcctctgtcaagtacaaaggccagaaactggacaagtacaaggccacctggctccggctgcaccagctgcacacgcctgccacggctgctgatgagagcccagccagtgaaggggaggaggaggagttgctgatggaagaggaggaggaggacgttctggcaggggtctcagcagaggacaagagtcggagaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctggacttccacagtcacctgacacggagtgaggtcgtgggttacctggggggccgctgggacgtcaacagccagatgctgacggtgctcagagccttcccttgtcggagccggctcggggacgcagagactgcagctgccatcgaagaggagatctaccagagcctgttcctgcggggcctgtccctggtgggctggtaccacagccacccacacagcccggcgctgccatctctgcaggacatcgacgcacagatggactaccagctgcggctgcagggctccagcaatggcttccagccctgcctcgccctgctctgctccccttactattctggcaacccaggccccgagtccaagatctcacctttctgggtgatgcctcctcccgagatgctgctggtggagttctacaagggttcccctgacctcgtgaggctccaggaaccctggagccaggagcacacctacctcgacaagcttaagatctccttggccagcaggacgcccaaggaccagagcctgtgtcacgtcctggaacaggtgtgcggcgtcctcaagcaggggagctgagccttccagggcagggtgggctccagttgtcttgagggtccggatgggctcaggtaataaagaaacggaagcagcagccagcc

SEQ ID NO: 5062 - DNA, 1506 bp, Homo sapiens
cggggcggggccgcgtgacgtgccgggaagccggagtctagagctccgggcgcggggaggcgcggccatggcagctccggagccgctgtccccggcgggcggtgcgggcgaggaggcgccggaggaggacgaggacgaagcggaggccgaggaccctgagcggccgaatgcgggagcgggcggtggacgcagtggcggcggcggcagtagcgtcagcggaggaggcggcggcggcggggccggggcggggggctgcggcgggcccgggggcgcgctcaccaggcgcgcggtcacactgcgggtgctcctcaaagacgcgctgctggagcctggcgccggggtgctgtccatctactacctggggaagaagttcctgggcgacctgcagccagacggaaggatcatgtggcaggagaccgggcagaccttcaactcacccagcgcctgggccacccactgcaagaagctggtgaaccctgccaagaagtcgggctgtggctgggcctctgtcaagtacaaaggccagaaactggacaagtacaaggccacctggctccggctgcaccagctgcacacgcctgccacggctgctgatgagagcccagccagtgaaggggaggaggaggagttgctgatggaagaggaggaggaggacgttctggcaggggtctcagcagaggacaagagtcggagaccactggggaagagcccttcagagcctgcccacccggaggccacaaccccagggaagcgggtggacagcaagatccgggttccggtccgctactgcatgctgggcagccgcgacttggccaggaacccccacaccctggtggaagtaacatcctttgcagccatcaacaagttccagccgttcaacgtggctgtttctagcaacgtgctgttcctgctgatctaccagagcctgttcctgcggggcctgtccctggtgggctggtaccacagccacccacacagcccggcgctgccatctctgcaggacatcgacgcacagatggactaccagctgcggctgcagggctccagcaatggcttccagccctgcctcgccctgctctgctccccttactattctggcaacccaggccccgagtccaagatctcacctttctgggtgatgcctcctcccgagcaaaggcccagtgactatggcatccccatggatgtggagatggcctacgtccaggacagcttcctgaccaatgacatccttcacgagatgatgctgctggtggagttctacaagggttcccctgacctcgtgaggctccaggaaccctggagccaggagcacacctacctcgacaagcttaagatctccttggccagcaggacgcccaaggaccagagcctgtgtcacgtcctggaacaggtgtgcggcgtcctcaagcaggggagctgagccttccagggcagggtgggctccagttgtcttgagggtccggatgggctcaggtaataaagaaacggaagcagcagccagcc

SEQ ID NO: 5063 - DNA, 2069 bp, Homo sapiens
cgccagcatgctgccggagcagctctacttcctgcagagccccccggaggaggagcccgaataccaccccgacgcctcagcccaagaattaaatgtgagggagtctgacgtaagagtttgtgatgagtcatcatgtaaatatggaggagtctgtaaagaagatggagatggtttgaaatgtgcatgccaatttcagtgccatacaaattatattcctgtctgtggatcaaatggggacacttatcaaaatgaatgctttctcagaagggctgcttgtaagcaccagaaagagataacagtaatagcaagaggaccatgctactctgataatggatctggatctggagaaggagaagaggaagggtcaggggcagaagttcacagaaaacactccaagtgtggaccctgcaaatataaagctgagtgtgatgaagatgcagaaaatgttgggtgtgtatgtaatatagattgcagtggatacagttttaatcctgtgtgtgcttctgatgggagttcctataacaatccctgttttgttcgagaagcatcttgtataaagcaagaacaaattgatataaggcatcttggtcattgcacagatacagatgacactagtttgttgggaaagaaagatgatggactacaatatcgaccagatgtgaaagatgctagtgatcaaagagaagatgtttatattggaaaccacatgccttgccctgaaaacctcaatggttactgcatccatggaaaatgtgaattcatctattctactcagaaggcttcttgtagatgtgaatctggctacactggacagcactgtgaaaagacagactttagtattctctatgtagtgccaagtaggcaaaagctcactcatgttcttattgcagcaattattggagctgtacagattgccatcatagtagcaattgtaatgtgcataacaagaaaatgccccaaaaacaatagaggacgtcgacagaagcaaaacctaggtcattttacttcagatacgtcatccagaatggtttaaactgatgacttttatatgtacactgaccatgtgatgtacatttattatgtctttttttaaagaatggaaatatttatttcagaggccttatttttggacatttttagtgtagtactgttggctcgtatttagaatattcagctacgacagttttggactgtttagtagtctttgttttatgtttttaaatacagaaattgctttcacaaatttgtaccacatggtaattctaagacttgttctttacccatggaatgtaatatttttgcaaagatggactacttcacaaatggttataaagtcatatccacttcttccacaatgaccacagcaaatgaccaagcatgaactaaaggtaaagatgtttacagattacttttcttacaaaaaaaatctagaagacactgtgtttaaatagatatttaaatgtttttgagatttagtaactgattttttagacactgcctatcgcatgaactgtaaagctgtgtgtattaggtgtaaaatatttataagatatatggactggggaatttgattattcctccctttgaaaaaatagtcctaataatttgaacaaatatgttagtaatgatggaacagatcaatgaaaagtagatatagatattgtgaaaataggctgtttaacaaacagattggaataaagcctattctaccagttaaactactttaatacacattcatttttaaagaaaatgtttgttttaacataaataaacaaatcgtatcagtgtttgtgaataaaatacaaaaatgattgttaatgattggtgctcttaaagtgagcttaaaatttatccaagacgtatatccaaatttgtcctgtagtaatagattaatattcatagattgttggtgtttaaagatctgaagtgtgagtagaatgtattcagctgtttaacatgtagtttagatattcaaaagtatgcatgtagaatttaaagaatatgttaaaaattattaattttaatattttgtttggaaaagcatgttataatataatgttttcactata

SEQ ID NO: 5064 - DNA, 706 bp, Homo sapiens
ggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccgagccatggggagccagggctctggcggggtgcccttggtgcaggctccctacacagtcctgctgctgccgctggggacaagccgccaagaccca

SEQ ID NO: 5065 - DNA, 1637 bp, Homo sapiens
gaaggacgggggaggaccgctgcttccggcgccgtaactgctgccatcttctccgcgctatggctgcgttcggccgtcaggtccttgattggcaccgcctgatccccctcacctgggcctgtatggctaggcagactcctcatcttggagaacagagaaggacgacagcttctttgttgcgcaaactgactacagcctccaatggaggggtcattgaggagttatcttgtgttagatccaataactatgtgcaggaaccagagtgcaggaggaatcttgttcagtgcctccttgagaagcaggggactcctgtggtacaagggtccttggagctagagagggtcatgagttccctcctggacatgggtttcagcaatgcccatattaatgaattgctcagtgtacggcgaggtgccagtcttcaacagttgctggacatcatttcagaatttattctcttgggtctgaatccagagcctgtgtgtgtggtcttgaagaaaagtccccagttattgaaactgcctattatgcaaatgaggaagcgctccagttacctgcaaaagcttgggcttggagaagggaaattaaagagggtgctttactgttgccctgaaattttcaccatgcgccagcaggacattaacgacactgtcaggcttctcaaggagaagtgccttttcacggtacagcaagtcaccaagattttgcacagttgcccctctgttcttcgagaggacctgggtcaactggaatacaagtttcagtatgcatacttcaggatgggaattaagcatccagacattgtaaagagtgagtacttgcagtattcactaaccaagattaagcagagacacatttacctggagcgcctgggacggtaccaaacccctgataagaaggggcagacacagatccctaacccattgctcaaggacattctcagagtttcagaagctgagtttttggccaggacagcctgtacttctgttgaggagtttcaagtttttaagaagctcctggctcgggaggaggaggagtctgagagcagcacatctgatgacaaaagggcaagtctggatgaggatgaggatgacgatgatgaggaggacaatgatgaggatgacaatgatgaggatgacgatgatgaggacgacgacgaggcggaggacaatgatgaggatgaggacgacgacgaggaggaatagctgtgatggaaggactagagcgaaagggcccagagatatcaaggaagcttttcattctcttaaagcttttgggtcctttacttgaatcttctcaagttattttttattctaaaactggtctcttgatgaaaaaaattataagtcacctgagaggcagacagatcaaaccaaacaggaaacaggaaatgcatgtttgatctgttgtcacgtgtctgtggggagggccctgtcccatcctgaataagatacttatgttgagctattcacatcaaggggactcaatatatcaacaattggttttatttttttctcttttgaatatgttggtgataattccgtgacagttggaagatggggttcattcttccggttcaggaatcactatgtatttccttcttgtgataaaaataaaattacgagaaggcaatgtga

SEQ ID NO: 5066 - DNA, 1555 bp, Homo sapiens
cccaaacccaactaattctactaccaaataacctcaactaaaacatttacccaaataaagtataggcgatagaaatgatatctcggcacaatagacataataccgcgatggaaagatgaaaaaacataaccaagcataaagtagcaaggacaaacccctataccttctgcataatgaattaactagaaataactttacaaagagaaccaaagccaagacccccgaaaccagacgagctacctaagaacagctgaaagagcacacccatctatgtagcaaaatagtgggaagattcataggtagaggtgacaagcctaccgagcctggtgatagctggttgtccaagatagaatcttagttcaactttaaatttatctacagaaccagctaatgcctttgtaaatttaactgttagtctaaagagggacagctctttagacactaggaaaaaaccttgtagagagagtaaaaaatataacttccaaagttggcctagaagaagcgatcaattaagaaggcgttcaagctcaacacccaaccacccaaaaaattccaaacacataactgaactcctcacatcacattggaccaatctatcatttcatagaagaaataatgttagtataagtgacatgcaaacattctcctccgcataagcctacatcagaccaaaatacttcactgacaattaacagcccaatatctataaataatcaatgaaaccattattacccacactgttaacccaacacaggcatgcttacaaggaaaggttaaaaaaagtaaaaggaactcagcgaatcttacccctcctgtttatcaaaaacatcacctctagcattaccagtactagaggcaccacctgcccagtgacatatgtttaatggctgcggtaccctaaccgtgtaaaggtagcataatcacttgttccttaaatagggacttgtctgaatggctccacgagggttcagctgtctcttactttcaaccagtgaaattgacctgcccgtgaagaggcggacataatacaacaagacgagaagaccctaaggagctttaatttatgaatgcaaacaagaccaaataggcccgcaggccctaaactaccagacctgcgttaaacatttcggttggggcgacctcggagtataacctaacctccgagcaacatatgctgagactataccagtcaaggcgaatatccacatacaattgacccaataatttgaccaacggaacaagttaccctagtgataacagtacaatcctattctagggtccacatcgacagtagcattaacgacctcgatgttggatcaggacatcccaatggtgcagccgctattaaaggttcgtttgttcaacgattagagtcctatgtgatctgagttcagaccggagtaatccaggttggtttctatctattctacatttcttccagtacgaaaggataagagaaatggggcccacttcataaagtgcccctgccccatagatgatattatctcagcattttactgtacccacacccacccaagaacagggtttgttaaga

SEQ ID NO: 5067 - DNA, 1121 bp, Homo sapiens
acagctctttagaccctaggaaacaaccttcctacagagagtaaaaaatatttccaccatagttggcccaaaagcaatcaccaattaagaaagcgtttaagctcaacatctatcttaaattctagtcactctactgaactcctaacatcacattggactaatctattacttaatagaagcaataatgttaatataagtaatatgaaaacattctccattgcataagcttacatcagactggaataacccactgacagttagcctaatattaataaacgatataataagctctttattatttacactgttaacccaacacaggtatgctctaaggaaagaatacaaaaagtaaaaggaactccgcaaattttaccccgcctgtttaccaaaaacatcacctctagcattaccagtattagaggcactgcctgcccagtgacatacgttcaatggccgcagtatcctgactgtgcaaaggtagcataatcacttgttccttaaataggaacttgtatgaatgaccacacgagggttcagctgtctcctacttttaatcagggaaattgacctatccgcgaagaggcggatataaacaaataagacgagaagaccctatgtatggagctttaatttattaatgcaaataaaaacttaagcctacaggccctagcctactatccctgcattaaaatttttggttggggtgacctcagagcataattcaacctccgagcaacctaaactaagactgcactagcctaagcaagttaatatatattgacccgataatttgatcaacggagtaagttaccctagggataacagcgcaatcctattctagagtccatatcaacaatagggtttacaatctcgatgttggatcaggacatcctaatggtgtcaccgctattaggggttcgtttgttcaacaattaaagtcctacgtgatgtgagttcagaccagagtaatccaggtcggtttctatctatttaacatttcccctagtatgaaaggacaagagaaatagggcccacttcataaagtgccctcgctccacagatgatgctatctcaatctaacaaatcatcacataccctacccaagaacagggtttgttaag

SEQ ID NO: 5068 - DNA, 1383 bp, Homo sapiens
caaagacaagcccttataccttctgcataatgcattaactagaaataactttacatagaactatggccaagtcccccgaaaccagacgagctacccaagaatagctgaaagagcacactcacctatgtggcaaaacagtgggaagattcatgagtagcggtgacacgcctaccgagcctggtgatagctggctggcttagttcaactttcaacttacccacagaattacttaaactccctgtaagtttaactgttagtctagagagacagacagctctttagacccttcctacagagagtaaaaaacattaccaccacagttggcccaaaagcagccactaattaagaaagcatttaagctcaatatctaactatcttaaattctaaccagtctactgaactcctaacatcacattggactaatctattacttaatagaagcagtaatgttaatgtaagtaagatgaagacattctccattgcataagcttacatcagacgggagtaacccactgacagttaacatcccaatattaataaatgatataataaacaccgtattatttgcactgttaacccaacacaggcatgctctaaggaaacattacaaaaaaataaaaggaactcagcaaatcttaccccgcctgtttaccaaaaacatcacctctagcattaccagtattagaggcactatctgcccagtgacatatattcaacagctgtggtatcctgaccgtgcgaaggtagcataatcacttgttctctaaatagggacttgaatgaatggccacacgaaggttcagctgtctcttactttcaaccagtgaaattgatctatccgtgaagaggcggatataaacaaataagacgagaaaaccttatggagctttaattcatcaatgcaaataaaaactccaacaagcctacaggccctagcctcctatccctgcattaaaaattttggttggggtgacctcggagcataattcaacctcctaacaacctaagaccacacaagtctaagtgagttattacacatcgacccaataatttgataaacggagtaagttaccctagggataacagcgcaatcctatactagagtccatatcgacaatagagtttacgacctcgatgttggatcaggacatcctaatggtgtagccgctattaagagtttgtttgttcaatgattaaagtcctatgtgatctcagttcagaccagagtaatccaggtcggtttctacctacttaacattcctcctactacgaaaggacaagagaaatagggcccacttcataaagtgccctcactccatagatgatgccatcccagtctcttaaatcatcacacatcctacccaagaacagggtttgttaaga

SEQ ID NO: 5069 - DNA, 1231 bp, Homo sapiens
tattgaactcctaacattacattagactaatctattacttaatagaagcaataatgttaatattagtaacacgaagacattctccattgcataagcttatatcaaaccagaatccactgatagttaacagcctaatattaataaagaataaataccctattatttataccattaatccaacacaggtatgctctaaggaaagattacaaaaagtataaggaactcgggaaatcttaccccacctgtttaccaaaaacatcacctctggcttcaccagtattagaggcaccgcctgcccagtgacatatgttcaacagctgcggtatcctgacattgtaaaggtagcataatcacttgttccctaaatagggacttgtatgaatggccacacaagggttcagctgtctcttactttcagtcagtgaaattgacctatccatgaagaggcagtataaacaaataagatgagaagactctatagagctttaattcattaatgcaaatagaaactcaaaaaaagcctacaggccctagcctactatctttgcattaaaaattttggttggggtgcccggcgtggtggctcacgcctataatcccagcactttgggaggctgagacaggcagatcacgaggtcaggagatcgagaccatcccggccaatatggtgaaatcccgtctctactaaaaatacaaaaattagctgggtgtggtggtatgtgcctgtaatcccagctactcaggagactgaggcaggagaatggctttaacccgggaggtggagatagcagtgagccaagatcgtgccactgcactccagcctggcaacagagccagactctgtcttaaaaaataaataaataaaaaacaaaaaaaataaaaattttcttttatttcagagcataattcaacctccaaactacctaaactaagaccgcactagtctaagcaagttaacacacactgacccaataatttgatcaacggaataagttatcctagggataacggcacaatcctattctagggtccatatcaacaacagggtttacagcttcaatgctggatcaggacatcctaatagtgtagccgctattaagggttcgttttttcaactattaaagtcccatgtgatctcagttcagatcggagtaatccaggtcggtttctaactatttaacatttctcctagtacaaaaggacaagagaagcagggcccatttcacaaagc

SEQ ID NO: 5070 - DNA, 1739 bp, Homo sapiens
caaaccatttaccctcgacaaaagtataggagatagaaattacttattctggtgcaatagatatagtaccgtaagggaacaatgaaagaactatatcaagcaccaaaaagcaaagacaaatccttgcatcttttgaataatgaattaactagaataaacttcacaaagagagctctagccaagtcccccaaaatcagaggagcttctccagaacagctagaagagtacactcatttatgtggcaaaatagtgagaagattcattagtagcagtgacaagcctacggaggctggtgatagctgattgtccaaggtagaattttagttcaactttaaacttaacctacagaattacttaatcctcctgtaagtttaactgttaaagggggacggatcttcagatactagaaaataaccgtcctatagagagtaaaagattttaccaccataattggcctaaaagcagccaccaattaagaaagcgtttaagctcaacatctgactaacttcatttctaatcaccctgttaaactcctaatattacattggactaatctattattcagtagaagcaataatgttagtgtaagtaacattaagacattatccattgcataagcttacatcagaccagaataatccactgacagttaacaacctaatattaacaaatgattaatagacatcttattatctttattttaacccaatacagtcatgctctaaggaaagattacaaaaagtaaaaggaactcggcacatttcaccccatctctctaccaaaaacatcacccctagcattgctagtattagaggcactgcctgctcagtgacatatgtttaagggttgcggtatcctgaacttgcaaaggtagcataatcacttgttccctaagtagggacttgtatgaatggccacaccagggtttagctgtctcttactttcaaccagtgaaattgacctacctatgaagaggcgggtataaataaataggagaagaccctgtggagcttgaattcattaatgcaaatagattcaaacaagccaacaggccccaatgtatcatccctgcattaaaaattttggttggggtggccgggcacagtggctcacgcctgtaatcccagcactttgggaggccgaggtgggtggatcacgaggtcaggagatcgagaccatcctggctaacatagtaaaaccctgtatctactaaaaatacaaaaaattagccgggtgtggtggcacatgcctgtagtcccagctacccaggaggatgaggcaggagaatggcatgaacctgggaagcagagcttgcagtgagcggagatggtgccactgcactccagcctgagagacagagtgagactctgtcttaaaaaaaaaaaaaattggttggggtgaccttggagcataattcaacctccgaaacgacttaaactaagaccgcactagtgtaagtcagttattacacattgacccaataattctatcaacaggataagtgaccctagggttaagagtgcaatcctattctagcatccatatcaacaacagggtttacgaccttgatgttggatcgggacatcctaaatggtgtagccgctattaagggatcatttgttcaatgattaaagtccttcgtgatctgagttcagaccagagcaatccaggttggtttctatctatttagcatttttcccagtatgaaaggatatgagaaaccgggcccacttcacaaa

SEQ ID NO: 5071 - DNA, 1395 bp, Homo sapiens
tactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtc

SEQ ID NO: 5072 - DNA, 1494 bp, Homo sapiens
gtataggtgatagaaatttttagcctggcacaatagacttagtacagtaagggaaagatgaaagaactgtatcaagcactgaaaagcaaagacaagcccttatgccttctgcataatgtattaaccagaaataactttacacagagaactatagccaagtcccccaaaaccagccaagctacccaagaacagctgaaagagcacactcacctatgtggcaagatagtgggaagattcatgagtagaagtgacaaggctatggagcctggtgatagctggttgtccaagatagactcctagttcaactttaagcttatacacagaattacttaacctccctgtaagtttaactgttagtctaaagagggacagctctttagaccctaggaaacaaccttcctacagaaaataaaaaatattaccaccacagttggcccaaaagcagccaccaattaagaacatgtttaagttcaacatctatcttaaattctaatcactctactgaactcctaacatcacactggactaatctattacttaatagacacaataatgttagtataagtaacatgaagacattctccattgcataagcttacatcagaccagaataatccactgacagttaacagcctaatattaataaacaatataataaacaccctattatttacactgttaacccaacacaggtatgctctaaggaaagattacaaaaagtaaaaggaactcggcaaatcatactctgcctgtttaccaaaaacacacctctagcattaccagtatttgaggcactgcctgcccagtgacatttgttcaacagccacagtatcctgaccatgcaaaagtagcataatcacttgttccctaaatagggacttgtatgaatggccacaggagggttcggctgcctcttacttttaatcagggaaattgacctatccgtgaagaggcagatataaacaaataagatgagaagctccctatggagctttaattcattaatgcaaattaaaactcaaacaagcctacaggctctagcctactattcttgcattaaaaattttggttggggtgaccttggagcataattcaacctctgaacaacctacactaagactgcactagtctaagtgagttaatacatatggacccaataatttgatcaacagagtaaggtaccctagggataacagcacaatccattctacagttcatattgacaatagggtttatgaccttgatgttagatcaggacatcctaatggtgtaaccactgttaaggattcatttattcaatgattaaagtcaattaatgtgatctgagttcagactggagtaatccaggttggtttctatctatttaacatttctccaagtatgaaaggacaagagaaatagagtccctttcataaagtgccctcacttcatagaggatgctatctcaatctaaaaaatcatcaccaccctacccaagaacagggtttgttaaga

SEQ ID NO: 5073 - DNA, 1290 bp, Homo sapiens
cccaaacccattccaccttactaccgaacagctttaaccaaatcatttacccaaataaagtataggcgatagaaattgtaaatcggcgcaatagatatagtaccgcaagggaaagatgaaaaattgcaaccaagcataatacagcaaggactaatccctgtaccttctgcataatgaattaactagaaataactttgcaaagagaaccaaagctaagacccccgaaaccagacgagctacctaagaacagctaaaagagcacacccgtctatgtagcaaaatagtgggaagattcgtaggtagaggcgacaaacctaccgagtctggtgatagctggttgtccaagacagaatcttagttcaactttaaatttacccacagaaccctccaaatccccctgtaaatttaactgttagtccaaagaggaacagctctttggacactaggaaaaaaccttgtaaagagagtaaaaaatttaatacccacagtaggcctaaaagcagccaccaattaagaaagcgttcaagctcgacacctgtcatctaaaaaatcccaaacacataactgaactccttgcacccaattggaccaatctattaccctatagaagagctaatgttagtataagtaacatgaaaacattctcctccgcataagcctacatcagaccaaaatattaaactgacaattaacagcccaatatctataaccaaccaacaagccattattacccccactgttaacccaacacaggcatgcccacaaggaaaggttaaaaaaagtaaaaggaactcggcaaatcttaccccgcctgtttaccaaaaacatcacctctagcattctcagtattagaggcaccgcctgcccagtgacatgcgtttaacggccgcggtaccctaactgtgcaaaggtagcataatcacttgttccttaaatagggacttgtatgaatggctccacgagggttcagctgtctcttactttcaaccagtgaaattgacctgcccgtgaagaggcgggcatagtataacaagacgagaagaccctatggagctttaattcattaacgcaaacaacacttaacaagtccacaggccctaaactatcaaacctgcgtgaaaaatttcggttggggcgacctcggagcacaatccgacctccgagcaacacatgccgagacttcaccagtcaaagcgaattaccacgtttaattgatccaataacttgaccaacggaacaagttaccctagggataacagcgcaatcctattctagagtccatatcaacaa

SEQ ID NO: 5074 - DNA, 527 bp, Homo sapiens
tattactcctactgttaacccaacacaggcatgcccacaaggaaaggttaaaaaaagtaaaaggaactcggcaaatcttaccccgcctgtttaccaaaaacatcacctctagcattaccagtattagaggcaccgcctgcccagtgacatatgtttaacggccgtggtaccctaaccgtgcaaaggtagcatgatcacttgttccttaaatagggacttgtatgaatggctcgacgaggtttcagctgtctcttactttcaaccactgcaactgacctgcccgtgaagaggcggacataatacaacaagacgagaagaccatatggagcttcaatttaccaatgcaaacaacacccaataagcccacaggctctaacctaccaaacctgcattaaaaatttcggctggggcgacctcggagtataacccaacctccgagcaacatatgctgagacttcaccagtcaaaacgagttaccacgtacaattgatccaataatttgactaacggaacaagttaccctaggg

SEQ ID NO: 5075 - DNA, 3557 bp, Homo sapiens
gagagggtccttcagggtctgcttatgcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacccatgaccgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctgacccacagcatcactgagctgggcccctacaccctggacagggacagtctctatgtcaatggtttcacacagcggagctctgtgcccaccactagcattcctgggacccccacagtggacctgggaacatctgggactccagtttctaaacctggtccctcggctgccagccctctcctggtgctattcactctcaacttcaccatcaccaacctgcggtatgaggagaacatgcagcaccctggctccaggaagttcaacaccacggagagggtccttcagggcctgctcaggtccctgttcaagagcaccagtgttggccctctgtactctggctgcagactgactttgctcaggcctgaaaaggatgggacagccactggagtggatgccatctgcacccaccaccctgaccccaaaagccctaggctggacagagagcagctgtattgggagctgagccagctgacccacaatatcactgagctgggcccctatgccctggacaacgacagcctctttgtcaatggtttcactcatcggagctctgtgtccaccaccagcactcctgggacccccacagtgtatctgggagcatctaagactccagcctcgatatttggcccttcagctgccagccatctcctgatactattcaccctcaacttcaccatcactaacctgcggtatgaggagaacatgtggcctggctccaggaagttcaacactacagagagggtccttcagggcctgctaaggcccttgttcaagaacaccagtgttggccctctgtactctggctgcaggctgaccttgctcaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtttcacccatcggagctctgtacccaccaccagcaccggggtggtcagcgaggagccattcacactgaacttcaccatcaacaacctgcgctacatggcggacatgggccaacccggctccctcaagttcaacatcacagacaacgtcatgcagcacctgctcagtcctttgttccagaggagcagcctgggtgcacggtacacaggctgcagggtcatcgcactaaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggttacaatgaacctggtccagatgagcctcctacaactcccaagccagccaccacattcctgcctcctctgtcagaagccacaacagccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggctatgcaccccagaatttatcaatccggggcgagtaccagataaatttccacattgtcaactggaacctcagtaatccagaccccacatcctcagagtacatcaccctgctgagggacatccaggacaaggtcaccacactctacaaaggcagtcaactacatgacacattccgcttctgcctggtcaccaacttgacgatggactccgtgttggtcactgtcaaggcattgttctcctccaatttggaccccagcctggtggagcaagtctttctagataagaccctgaatgcctcattccattggctgggctccacctaccagttggtggacatccatgtgacagaaatggagtcatcagtttatcaaccaacaagcagctccagcacccagcacttctacctgaatttcaccatcaccaacctaccatattcccaggacaaagcccagccaggcaccaccaattaccagaggaacaaaaggaatattgaggatgcgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatgggtattctcccaacagaaatgagcccttaactgggaattctgaccttcccttctgggctgtcatcctcatcggcttggcaggactcctgggagtcatcacatgcctgatctgcggtgtcctggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcg

SEQ ID NO: 5076 - DNA, 32753 bp, Homo sapiens
aagcgttgcacaattcccccaacctccatacatacggcagctcttctagacacaggttttcccaggtcaaatgcggggaccccagccatatctcccaccctgagaaattttggagtttcagggagctcagaagctctgcagaggccaccctctctgaggggattcttcttagacctccatccagaggcaaatgttgacctgtccatgctgaaaccctcaggccttcctgggtcatcttctcccacccgctccttgatgacagggagcaggagcactaaagccacaccagaaatggattcaggactgacaggagccaccttgtcacctaagacatctacaggtgcaatcgtggtgacagaacatactctgccctttacttccccagataagaccttggccagtcctacatcttcggttgtgggaagaaccacccagtctttgggggtgatgtcctctgctctccctgagtcaacctctagaggaatgacacactccgagcaaagaaccagcccatcgctgagtccccaggtcaatggaactccctctaggaactaccctgctacaagcatggtttcaggattgagttccccaaggaccaggaccagttccacagaaggaaattttaccaaagaagcatctacatacacactcactgtagagaccacaagtggcccagtcactgagaagtacacagtccccactgagacctcaacaactgaaggtgacagcacagagaccccctgggacacaagatatattcctgtaaaaatcacatctccaatgaaaacatttgcagattcaactgcatccaaggaaaatgccccagtgtctatgactccagctgagaccacagttactgactcacatactccaggaaggacaaacccatcatttgggacactttattcttccttccttgacctatcacctaaagggaccccaaattccagaggtgaaacaagcctggaactgattctatcaaccactggatatcccttctcctctcctgaacctggctctgcaggacacagcagaataagtaccagtgcgcctttgtcatcatctgcttcagttctcgataataaaatatcagagaccagcatattctcaggccagagtctcacctcccctctgtctcctggggtgcccgaggccagagccagcacaatgcccaactcagctatccctttttccatgacactaagcaatgcagaaacaagtgccgaaagggtcagaagcacaatttcctctctggggactccatcaatatccacaaagcagacagcagagactatccttaccttccatgccttcgctgagaccatggatatacccagcacccacatagccaagactttggcttcagaatggttgggaagtccaggtacccttggtggcaccagcacttcagcgctgacaaccacatctccatctaccactttagtctcagaggagaccaacacccatcactccacgagtggaaaggaaacagaaggaactttgaatacatctatgactccacttgagacctctgctcctggagaagagtccgaaatgactgccaccttggtccccactctaggttttacaactcttgacagcaagatcagaagtccatctcaggtctcttcatcccacccaacaagagagctcagaaccacaggcagcacctctgggaggcagagttccagcacagctgcccacgggagctctgacatcctgagggcaaccacttccagcacctcaaaagcatcatcatggaccagtgaaagcacagctcagcaatttagtgaaccccagcacacacagtgggtggagacaagtcctagcatgaaaacagagagacccccagcatcaaccagtgtggcagcccctatcaccacttctgttccctcagtggtctctggcttcaccaccctgaagaccagctccacaaaagggatttggcttgaagaaacatctgcagacacactcatcggagaatccacagctggcccaaccacccatcagtttgctgttcccactgggatttcaatgacaggaggcagcagcaccaggggaagccagggcacaacccacctactcaccagagccacagcatcatctgagacatccgcagatttgactctggccacgaacggtgtcccagtctccgtgtctccagcagtgagcaagacggctgctggctcaagtcctccaggagggacaaagccatcatatacaatggtttcttctgtcatccctgagacatcatctctacagtcctcagctttcagggaaggaaccagcctgggactgactccattaaacactagacatcccttctcttcccctgaaccagactctgcaggacacaccaagataagcaccagcattcctctgttgtcatctgcttcagttcttgaggataaagtgtcagcgaccagcacattctcacaccacaaagccacctcatctattaccacagggactcctgaaatctcaacaaagacaaagcccagctcagccgttctttcctccatgaccctaagcaatgcagcaacaagtcctgaaagagtcagaaatgcaacttcccctctgactcatccatctccatcaggggaagagacagcagggagtgtcctcactctcagcacctctgctgagactacagactcacctaacatccacccaactgggacactgacttcagaatcgtcagagagtcctagcactctcagcctcccaagtgtctctggagtcaaaaccacattttcttcatctactccttccactcatctatttactagtggagaagaaacagaggaaacttcgaatccatctgtgtctcaacctgagacttctgtttccagagtaaggaccaccttggccagcacctctgtccctaccccagtattccccaccatggacacctggcctacacgttcagctcagttctcttcatcccacctagtgagtgagctcagagctacgagcagtacctcagttacaaactcaactggttcagctcttcctaaaatatctcacctcactgggacggcaacaatgtcacagaccaatagagacacgtttaatgactctgctgcaccccaaagcacaacttggccagagactagtcccagattcaagacagggttaccttcagcaacaaccactgtttcaacctctgccacttctctctctgctactgtaatggtctctaaattcacttctccagcaactagttccatggaagcaacttctatcagggaaccatcaacaaccatcctcacaacagagaccacgaatggcccaggctctatggctgtggcttctaccaacatcccaattggaaagggctacattactgaaggaagattggacacaagccatctgcccattggaaccacagcttcctctgagacatctatggattttaccatggccaaagaaagtgtctcaatgtcagtatctccatctcagtccatggatgctgctggctcaagcactccaggaaggacaagccaattcgttgacacattttctgatgatgtctatcatttaacatccagagaaattacaatacctagagatggaacaagctcagctctgactccacaaatgactgcaactcaccctccatctcctgatcctggctctgctagaagcacctggcttggcatcttgtcctcatctccttcttctcctactcccaaagtcacaatgagctccacattttcaactcagagagtcaccacaagcatgataatggacacagttgaaactagtcggtggaacatgcccaacttaccttccacgacttccttgacaccaagtaatattccaacaagtggtgccataggaaaaagcaccctggttcccttggacactccatctccagccacatcattggaggcatcagaagggggacttccaaccctcagcacctaccctgaatcaacaaacacacccagcatccacctcggagcacacgctagttcagaaagtccaagcaccatcaaacttaccatggcttcagtagtaaaacctggctcttacacacctctcaccttcccctcaatagagacccacattcatgtatcaacagccagaatggcttactcttctgggtcttcacctgagatgacagctcctggagagactaacactggtagtacctgggaccccaccacctacatcaccactacggatcctaaggatacaagttcagctcaggtctctacaccccactcagtgaggacactcagaaccacagaaaaccatccaaagacagagtccgccaccccagctgcttactctggaagtcctaaaatctcaagttcacccaatctcaccagtccggccacaaaagcatggaccatcacagacacaactgaacactccactcaattacattacacaaaattggcagaaaaatcatctggatttgagacacagtcagctccaggacctgtctctgtagtaatccctacctcccctaccattggaagcagcacattggaactaacttctgatgtcccaggggaacccctggtccttgctcccagtgagcagaccacaatcactctccccatggcaacatggctgagtaccagtttgacagaggaaatggcttcaacagaccttgatatttcaagtccaagttcacccatgagtacatttgctatttttccacctatgtccacaccttctcatgaactttcaaagtcagaggcagataccagtgccattagaaatacagattcaacaacgttggatcagcacctaggaatcaggagtttgggcagaactggggacttaacaactgttcctatcaccccactgacaaccacgtggaccagtgtgattgaacactcaacacaagcacaggacaccctttctgcaacgatgagtcctactcacgtgacacagtcactcaaagatcaaacatctataccagcctcagcatccccttcccatcttactgaagtctaccctgagctcgggacacaagggagaagctcctctgaggcaaccactttttggaaaccatctacagacacactgtccagagagattgagactggcccaacaaacattcaatccactccacccatggacaacacaacaacagggagcagtagtagtggagtcaccctgggcatagcccaccttcccataggaacatcctccccagctgagacatccacaaacatggcactggaaagaagaagttctacagccactgtctctatggctgggacaatgggactccttgttactagtgctccaggaagaagcatcagccagtcattaggaagagtttcctctgtcctttctgagtcaactactgaaggagtcacagattctagtaagggaagcagcccaaggctgaacacacagggaaatacagctctctcctcctctcttgaacccagctatgctgaaggaagccagatgagcacaagcatccctctaacctcatctcctacaactcctgatgtggaattcatagggggcagcacattttggaccaaggaggtcaccacagttatgacctcagacatctccaagtcttcagcaaggacagagtccagctcagctacccttatgtccacagctttgggaagcactgaaaatacaggaaaagaaaaactcagaactgcctctatggatcttccatctccaactccatcaatggaggtgacaccatggatttctctcactctcagtaatgcccccaataccacagattcacttgacctcagccatggggtgcacaccagctctgcagggactttggccactgacaggtcattgaatactggtgtcactagagcctccagattggaaaacggctctgatacctcttctaagtccctgtctatgggaaacagcactcacacttccatgacttacacagagaagagtgaagtgtcttcttcaatccatccccgacctgagacctcagctcctggagcagagaccactttgacttccactcctggaaacagggccataagcttaacattgcctttttcatccattccagtggaagaagtcatttctacaggcataacctcaggaccagacatcaactcagcacccatgacacattctcccatcaccccaccaacaattgtatggaccagtacaggcacaattgaacagtccactcaaccactacatgcagtttcttcagaaaaagtttctgtgcagacacagtcaactccatatgtcaactctgtggcagtgtctgcttcccctacccatgagaattcagtctcttctggaagcagcacatcctctccatattcctcagcctcacttgaatccttggattccacaatcagtaggaggaatgcaatcacttcctggctatgggacctcactacatctctccccactacaacttggccaagtactagtttatctgaggcactgtcctcaggccattctggggtttcaaacccaagttcaactacgactgaatttccactcttttcagctgcatccacatctgctgctaagcaaagaaatccagaaacagagacccatggtccccagaatacagccgcgagtactttgaacactgatgcatcctcggtcacaggtctttctgagactcctgtgggggcaagtatcagctctgaagtccctcttccaatggccataacttctagatcagatgtttctggccttacatctgagagtactgctaacccgagtttaggcacagcctcttcagcagggaccaaattaactaggacaatatccctgcccacttcagagtctttggtttcctttagaatgaacaaggatccatggacagtgtcaatccctttggggtcccatccaactactaatacagaaacaagcatcccagtaaacagcgcaggtccacctggcttgtccacagtagcatcagatgtaattgacacaccttcagatggggctgagagtattcccactgtctccttttccccctcccctgatactgaagtgacaactatctcacatttcccagaaaagacaactcattcatttagaaccatttcatctctcactcatgagttgacttcaagagtgacacctattcctggggattggatgagttcagctatgtctacaaagcccacaggagccagtccctccattacactgggagagagaaggacaatcacctctgctgctccaaccacttcccccatagttctcactgctagtttcacagagaccagcacagtttcactggataatgaaactacagtaaaaacctcagatatccttgacgcacggaaaacaaatgagctcccctcagatagcagttcttcttctgatctgatcaacacctccatagcttcttcaactatggatgtcactaaaacagcctccatcagtcccactagcatctcaggaatgacagcaagttcctccccatctctcttctcttcagatagaccccaggttcccacatctacaacagagacaaatacagccacctctccatctgtttccagtaacacctattctcttgatgggggctccaatgtgggtggcactccatccactttaccaccctttacaatcacccaccctgtcgagacaagctcggccctattagcctggtctagaccagtaagaactttcagcaccatggtcagcactgacactgcctccggagaaaatcctacctctagcaattctgtggtgacttctgttccagcaccaggtacatggaccagtgtaggcagtactactgacttacctgccatgggctttctcaagacaagtcctgcaggagaggcacactcacttctagcatcaactattgaaccagccactgccttcactccccatctctcagcagcagtggtcactggatccagtgctacatcagaagccagtcttctcactacgagtgaaagcaaagccattcattcttcaccacagaccccaactacacccacctctggagcaaactgggaaacttcagctactcctgagagccttttggtagtcactgagacttcagacacaacacttacctcaaagattttggtcacagataccatcttgttttcaactgtgtccacgccaccttctaaatttccaagtacggggactctgtctggagcttccttccctactttactcccggacactccagccatccctctcactgccactgagccaacaagttcattagctacatcctttgattccaccccactggtgactatagcttcggatagtcttggcacagtcccagagactaccctgaccatgtcagagacctcaaatggtgatgcactggttcttaagacagtaagtaacccagataggagcatccctggaatcactatccaaggagtaacagaaagtccactccatccttcttccacttccccctctaagattgttgctccacggaatacaacctatgaaggttcgatcacagtggcactttctactttgcctgcgggaactactggttcccttgtattcagtcagagttctgaaaactcagagacaacggctttggtagactcatcagctgggcttgagagggcatctgtgatgccactaaccacaggaagccagggtatggctagctctggaggaatcagaagtgggtccactcactcaactggaaccaaaacattttcttctctccctctgaccatgaacccaggtgaggttacagccatgtctgaaatcaccacgaacagactgacagctactcaatcaacagcacccaaagggatacctgtgaagcccaccagtgctgagtcaggcctcctaacacctgtctctgcctcctcaagcccatcaaaggcctttgcctcactgactacagctcccccaacttgggggatcccacagtctaccttgacatttgagttttctgaggtcccaagtttggatactaagtccgcttctttaccaactcctggacagtccctgaacaccattccagactcagatgcaagcacagcatcttcctcactgtccaagtctccagaaaaaaacccaagggcaaggatgatgacttccacaaaggccataagtgcaagctcatttcaatcaacaggttttactgaaacccctgagggatctgcctccccttctatggcagggcatgaacccagagtccccacttcaggaacaggggaccctagatatgcctcagagagcatgtcttatccagacccaagcaaggcatcatcagctatgacatcgacctctcttgcatcaaaactcacaactctcttcagcacaggtcaagcagcaaggtctggttctagttcctctcccataagcctatccactgagaaagaaacaagcttcctttcccccactgcatccacctccagaaagacttcactatttcttgggccttccatggcaaggcagcccaacatattggtgcatcttcagacttcagctctgacactttctccaacatccactctaaatatgtcccaggaggagcctcctgagttaacctcaagccagaccattgcagaagaagagggaacaacagctgaaacacagacgttaaccttcacaccatctgagaccccaacatccttgttacctgtctcttctcccacagaacccacagccagaagaaagagttctccagaaacatgggcaagctctatttcagttcctgccaagacctccttggttgaaacaactgatggaacgctagtgaccaccataaagatgtcaagccaggcagcacaaggaaattccacgtggcctgccccagcagaggagacggggagcagtccagcaggcacatccccaggaagcccagaaatgtctaccactctcaaaatcatgagctccaaggaacccagcatcagcccagagatcaggtccactgtgagaaattctccttggaagactccagaaacaactgttcccatggagaccacagtggaaccagtcacccttcagtccacagccctaggaagtggcagcaccagcatctctcacctgcccacaggaaccacatcaccaaccaagtcaccaacagaaaatatgttggctacagaaagggtctccctctccccatccccacctgaggcttggaccaacctttattctggaactccaggagggaccaggcagtcactggccacaatgtcctctgtctccctagagtcaccaactgctagaagcatcacagggactggtcagcaaagcagtccagaactggtttcaaagacaactggaatggaattctctatgtggcatggctctactggagggaccacaggggacacacatgtctctctgagcacatcttccaatatccttgaagaccctgtaaccagcccaaactctgtgagctcattgacagataaatccaaacataaaaccgagacatgggtaagcaccacagccattccctccactgtcctgaataataagataatggcagctgaacaacagacaagtcgatctgtggatgaggcttattcatcaactagttcttggtcagatcagacatctgggagtgacatcacccttggtgcatctcctgatgtcacaaacacattatacatcacctccacagcacaaaccacctcactagtgtctctgccctctggagaccaaggcattacaagcctcaccaatccctcaggaggaaaaacaagctctgcgtcatctgtcacatctccttcaatagggcttgagactctgagggccaatgtaagtgcagtgaaaagtgacattgcccctactgctgggcatctatctcagacttcatctcctgcggaagtgagcatcctggacgtaaccacagctcctactccaggtatctccaccaccatcaccaccatgggaaccaactcaatctcaactaccacacccaacccagaagtgggtatgagtaccatggacagcaccccggccacagagaggcgcacaacttctacagaacacccttccacctggtcttccacagctgcatcagattcctggactgtcacagacatgacttcaaacttgaaagttgcaagatctcctggaacaatttccacaatgcatacaacttcattcttagcctcaagcactgaattagactccatgtctactccccatggccgtataactgtcattggaaccagcctggtcactccatcctctgatgcttcagctgtaaagacagagaccagtacaagtgaaagaacattgagtccttcagacacaactgcatctactcccatctcaactttttctcgtgtccagaggatgagcatctcagttcctgacattttaagtacaagttggactcccagtagtacagaagcagaagatgtgcctgtttcaatggtttctacagatcatgctagtacaaagactgacccaaatacgcccctgtccacttttctgtttgattctctgtccactcttgactgggacactgggagatctctgtcatcagccacagccactacctcagctcctcagggggccacaactccccaggaactcactttggaaaccatgatcagcccagctacctcacagttgcccttctctatagggcacattacaagtgcagtcacaccagctgcaatggcaaggagctctggagttactttttcaagaccagatcccacaagcaaaaaggcagagcagacttccactcagcttcccaccaccacttctgcacatccagggcaggtgcccagatcagcagcaacaactctggatgtgatcccacacacagcaaaaactccagatgcaacttttcagagacaagggcagacagctcttacaacagaggcaagagctacatctgactcctggaatgagaaagaaaaatcaaccccaagtgcaccttggatcactgagatgatgaattctgtctcagaagataccatcaaggaggttaccagctcctccagtgtattaaggaccctgaatacgctggacataaacttggaatctgggacgacttcatccccaagttggaaaagcagcccatatgagagaattgccccttctgagtccaccacagacaaagaggcaattcacccttctacaaacacagtagagaccacaggctgggtcacaagttccgaacatgcttctcattccactatcccagcccactcagcgtcatccaaactcacatctccagtggttacaacctccaccagggaacaagcaatagtttctatgtcaacaaccacatggccagagtctacaagggctagaacagagcctaattccttcttgactattgaactgagggacgtcagcccttacatggacaccagctcaaccacacaaacaagtattatctcttccccaggttccactgcgatcaccaaggggcctagaacagaaattacctcctctaagagaatatccagctcattccttgcccagtctatgaggtcgtcagacagcccctcagaagccatcaccaggctgtctaactttcctgccatgacagaatctggaggaatgatccttgctatgcaaacaagtccacctggcgctacatcactaagtgcacctactttggatacatcagccacagcctcctggacagggactccactggctacgactcagagatttacatactcagagaagaccactctctttagcaaaggtcctgaggatacatcacagccaagccctccctctgtggaagaaaccagctcttcctcttccctggtacctatccatgctacaacctcgccttccaatattttgttgacatcacaagggcacagtccctcctctactccacctgtgacctcagttttcttgtctgagacctctggcctggggaagaccacagacatgtcgaggataagcttggaacctggcacaagtttacctcccaatttgagcagtacagcaggtgaggcgttatccacttatgaagcctccagagatacaaaggcaattcatcattctgcagacacagcagtgacgaatatggaggcaaccagttctgaatattctcctatcccaggccatacaaagccatccaaagccacatctccattggttacctcccacatcatgggggacatcacttcttccacatcagtatttggctcctccgagaccacagagattgagacagtgtcctctgtgaaccagggacttcaggagagaagcacatcccaggtggccagctctgctacagagacaagcactgtcattacccatgtgtctagtggtgatgctactactcatgtcaccaagacacaagccactttctctagcggaacatccatctcaagccctcatcagtttataacttctaccaacacatttacagatgtgagcaccaacccctccacctctctgataatgacagaatcttcaggagtgaccatcaccacccaaacaggtcctactggagctgcaacacagggtccatatctcttggacacatcaaccatgccttacttgacagagactccattagctgtgactccagattttatgcaatcagagaagaccactctcataagcaaaggtcccaaggatgtgtcctggacaagccctccctctgtggcagaaaccagctatccctcttccctgacacctttcttggtcacaaccatacctcctgccacttccacgttacaagggcaacatacatcctctcctgtttctgcgacttcagttcttacctctggactggtgaagaccacagatatgttgaacacaagcatggaacctgtgaccaattcacctcaaaatttgaacaatccatcaaatgagatactggccactttggcagccaccacagatatagagactattcatccttccataaacaaagcagtgaccaatatggggactgccagttcagcacatgtactgcattccactctcccagtcagctcagaaccatctacagccacatctccaatggttcctgcctccagcatgggggacgctcttgcttctatatcaatacctggttctgagaccacagacattgagggagagccaacatcctccctgactgctggacgaaaagagaacagcaccctccaggagatgaactcaactacagagtcaaacatcatcctctccaatgtgtctgtgggggctattactgaagccacaaaaatggaagtcccctcttttgatgcaacattcataccaactcctgctcagtcaacaaagttcccagatattttctcagtagccagcagtagactttcaaactctcctcccatgacaatatctacccacatgaccaccacccagacagggtcttctggagctacatcaaagattccacttgccttagacacatcaaccttggaaacctcagcagggactccatcagtggtgactgaggggtttgcccactcaaaaataaccactgcaatgaacaatgatgtcaaggacgtgtcacagacaaaccctccctttcaggatgaagccagctctccctcttctcaagcacctgtccttgtcacaaccttaccttcttctgttgctttcacaccgcaatggcacagtacctcctctcctgtttctatgtcctcagttcttacttcttcactggtaaagaccgcaggcaaggtggatacaagcttagaaacagtgaccagttcacctcaaagtatgagcaacactttggatgacatatcggtcacttcagcagccaccacagatatagagacaacgcatccttccataaacacagtagttaccaatgtggggaccaccggttcagcatttgaatcacattctactgtctcagcttacccagagccatctaaagtcacatctccaaatgttaccacctccaccatggaagacaccacaatttccagatcaatacctaaatcctctaagactacaagaactgagactgagacaacttcctccctgactcctaaactgagggagaccagcatctcccaggagatcacctcgtccacagagacaagcactgttccttacaaagagctcactggtgccactaccgaggtatccaggacagatgtcacttcctctagcagtacatccttccctggccctgatcagtccacagtgtcactagacatctccacagaaaccaacaccaggctgtctacctccccaataatgacagaatctgcagaaataaccatcaccacccaaacaggtcctcatggggctacatcacaggatacttttaccatggacccatcaaatacaaccccccaggcagggatccactcagctatgactcatggattttcacaattggatgtgaccactcttatgagcagaattccacaggatgtatcatggacaagtcctccctctgtggataaaaccagctccccctcttcctttctgtcctcacctgcaatgaccacaccttccctgatttcttctaccttaccagaggataagctctcctctcctatgacttcacttctcacctctggcctagtgaagattacagacatattacgtacacgcttggaacctgtgaccagctcacttccaaatttcagcagcacctcagataagatactggccacttctaaagacagtaaagacacaaaggaaatttttccttctataaacacagaagagaccaatgtgaaagccaacaactctggacatgaatcccattcccctgcactggctgactcagagacacccaaagccacaactcaaatggttatcaccaccactgtgggagatccagctccttccacatcaatgccagtgcatggttcctctgagactacaaacattaagagagagccaacatatttcttgactcctagactgagagagaccagtacctctcaggagtccagctttcccacggacacaagttttctactttccaaagtccccactggtactattactgaggtctccagtacaggggtcaactcttctagcaaaatttccaccccagaccatgataagtccacagtgccacctgacaccttcacaggagagatccccagggtcttcacctcctctattaagacaaaatctgcagaaatgacgatcaccacccaagcaagtcctcctgagtctgcatcgcacagtacccttcccttggacacatcaaccacactttcccagggagggactcattcaactgtgactcagggattcccatactcagaggtgaccactctcatgggcatgggtcctgggaatgtgtcatggatgacaactccccctgtggaagaaaccagctctgtgtcttccctgatgtcttcacctgccatgacatccccttctcctgtttcctccacatcaccacagagcatcccctcctctcctcttcctgtgactgcacttcctacttctgttctggtgacaaccacagatgtgttgggcacaacaagcccagagtctgtaaccagttcacctccaaatttgagcagcatcactcatgagagaccggccacttacaaagacactgcacacacagaagccgccatgcatcattccacaaacaccgcagtgaccaatgtagggacttccgggtctggacataaatcacaatcctctgtcctagctgactcagagacatcgaaagccacacctctgatgagtaccacctccaccctgggggacacaagtgtttccacatcaactcctaatatctctcagactaaccaaattcaaacagagccaacagcatccctgagccctagactgagggagagcagcacgtctgagaagaccagctcaacaacagagacaaatactgccttttcttatgtgcccacaggtgctattactcaggcctccagaacagaaatctcctctagcagaacatccatctcagaccttgatcggcccacaatagcacccgacatctccacaggaatgatcaccaggctcttcacctcccccatcatgacaaaatctgcagaaatgaccgtcaccactcaaacaactactcctggggctacatcacagggtatccttccctgggacacatcaaccacacttttccagggagggactcattcaaccgtgtctcagggattcccacactcagagataaccactcttcggagcagaacccctggagatgtgtcatggatgacaactccccctgtggaagaaaccagctctgggttttccctgatgtcaccttccatgacatccccttctcctgtttcctccacatcaccagagagcatcccctcctctcctctccctgtgactgcacttcttacttctgttctggtgacaaccacaaatgtattgggcacaacaagcccagagcccgtaacgagttcacctccaaatttaagcagccccacacaggagagactgaccacttacaaagacactgcgcacacagaagccatgcatgcttccatgcatacaaacactgcagtggccaacgtggggacctccatttctggacatgaatcacaatcttctgtcccagctgattcacacacatccaaagccacatctccaatgggtatcaccttcgccatgggggatacaagtgtttctacatcaactcctgccttctttgagactagaattcagactgaatcaacatcctctttgattcctggattaagggacaccaggacgtctgaggagatcaacactgtgacagagaccagcactgtcctttcagaagtgcccactactactactactgaggtctccaggacagaagttatcacttccagcagaacaaccatctcagggcctgatcattccaaaatgtcaccctacatctccacagaaaccatcaccaggctctccacttttccttttgtaacaggatccacagaaatggccatcaccaaccaaacaggtcctatagggactatctcacaggctacccttaccctggacacatcaagcacagcttcctgggaagggactcactcacctgtgactcagagatttccacactcagaggagaccactactatgagcagaagtactaagggcgtgtcatggcaaagccctccctctgtggaagaaaccagttctccttcttccccagtgcctttacctgcaataacctcacattcatctctttattccgcagtatcaggaagtagccccacttctgctctccctgtgacttcccttctcacctctggcaggaggaagaccatagacatgttggacacacactcagaacttgtgaccagctccttaccaagtgcaagtagcttctcaggtgagatactcacttctgaagcctccacaaatacagagacaattcacttttcagagaacacagcagaaaccaatatggggaccaccaattctatgcataaactacattcctctgtctcaatccactcccagccatccggacacacacctccaaaggttactggatctatgatggaggacgctattgtttccacatcaacacctggttctcctgagactaaaaatgttgacagagactcaacatcccctctgactcctgaactgaaagaggacagcaccgccctggtgatgaactcaactacagagtcaaacactgttttctccagtgtgtccctggatgctgctactgaggtctccagggcagaagtcacctactatgatcctacattcatgccagcttctgctcagtcaacaaagtccccagacatttcacctgaagccagcagcagtcattctaactctcctcccttgacaatatctacacacaagaccatcgccacacaaacaggtccttctggggtgacatctcttggccaactgaccctggacacatcaaccatagccacctcagcaggaactccatcagccagaactcaggattttgtagattcagaaacaaccagtgtcatgaacaatgatctcaatgatgtgttgaagacaagccctttctctgcagaagaagccaactctctctcttctcaggcacctctccttgtgacaacctcaccttctcctgtaacttccacattgcaagagcacagtacctcctctcttgtttctgtgacctcagtacccacccctacactggcgaagatcacagacatggacacaaacttagaacctgtgactcgttcacctcaaaatttaaggaacaccttggccacttcagaagccaccacagatacacacacaatgcatccttctataaacacagcagtggccaatgtggggaccaccagttcaccaaatgaattctattttactgtctcacctgactcagacccatataaagccacatccgcagtagttatcacttccacctcgggggactcaatagtttccacatcaatgcctagatcctctgcgatgaaaaagattgagtctgagacaactttctccctgatatttagactgagggagactagcacctcccagaaaattggctcatcctcagacacaagcacggtctttgacaaagcattcactgctgctactactgaggtctccagaacagaactcacctcctctagcagaacatccatccaaggcactgaaaagcccacaatgtcaccggacacctccacaagatctgtcaccatgctttctacttttgctggcctgacaaaatccgaagaaaggaccattgccacccaaacaggtcctcatagggcgacatcacagggtacccttacctgggacacatcaatcacaacctcacaggcagggacccactcagctatgactcatggattttcacaattagatttgtccactcttacgagtagagttcctgagtacatatcagggacaagcccaccctctgtggaaaaaaccagctcttcctcttcccttctgtctttaccagcaataacctcaccgtcccctgtacctactacattaccagaaagtaggccgtcttctcctgttcatctgacttcactccccacctctggcctagtgaagaccacagatatgctggcatctgtggccagtttacctccaaacttgggcagcacctcacataagataccgactacttcagaagacattaaagatacagagaaaatgtatccttccacaaacatagcagtaaccaatgtggggaccaccacttctgaaaaggaatcttattcgtctgtcccagcctactcagaaccacccaaagtcacctctccaatggttacctctttcaacataagggacaccattgtttccacatccatgcctggctcctctgagattacaaggattgagatggagtcaacattctccctggctcatgggctgaagggaaccagcacctcccaggaccccatcgtatccacagagaaaagtgctgtccttcacaagttgaccactggtgctactgagacctctaggacagaagttgcctcttctagaagaacatccattccaggccctgatcattccacagagtcaccagacatctccactgaagtgatccccagcctgcctatctcccttggcattacagaatcttcaaatatgaccatcatcactcgaacaggtcctcctcttggctctacatcacagggcacatttaccttggacacaccaactacatcctccagggcaggaacacactcgatggcgactcaggaatttccacactcagaaatgaccactgtcatgaacaaggaccctgagattctatcatggacaatccctccttctatagagaaaaccagcttctcctcttccctgatgccttcaccagccatgacttcacctcctgtttcctcaacattaccaaagaccattcacaccactccttctcctatgacctcactgctcacccctagcctagtgatgaccacagacacattgggcacaagcccagaacctacaaccagttcacctccaaatttgagcagtacctcacatgagatactgacaacagatgaagacaccacagctatagaagccatgcatccttccacaagcacagcagcgactaatgtggaaaccaccagttctggacatgggtcacaatcctctgtcctagctgactcagaaaaaaccaaggccacagctccaatggataccacctccaccatggggcatacaactgtttccacatcaatgtctgtttcctctgagactacaaaaattaagagagagtcaacatattccttgactcctggactgagagagaccagcatttcccaaaatgccagcttttccactgacacaagtattgttctttcagaagtccccactggtactactgctgaggtctccaggacagaagtcacctcctctggtagaacatccatccctggcccttctcagtccacagttttgccagaaatatccacaagaacaatgacaaggctctttgcctcgcccaccatgacagaatcagcagaaatgaccatccccactcaaacaggtccttctgggtctacctcacaggatacccttaccttggacacatccaccacaaagtcccaggcaaagactcattcaactttgactcagagatttccacactcagagatgaccactctcatgagcagaggtcctggagatatgtcatggcaaagctctccctctctggaaaatcccagctctctcccttccctgctgtctttacctgccacaacctcacctcctcccatttcctccacattaccagtgactatctcctcctctcctcttcctgtgacttcacttctcacctctagcccggtaacgaccacagacatgttacacacaagcccagaacttgtaaccagttcacctccaaagctgagccacacttcagatgagagactgaccactggcaaggacaccacaaatacagaagctgtgcatccttccacaaacacagcagcgtccaatgtggagattcccagctctggacatgaatccccttcctctgccttagctgactcagagacatccaaagccacatcaccaatgtttattacctccacccaggaggatacaactgttgccatatcaacccctcacttcttggagactagcagaattcagaaagagtcaatttcctccctgagccctaaattgagggagacaggcagttctgtggagacaagctcagccatagagacaagtgctgtcctttctgaagtgtccattggtgctactactgagatctccaggacagaagtcacctcctctagcagaacatccatctctggttctgctgagtccacaatgttgccagaaatatccaccacaagaaaaatcattaagttccctacttcccccatcctggcagaatcatcagaaatgaccatcaagacccaaacaagtcctcctgggtctacatcagagagtacctttacattagacacatcaaccactccctccttggtaataacccattcgactatgactcagagattgccacactcagagataaccactcttgtgagtagaggtgctggggatgtgccacggcccagctctctccctgtggaagaaacaagccctccatcttcccagctgtctttatctgccatgatctcaccttctcctgtttcttccacattaccagcaagtagccactcctcttctgcttctgtgacttcacttctcacaccaggccaagtgaagactactgaggtgttggacgcaagtgcagaacctgaaaccagttcacctccaagtttgagcagcacctcagttgaaatactggccacctctgaagtcaccacagatacggagaaaattcatcctttctcaaacacggcagtaaccaaagttggaacttccagttctggacatgaatccccttcctctgtcctacctgactcagagacaaccaaagccacatcggcaatgggtaccatctccattatgggggatacaagtgtttctacattaactcctgccttatctaacactaggaaaattcagtcagagccagcttcctcactgaccaccagattgagggagaccagcacctctgaagagaccagcttagccacagaagcaaacactgttctttctaaagtgtccactggtgctactactgaggtctccaggacagaagccatctcctttagcagaacatccatgtcaggccctgagcagtccacaatgtcacaagacatctccataggaaccatccccaggatttctgcctcctctgtcctgacagaatctgcaaaaatgaccatcacaacccaaacaggtccttcggagtctacactagaaagtacccttaatttgaacacagcaaccacaccctcttgggtggaaacccactctatagtaattcagggatttccacacccagagatgaccacttccatgggcagaggtcctggaggtgtgtcatggcctagccctccctttgtgaaagaaaccagccctccatcctccccgctgtctttacctgccgtgacctcacctcatcctgtttccaccacattcctagcacatatccccccctctccccttcctgtgacttcacttctcacctctggcccggcgacaaccacagatatcttgggtacaagcacagaacctggaaccagttcatcttcaagtttgagcaccacctcccatgagagactgaccacttacaaagacactgcacatacagaagccgtgcatccttccacaaacacaggagggaccaatgtggcaaccaccagctctggatataaatcacagtcctctgtcctagctgactcatctccaatgtgtaccacctccaccatgggggatacaagtgttctcacatcaactcctgccttccttgagactaggaggattcagacagagctagcttcctccctgacccctggattgagggagtccagcggctctgaagggaccagctcaggcaccaagatgagcactgtcctctctaaagtgcccactggtgctactactgagatctccaaggaagacgtcacctccatcccaggtcccgctcaatccacaatatcaccagacatctccacaagaaccgtcagctggttctctacatcccctgtcatgacagaatcagcagaaataaccatgaacacccatacaagtcctttaggggccacaacacaaggcaccagtactttggacacgtcaagcacaacctctttgacaatgacacactcaactatatctcaaggattttcacactcacagatgagcactcttatgaggaggggtcctgaggatgtatcatggatgagccctccccttctggaaaaaactagaccttccttttctctgatgtcttcaccagccacaacttcaccttctcctgtttcctccacattaccagagagcatctcttcctctcctcttcctgtgacttcactcctcacgtctggcttggcaaaaactacagatatgttgcacaaaagctcagaacctgtaaccaactcacctgcaaatttgagcagcacctcagttgaaatactggccacctctgaagtcaccacagatacagagaaaactcatccttcttcaaacagaacagtgaccgatgtggggacctccagttctggacatgaatccacttcctttgtcctagctgactcacagacatccaaagtcacatctccaatggttattacctccaccatggaggatacgagtgtctccacatcaactcctggcttttttgagactagcagaattcagacagaaccaacatcctccctgacccttggactgagaaagaccagcagctctgaggggaccagcttagccacagagatgagcactgtcctttctggagtgcccactggtgccactgctgaagtctccaggacagaagtcacctcctctagcagaacatccatctcaggctttgctcagctcacagtgtcaccagagacttccacagaaaccatcaccagactccctacctccagcataatgacagaatcagcagaaatgatgatcaagacacaaacagatcctcctgggtctacaccagagagtactcatactgtggacatatcaacaacacccaactgggtagaaacccactcgactgtgactcagagattttcacactcagagatgaccactcttgtgagcagaagccctggtgatatgttatggcctagtcaatcctctgtggaagaaaccagctctgcctcttccctgctgtctctgcctgccacgacctcaccttctcctgtttcctctacattagtagaggatttcccttccgcttctcttcctgtgacttctcttctcaaccctggcctggtgataaccacagacaggatgggcataagcagagaacctggaaccagttccacttcaaatttgagcagcacctcccatgagagactgaccactttggaagacactgtagatacagaagacatgcagccttccacacacacagcagtgaccaacgtgaggacctccatttctggacatgaatcacaatcttctgtcctatctgactcagagacacccaaagccacatctccaatgggtaccacctacaccatgggggaaacgagtgtttccatatccacttctgacttctttgagaccagcagaattcagatagaaccaacatcctccctgacttctggattgagggagaccagcagctctgagaggatcagctcagccacagagggaagcactgtcctttctgaagtgcccagtggtgctaccactgaggtctccaggacagaagtgatatcctctaggggaacatccatgtcagggcctgatcagttcaccatatcaccagacatctctactgaagcgatcaccaggctttctacttcccccattatgacagaatcagcagaaagtgccatcactattgagacaggttctcctggggctacatcagagggtaccctcaccttggacacctcaacaacaaccttttggtcagggacccactcaactgcatctccaggattttcacactcagagatgaccactcttatgagtagaactcctggagatgtgccatggccgagccttccctctgtggaagaagccagctctgtctcttcctcactgtcttcacctgccatgacctcaacttcttttttctccacattaccagagagcatctcctcctctcctcatcctgtgactgcacttctcacccttggcccagtgaagaccacagacatgttgcgcacaagctcagaacctgaaaccagttcacctccaaatttgagcagcacctcagctgaaatattagccacgtctgaagtcaccaaagatagagagaaaattcatccctcctcaaacacacctgtagtcaatgtagggactgtgatttataaacatctatccccttcctctgttttggctgacttagtgacaacaaaacccacatctccaatggctaccacctccactctggggaatacaagtgtttccacatcaactcctgccttcccagaaactatgatgacacagccaacttcctccctgacttctggattaagggagatcagtacctctcaagagaccagctcagcaacagagagaagtgcttctctttctggaatgcccactggtgctactactaaggtctccagaacagaagccctctccttaggcagaacatccaccccaggtcctgctcaatccacaatatcaccagaaatctccacggaaaccatcactagaatttctactcccctcaccacgacaggatcagcagaaatgaccatcacccccaaaacaggtcattctggggcatcctcacaaggtacctttaccttggacacatcaagcagagcctcctggccaggaactcactcagctgcaactcacagatctccacactcagggatgaccactcctatgagcagaggtcctgaggatgtgtcatggccaagccgcccatcagtggaaaaaactagccctccatcttccctggtgtctttatctgcagtaacctcaccttcgccactttattccacaccatctgagagtagccactcatctcctctccgggtgacttctcttttcacccctgtcatgatgaagaccacagacatgttggacacaagcttggaacctgtgaccacttcacctcccagtatgaatatcacctcagatgagagtctggccacttctaaagccaccatggagacagaggcaattcagctttcagaaaacacagctgtgactcagatgggcaccatcagcgctagacaagaattctattcctcttatccaggcctcccagagccatccaaagtgacatctccagtggtcacctcttccaccataaaagacattgtttctacaaccatacctgcttcctctgagataacaagaattgagatggagtcaacatccaccctgacccccacaccaagggagaccagcacctcccaggagatccactcagccacaaagccaagcactgttccttacaaggcactcactagtgccacgattgaggactccatgacacaagtcatgtcctctagcagaggacctagccctgatcagtccacaatgtcacaagacatatccactgaagtgatcaccaggctctctacctcccccatcaagacagaatctacagaaatgaccattaccacccaaacaggttctcctggggctacatcaaggggtacccttaccttggacacttcaacaacttttatgtcagggacccactcaactgcatctcaaggattttcacactcacagatgaccgctcttatgagtagaactcctggagatgtgccatggctaagccatccctctgtggaagaagccagctctgcctctttctcactgtcttcacctgtcatgacctcatcttctcccgtttcttccacattaccagacagcatccactcttcttcgcttcctgtgacatcacttctcacctcagggctggtgaagaccacagagctgttgggcacaagctcagaacctgaaaccagttcacccccaaatttgagcagcacctcagctgaaatactggccatcactgaagtcactacagatacagagaaactggagatgaccaatgtggtaacctcaggttatacacatgaatctccttcctctgtcctagctgactcagtgacaacaaaggccacatcttcaatgggtatcacctaccccacaggagatacaaatgttctcacatcaacccctgccttctctgacaccagtaggattcaaacaaagtcaaagctctcactgactcctgggttgatggagaccagcatctctgaagagaccagctctgccacagaaaaaagcactgtcctttctagtgtgcccactggtgctactactgaggtctccaggacagaagccatctcttctagcagaacatccatcccaggccctgctcaatccacaatgtcatcagacacctccatggaaaccatcactagaatttctacccccctcacaaggaaagaatcaacagacatggccatcacccccaaaacaggtccttctggggctacctcgcagggtacctttaccttggactcatcaagcacagcctcctggccaggaactcactcagctacaactcagagatttccacagtcagtggtgacaactcctatgagcagaggtcctgaggatgtgtcatggccaagcccgctgtctgtggaaaaaaacagccctccatcttccctggtatcttcatcttcagtaacctcaccttcgccactttattccacaccatctgggagtagccactcctctcctgtccctgtcacttctcttttcacctctatcatgatgaaggccacagacatgttggatgcaagtttggaacctgagaccacttcagctcccaatatgaatatcacctcagatgagagtctggccgcttctaaagccaccacggagacagaggcaattcacgtttttgaaaatacagcagcgtcccatgtggaaaccaccagtgctacagaggaactctattcctcttccccaggcttctcagagccaacaaaagtgatatctccagtggtcacctcttcctctataagagacaacatggtttccacaacaatgcctggctcctctggcattacaaggattgagatagagtcaatgtcatctctgacccctggactgagggagaccagaacctcccaggacatcacctcatccacagagacaagcactgtcctttacaagatgccctctggtgccactcctgaggtctccaggacagaagttatgccctctagcagaacatccattcctggccctgctcagtccacaatgtcactagacatctccgatgaagttgtcaccaggctgtctacctctcccatcatgacagaatctgcagaaataaccatcaccacccaaacaggttattctctggctacatcccaggttacccttcccttgggcacctcaatgacctttttgtcagggacccactcaactatgtctcaaggactttcacactcagagatgaccaatcttatgagcaggggtcctgaaagtctgtcatggacgagccctcgctttgtggaaacaactagatcttcctcttctctgacatcattacctctcacgacctcactttctcctgtgtcctccacattactagacagtagcccctcctctcctcttcctgtgacttcacttatcctcccaggcctggtgaagactacagaagtgttggatacaagctcagagcctaaaaccagttcatctccaaatttgagcagcacctcagttgaaataccggccacctctgaaatcatgacagatacagagaaaattcatccttcctcaaacacagcggtggccaaagtgaggacctccagttctgttcatgaatctcattcctctgtcctagctgactcagaaacaaccataaccataccttcaatgggtatcacctccgctgtggacgataccactgttttcacatcaaatcctgccttctctgagactaggaggattccgacagagccaacattctcattgactcctggattcagggagactagcacctctgaagagaccacctcaatcacagaaacaagtgcagtcctttatggagtgcccactagtgctactactgaagtctccatgacagaaatcatgtcctctaatagaatacacatccctgactctgatcagtccacgatgtctccagacatcatcactgaagtgatcaccaggctctcttcctcatccatgatgtcagaatcaacacaaatgaccatcaccacccaaaaaagttctcctggggctacagcacagagtactcttaccttggccacaacaacagcccccttggcaaggacccactcaactgttcctcctagatttttacactcagagatgacaactcttatgagtaggagtcctgaaaatccatcatggaagagctctctctttgtggaaaaaactagctcttcatcttctctgttgtccttacctgtcacgacctcaccttctgtttcttccacattaccgcagagtatcccttcctcctctttttctgtgacttcactcctcaccccaggcatggtgaagactacagacacaagcacagaacctggaaccagtttatctccaaatctgagtggcacctcagttgaaatactggctgcctctgaagtcaccacagatacagagaaaattcatccttcttcaagcatggcagtgaccaatgtgggaaccaccagttctggacatgaactatattcctctgtttcaatccactcggagccatccaaggctacatacccagtgggtactccctcttccatggctgaaacctctatttccacatcaatgcctgctaattttgagaccacaggatttgaggctgagccattttctcatttgacttctggatttaggaagacaaacatgtccctggacaccagctcagtcacaccaacaaatacaccttcttctcctgggtccactcaccttttacagagttccaagactgatttcacctcttctgcaaaaacatcatccccagactggcctccagcctcacagtatactgaaattccagtggacataatcaccccctttaatgcttctccatctattacggagtccactgggataacctccttcccagaatccaggtttactatgtctgtaacagaaagtactcatcatctgagtacagatttgctgccttcagctgagactatttccactggcacagtgatgccttctctatcagaggccatgacttcatttgccaccactggagttccacgagccatctcaggttcaggtagtccattctctaggacagagtcaggccctggggatgctactctgtccaccattgcagagagcctgccttcatccactcctgtgccattctcctcttcaaccttcactaccactgattcttcaaccatcccagccctccatgagataacttcctcttcagctaccccatatagagtggacaccagtcttgggacagagagcagcactactgaaggacgcttggttatggtcagtactttggacacttcaagccaaccaggcaggacatcttcatcacccattttggataccagaatgacagagagcgttgagctgggaacagtgacaagtgcttatcaagttccttcactctcaacacggttgacaagaactgatggcattatggaacacatcacaaaaatacccaatgaagcagcacacagaggtaccataagaccagtcaaaggccctcagacatccacttcgcctgccagtcctaaaggactacacacaggagggacaaaaagaatggagaccaccaccacagctctgaagaccaccaccacagctctgaagaccacttccagagccaccttgaccaccagtgtctatactcccactttgggaacactgactcccctcaatgcatcaatgcaaatggccagcacaatccccacagaaatgatgatcacaaccccatatgttttccctgatgttccagaaacgacatcctcattggctaccagcctgggagcagaaaccagcacagctcttcccaggacaaccccatctgttttcaatagagaatcagagaccacagcctcactggtctctcgttctggggcagagagaagtccggttattcaaactctagatgtttcttctagtgagccagatacaacagcttcatgggttatccatcctgcagagaccatcccaactgtttccaagacaacccccaattttttccacagtgaattagacactgtatcttccacagccaccagtcatggggcagacgtcagctcagccattccaacaaatatctcacctagtgaactagatgcactgaccccactggtcactatttcggggacagatactagtacaacattcccaacactgactaagtccccacatgaaacagagacaagaaccacatggctcactcatcctgcagagaccagctcaactattcccagaacaatccccaatttttctcatcatgaatcagatgccacaccttcaatagccaccagtcctggggcagaaaccagttcagctattccaattatgactgtctcacctggtgcagaagatctggtgacctcacaggtcactagttctgggacagacagaaatatgactattccaactttgactctttctcctggtgaaccaaagacgatagcctcattagtcacccatcctgaagcacagacaagttcggccattccaacttcaactatctcgcctgctgtatcacggttggtgacctcaatggtcaccagtttggcggcaaagacaagtacaactaatcgagctctgacaaactcccctggtgaaccagctacaacagtttcattggtcacgcatcctgcacagaccagcccaacagttccctggacaacttccatttttttccatagtaaatcagacaccac

SEQ ID NO: 5077 - DNA, 1341 bp, Homo sapiens
acagctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggcctgagaagaatggggcagccactggaatggatgccatctgcagccaccgtcttgaccccaaaagccctggactcaacagagagcagctgtactgggagctgagccagctgacccatggcatcaaagagctgggcccctacaccctggacaggaacagtctctatgtcaatggtttcacccatcggagctctgtggcccccaccagcactcctgggacctccacagtggaccttgggacctcagggactccatcctccctccccagccccacaacagctgttcctctcctggtgccgttcaccctcaactttaccatcaccaatctgcagtatggggaggacatgcgtcaccctggctccaggaagttcaacaccacagagagggtcctgcagggtctgcttggtcccttgttcaagaactccagtgtcggccctctgtactctggctgcagactgatctctctcaggtctgagaaggatggggcagccactggagtggatgccatctgcacccaccaccttaaccctcaaagccctggactggacagggagcagctgtactggcagctgagccagatgaccaatggcatcaaagagctgggcccctacaccctggaccggaacagtctctacgtcaatggtttcacccatcggagctctgggctcaccaccagcaccaccggccctctcctggtgccattcacactcaacttcaccatcactaacctacagtatgaggagaacatgggtcaccctggctccaggaagttcaacatcacggagagtgttctgcagggtctgctcaagcccttgttcaagagcaccagtgttggccctctgtattctggctgcagactgaccttgctcaggcctgagaaggatggagtagccaccagagtggacgccatctgcacccaccgccctgaccccaaaatccctgggctagacagacagcagctatactgggagctgagccagctgacccacagcatcactgagctgggaccctacaccctggatagggacagtctctatgtcaatggtttcacccagcggagctctgtgcccaccaccagcactcctgggactttcacagtacagccggaaacctctgagactccatcatccctccctggccccaca

SEQ ID NO: 5078 - DNA, 6019 bp, Homo sapiens
aaaaaagaagaaaaataagaagccaaactgtggagcaatttgggggctccccccaaccatgccatctgcctacaaggcttaccctggcactggctggcctttgggtctttttgtgcaactttattttctatcaaggcccagggggtttgccccttgtctctctgcctctttgacctatccttcctttggaacccaggcatctaaatgacaacttctatgtgcatcatttagagatgagaagaggaaatatctctcctgctttctggttcctgtggctgcttctctttggacttctgggacccagctctgagaataccacagccttcacaaaaggctccgacaccaccacagcctccatcacaggctctgagaccaccatggcctccaccatggcctctacttcggccttaactacaggctctaagatcaccacagactctaccacaggctctgagacaacctcagcctccaccatggcttctactgcagccttcaccacaggctctgagaccaacacggcctccaccacagactcagggactactatagcctccactaggaccttcaccacaggctctgacacaaccacaggctccactgcaggctctgaaactatcgtggcctccaccacagtctctgggaccacaacaacctttactatagcctccactacagtccctgagactaccatggcctccagcacaacctccactgcaggctctgagaaaacgatggcctcctccataatttctgagaccaccatggcctccaccacaggctctgagactgccacagtctctaccacaggctctgagaccaccaccacctccactgcaagctctgaggccactaaagtctctaccacaggctctgaaaccaccacagcatctactgcaggttctgagaccaccactacctccacctccatggcaggctctgaggccaccacaacctcaactgcagactccaaggtgatcacggcatccagcatgagctctgagaccactgtggcccccgctgcaggctctaacaccaccacagcctctaccacaggctctgagaccactacaatcctgattaaagcctctgagaccaccacagcctctacagcaggttctgagaccaccaccccctcccccacaggctctcagaccaccatagtctctatttcaggttctgagatcaccaccacctctacggcaggatccgagaacaccacagtctctagtgcaggctctgggaccaccacagcttctatggcaggctctgagaccaccgtctccactgcaggctctgagaccactacagtctctatcacaggcactgagaccaccatggtctctgccatgggctcagagaccaccacaaactctactacaagctctgagaccaccgtcacctctactgcaggctctgagaccaccacagtctccaccgtgggctctgagaccaccacagcctatactgcagattctgagaccactgcagcctctaccacaggctctgagatgaccacagtcttcactgcaggctcggaaaccatcacaccctctactgcaggctcagagaccaccacagtctctactgcaggctctgagaccactacagtctccaccacaggctctgagaccacaacagcctctactgcacattctgagacgactgcagcctccaccatgggctctgagaccaccaaagtctcaactgcaggctctgagaccacagtctccactgcaggctctgagaccactgcagcctctactgaagattctgaaaccaacacagcatttactgaagattctaagactaccacagcctctactacagggtttgagacaaccgcagcctctactacaggctctgagcctaccatggcatccaccatgggctctgagaccactatggcctctaccataggccctgagaccaccaaggtctccactgcaagctctgaggtgaccacagtctttgctgcaggctctgagacaatcagagcctctaccgtaggctctgagaccaccacagtctctaccacaggctctgagaccaccacagcctccatcatgggctctgagaccagcacagattctaccacaggctctgagaccaccacagcctctactgaaggctctgagaccaccacagcttccactgaaggctctgaggccactacagtctccaccacaggctctgagaccactacagtttctatcacagactcagagaccaccaccacctgtactgaaggctctgagatgactgcagtctccaccacagtctttgagaccactacagcctctactgaaggctctgagatcacaatagcctctacttcagactctgagaccaccacagcttctactgaaggttctgagaccactacagtcactaccgcaggctctgagaccaaaacagcctatactacaggctctgagaccaccacagcctctaatacaggcttggagaccaccacagtctttaccataggctctgacaccaccacagcctctactgaaggctctgagaccactgcagtctctgccacaggctctgagatgaccacagtctctactgaaggctctgagaacactacagtctccaccacaggctctgagaccactacagtttccaccacaggcttggagaccaccaccacttccactgaaggctctgagatgactacagtctccaccacaggtgctgagaccaccacagactctactgaaggctctgggaccactgcagcctccactgcaggctctgagaccaccacagtctctactgcagattctgagaacaccacagcatctactgcagattctgagaccacctcagcctctactacaggctctgagaccaccacagcctctactacaagctctgagaccaccacagcctctactgaaggctctgagaccactacagtctccaccacagactctgagaccaccatggtctctaccacaggctctgagaggaccatcacctctactgaaggctctgagaccactacagtatctgccacaggctctgagaccacagtctctactgaaggctctgggaccactacagtctccatcacaggctctgagaccactaaagtttctaccacaggttcagagaccaccaccacttctactgaaggctctgagattactacagcctccatcacaggctctgagaccaccacagcctctactgaaggctccgagaccaccacagcctctactgaaggctccgagaccacctcagcctctactacaggctctgagaccaccacagcctctactacaagctctgagaccaccatggcatccatcatgggctctgagaccactatggcctctaccataggctctgagaccaccaaggtctccactgcaagctctaaaatgaccacagtcttcactgaaaactctgagaccaccatagcctctaccacagcctctgagaccaccacagtctccactgcaggctctgagaccatcccagcctctacagcaggctctgagaccaccaccaccacctctactgaaggctctgagaccactacagcctctactgaaggctctgagaccaccacagcctctactgaaagctctgagaccactacagccactaccataggctctgagaccaccacagcctctactgaaggctctgagactaccaccacctctactgaaggctctgagaccaccacagcctctactgaaggctctgagatcactacagtttctaccacaggctctgagaccaccacagcctctactgaaggctctgagaccaccacagcctctactgaaggctctgagctcactacagtttctaccacaggctctgagaccatcacagtctctgctgaaggctctgagaccactacagtcactactatgggctctgagaccaccacggcctctactgcaggctcagagaccaccacagtctctactgcaggctctgagaccaccacagcctctattgaaggctctgagaccactacagtctcctccacaggctctgagaccaccacagtctctaccacaggcactgagactaccatcacctctactgaaggttcagagaccactacagtcactactgcaggttctgagaccacagcagtctataccacaggctctgagactaccaccacctctactgaaggctctgagacaaccacagtctctaccacgggctctgagaccaccacagcctctaccgcagatttggagaccaccacagtctccacctcaggctctgggaccaccacagcctctaccgcaggctctgagaccacaacagtctatatcacaggctctaagactaccaccgcctctactgaaggctctgaggccactacagtttctaccactagctctgagaccaccacagcctctaccacaggctctgagatgactacagtctttaccacagtctctgagaccaccacagtctctaccataggctctgaggccaccacatcctctgctgcaggctctgaggccaccaccacctctactgaaggctctgagaccaccacagcctccactgcaggctctgagaccaccacagcctccactgcaggctctgagaccaccacagcctccacttcaggctctgagaccaacacagcctgtaccacaggttctgagacctccacaccctccagtgcaggctctgagaccaacactgccttcatcataggctctgagagcaccatagcttccactgcaagcttggagcccactgcaacttccctcacaggctctgagaccaccacagtctctatcacagcttctggggccactgcagcctccaccactgtctcttccaccacgtttgtactcaccaaggccactgacgtttctatccagcccatcaccaacacacctatgtcaggcaccagaaccactggaaccagactcactgcctccagctctgtcaccatggcccctggaatggacttcacggcctctgctgccagccatactgtgccaggaatagtcttaaacacctctggcctgggtacatccactatgggagcatcatctaccacctcagcccacggcgtcaggaccaccacaggatccacccgtgagccaaccagcagcaccttccaggaaacaggcccggtgtccatgggcacaaacacagttagcatgagccacacacccacaaacgtgatcaaaccaagtggatatttacagccctgggctatcatcctcatttccctggctgcagttgtggctgctgttggattgtcagtaggactgagtttttgtctgagaaaccttttcttccccctgagatattgtggtatttattacccccatggccacagccacagccttggtctggacctgaacttgggcctgggctctgggacattccacagcctgggaaatgcactggttcatggaggagaacttgaaatgggacatggaggaacacacggctttggatatggagtgggccatggactgagccacatccatggagatggctacggagtgaatcatggcgggcattatggacatggaggaggccactgaggacaccatggagtggatcacagagggagccaccaaggaggccacggcaggacaagatggctgtggccatagattgggtatcaaaacatattatgggtgggagggggtcatggaggagaaaaaaataatgatcatgaaataattaaaatggagcataggaagcttcccaggatgtgatccatggagatggacatggactaggtcaagaaaagaaccagcaaaaggacctcagagactttgactggcttggaggggacttcaagtcaaagcttctgtgagtttttcctgagtctcagcctctgttgtggggagtcacgacaaccaccctcaggacatcttctctcccatttcccgccacatcagggtcaacgtttctcatccctgtgtttcctcatggtgctataaatattaccaagacatgtctaagaaacaaaagcacataatgaatgtattatcagggccac

SEQ ID NO: 5079 - DNA, 3651 bp, Homo sapiens
agagaaagaggcaactacattgcctggaggaagcctaaggaacccaggcatccagctgcccacgcctgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagcgtccagtgggatcagcatagccaccaactctgagtccagcacaacctccagtggggccagcacagccaccaactctgagtccagcacaccctccagtggggccagcacagccaccaactctgactccagcacaacctccagtggggctagcacagccaccaactctgactccagcacaacctccagtgaggccagcacagccaccaactctgagtccagcacaacctccagtggggccagcacagccaccaactctgagtccagcacagtgtccagtagggccagcactgccaccaactctgagtccagcacaacctccagtggggccagcacagccaccaactctgagtccagaacgacctccaatggggctggcacagccaccaactctgagtccagcacgacctccagtggggccagcacagccaccaactctgagtccagcacaccctccagtggggccggcacagccaccaactctgagtccagcacgacctccagtggggccggcacagccaccaactctgagtccagcacagtgtccagtgggatcagcacagtcaccaattctgagtccagcacaccctccagtggggccaacacagccaccaactctgagtccagtacgacctccagtggggccaacacagccaccaactctgactccagcacaacctccagtggggccagcacagccaccaactctgagtccagcacgacctccagtggggccagcacagccaccaactctgagtccagcacaacctccagtggggccagcacagccaccaactctgggtccagcacgacctccagtgggaccagcacagccaccaactctgagtccagcacagtgtccagtggggccagcacagccaccacctctgagtccagcacgacctccagtggggccagcacagccaccaactctgagtccagcacagtgtccagtggggccagcactgccaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcgaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcctcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcgtgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattgacttgggagagataaggagggagggcgggtgccagcatgctatgggctcctgcgtgaggcctgtggtacacagagattaggttgtgatacatgaagagccaagagcaggatgaggtggaggcgttacaactacctgctctgtgtgtggggggggaggggggaggggggtacgcatattcacttgaagtcgaggttcccagggcatttccatgtgctccaggcctgactacccatcagggtggaggagctggtgacactcatctccctgagtgctccctggtttcccaagggaaagactttctggcctgctgaggtcgaatcttccaagaggctcttgcaaagacccgagattctcataaatccccgcccagaagagctgcacgtatccctttcatgagtccagggaagagggtcctccaggtcttggaagacagaggggagctgctttagaggctaagttgctttgagcccacaaggtaatggagggctcctacttgggacagagccctcagcagagaattagcagtctgttggtgggttcaccccaactcacagcagtagaaactgctccatcttccaccacttattgggtttctccagtgtcagcaaaccaaagaattggatcttaccaatgcggctataggaaaacagcctgttgcatggtaagagtgataccatcttgaagtgaaaccaccacaatggccattttttttttagatggagttttgcagtggtgcaatcatagctcattgcagccttcaattcctgggctcaggcaatcctcctgcctcagcctcctgagtagctgggactacagtttcgtgtgccaccatgcctggctaatttttagaattttttgtagggacagggcctcactctgttgcacaagctggtcttgaactcctggcctccttgaactcctcctgccttggcctcccaaaatgctgagattacaggtgtgagccactgcacctcgccagatgtccaatgtctgactcctgcataccaaggtgttctgtatcaagggctttaaaacaatgcctgtagcgtaattaacctctcacaaagatgcttatctaacctccccagcagtcatgggtttcagcaagaaagtctgtgatgtgaccagttgcacatgttttcccctaaaagcttactctagaaaggatattttttggagagggagtgtgggaatccaccatcttgtggccacctcagacatcacttctctttggaagactccattaaatatttctctgtgagaaa

SEQ ID NO: 5080 - DNA, 3651 bp, Homo sapiens; identical to SEQ ID NO: 5079

SEQ ID NO: 5081 - DNA, 3651 bp, Homo sapiens
agagaaagaggcaactacattgcctggaggaagcctaaggaacccaggcatccagctgcccacgcccgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagcgtccagtgggatcagcatagccaccaactctgagtccagcacaacctccagtggggccagcacagccaccaactctgagtccagcacaccctccagtggggccagcacagccaccaactctgactccagcacaacctccagtggggctagcacagccaccaactctgactccagcacaacctccagtgaggccagcacagccaccaactctgagtccagcacaacctccagtggggccagcacagccaccaactctgagtccagcacagtgtccagtagggccagcactgccaccaactctgagtccagcacaacctccagtggggccagcacagccaccaactctgagtccagaacgacctccaatggggctggcacagccaccaactctgagtccagcacgacctccagtggggccagcacagccaccaactctgagtccagcacaccctccagtggggccggcacagccaccaactctgagtccagcacgacctccagtggggccggcacagccaccaactctgagtccagcacagtgtccagtgggatcagcacagtcaccaattctgagtccagcacaccctccagtggggccaacacagccaccaactctgagtccagtacaacctccagtggggccaacacagccaccaactctgactccagcacaacctccagtggggccagcacagccaccaactctgagtccagcacgacctccagtggggccagcacagccaccaactctgagtccagcacaacctccagtggggccagcacagccaccaactctgggtccagcacgacctccagtgggaccagcacagccaccaactctgagtccagcacagtgtccagtggggccagcacagccaccacctctgagtccagcacgacctccagtggggccagcacagccaccaactctgagtccagcacagtgtccagtggggccagcactgccaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcgaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcctcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcgtgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattgacttgggagagataaggagggagggcgggtgccagcatgctatgggctcctgcgtgaggcctgtggtacacagagattaggttgtgatacatgaagagccaagagcaggatgaggtggaggcgttacaactacctgctctgtgtgtggggggggaggggggaggggggtacgcatattcacttgaagtcgaggttcccagggcatttccatgtgctccaggcctgactacccatcagggtggaggagctggtgacactcatctccctgagtgctccctggtttcccaagggaaagactttctggcctgctgaggtcgaatcttccaagaggctcttgcaaagacccgagattctcataaatccccgcccagaagagctgcacgtatccctttcatgagtccagggaagagggtcctccaggtcttggaagacagaggggagctgctttagaggctaagttgctttgagcccacaaggtaatggagggctcctacttgggacagagccctcagcagagaattagcagtctgttggtgggttcaccccaactcacagcagtagaaactgctccatcttccaccacttattgggtttctccagtgtcagcaaaccaaagaattggatcttaccaatgcggctataggaaaacagcctgttgcatggtaagagtgataccatcttgaagtgaaaccaccacaatggccattttttttttagatggagttttgcagtggtgcaatcatagctcattgcagccttcaattcctgggctcaggcaatcctcctgcctcagcctcctgagtagctgggactacagtttcgtgtgccaccatgcctggctaatttttagaattttttgtagggacagggcctcactctgttgcacaagctggtcttgaactcctggcctccttgaactcctcctgccttggcctcccaaaatgctgagattacaggtgtgagccactgcacctcgccagatgtccaatgtctgactcctgcataccaaggtgttctgtatcaagggctttaaaacaatgcctgtagcgtaattaacctctcacaaagatgcttatctaacctccccagcagtcatgggtttcagcaagaaagtctgtgatgtgaccagttgcacatgttttcccctaaaagcttactctagaaaggatattttttggagagggagtgtgggaatccaccatcctgtggccacctcagacatcacttctctttggaagactccattaaatatttctctgtgagaaa

SEQ ID NO: 5082 - DNA, 3206 bp, Homo sapiens
ctttcacaacagagaaagaggcaactacattgcctggaggaagcctaaggaacccaggcatccagctgcccacgcctgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagcgtccagtgggatcagcatagccaccaactctgagtccagcacaacctccagtggggccagcacagccaccaactctgagtccagcacaccctccagtggggccagcacagccaccaactctgactccagcacaacctccagtggggctagcacagccaccaactctgactccagcacaacctccagtgaggccagcacagccaccaactctgagtccagcacaacctccagtggggccagcacagccaccaactctgagtccagcacgacctccagtggggccagcacagccaccaactctgagtccagcacaacctccagtggggccagcacagccaccaactctgggtccagcacgacctccagtgggaccagcacagccaccaactctgagtccagcacagtgtccagtggggccagcacagccaccacctctgagtccagcacgacctccagtggggccagcacagccaccaactctgagtccagcacagtgtccagtggggccagcactgccaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcgaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcctcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcgtgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattgacttgggagagataaggagggagggcgggtgccagcatgctatgggctcctgcgtgaggcctgtggtacacagagattaggttgtgatacatgaagagccaagagcaggatgaggtggaggcgttacaactacctgctctgtgtgtggggggggaggggggaggggggtacgcatattcacttgaagtcgaggttcccagggcatttccatgtgctccaggcctgactacccatcagggtggaggagctggtgacactcatctccctgagtgctccctggtttcccaagggaaagactttctggcctgctgaggtcgaatcttccaagaggctcttgcaaagacccgagattctcataaatccccgcccagaagagctgcacgtatccctttcatgagtccagggaagagggtcctccaggtcttggaagacagaggggagctgctttagaggctaagttgctttgagcccacaaggtaatggagggctcctacttgggacagagccctcagcagagaattagcagtctgttggtgggttcaccccaactcacagcagtagaaactgctccatcttccaccacttattgggtttctccagtgtcagcaaaccaaagaattggatcttaccaatgcggctataggaaaacagcctgttgcatggtaagagtgataccatcttgaagtgaaaccaccacaatggccattttttttttagatggagttttgcagtggtgcaatcatagctcattgcagccttcaattcctgggctcaggcaatcctcctgcctcagcctcctgagtagctgggactacagtttcgtgtgccaccatgcctggctaatttttagaattttttgtagggacagggcctcactctgttgcacaagctggtcttgaactcctggcctccttgaactcctcctgccttggcctcccaaaatgctgagattacaggtgtgagccactgcacctcgccagatgtccaatgtctgactcctgcataccaaggtgttctgtatcaagggctttaaaacaatgcctgtagcgtaattaacctctcacaaagatgcttatctaacctccccagcagtcatgggtttcagcaagaaagtctgtgatgtgaccagttgcacatgttttcccctaaaagcttactctagaaaggatattttttggagagggagtgtgggaatccaccatcttgtggccacctcagacatcacttctctttggaagactccattaaatatttctctgtg

SEQ ID NO: 5083 - DNA, 3206 bp, Homo sapiens
ctttcacaacagagaaagaggcaactacattgcctggaggaagcctaaggaacccaggcatccagctgcccacgcccgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagcgtccagtgggatcagcatagccaccaactctgagtccagcacaacctccagtggggccagcacagccaccaactctgagtccagcacaccctccagtggggccagcacagccaccaactctgactccagcacaacctccagtggggctagcacagccaccaactctgactccagcacaacctccagtgaggccagcacagccaccaactctgagtccagcacaacctccagtggggccagcacagccaccaactctgagtccagcacgacctccagtggggccagcacagccaccaactctgagtccagcacaacctccagtggggccagcacagccaccaactctgggtccagcacgacctccagtgggaccagcacagccaccaactctgagtccagcacagtgtccagtggggccagcacagccaccacctctgagtccagcacgacctccagtggggccagcacagccaccaactctgagtccagcacagtgtccagtggggccagcactgccaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcgaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcctcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcgtgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattgacttgggagagataaggagggagggcgggtgccagcatgctatgggctcctgcgtgaggcctgtggtacacagagattaggttgtgatacatgaagagccaagagcaggatgaggtggaggcgttacaactacctgctctgtgtgtggggggggaggggggaggggggtacgcatattcacttgaagtcgaggttcccagggcatttccatgtgctccaggcctgactacccatcagggtggaggagctggtgacactcatctccctgagtgctccctggtttcccaagggaaagactttctggcctgctgaggtcgaatcttccaagaggctcttgcaaagacccgagattctcataaatccccgcccagaagagctgcacgtatccctttcatgagtccagggaagagggtcctccaggtcttggaagacagaggggagctgctttagaggctaagttgctttgagcccacaaggtaatggagggctcctacttgggacagagccctcagcagagaattagcagtctgttggtgggttcaccccaactcacagcagtagaaactgctccatcttccaccacttattgggtttctccagtgtcagcaaaccaaagaattggatcttaccaatgcggctataggaaaacagcctgttgcatggtaagagtgataccatcttgaagtgaaaccaccacaatggccattttttttttagatggagttttgcagtggtgcaatcatagctcattgcagccttcaattcctgggctcaggcaatcctcctgcctcagcctcctgagtagctgggactacagtttcgtgtgccaccatgcctggctaatttttagaattttttgtagggacagggcctcactctgttgcacaagctggtcttgaactcctggcctccttgaactcctcctgccttggcctcccaaaatgctgagattacaggtgtgagccactgcacctcgccagatgtccaatgtctgactcctgcataccaaggtgttctgtatcaagggctttaaaacaatgcctgtagcgtaattaacctctcacaaagatgcttatctaacctccccagcagtcatgggtttcagcaagaaagtctgtgatgtgaccagttgcacatgttttcccctaaaagcttactctagaaaggatattttttggagagggagtgtgggaatccaccatcctgtggccacctcagacatcacttctctttggaagactccattaaatatttctctgtg

SEQ ID NO: 5084 - DNA, 3206 bp, Homo sapiens; identical to SEQ ID NO: 5082

SEQ ID NO: 5085 - DNA, 616 bp, Homo sapiens
actgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 5086 - DNA, 2236 bp, Homo sapiens
gtgatagaaatcatatagaaatacagaaaattgcttgatatttcccccactcttttttttttgagacagagtcttgctctgtcaccaggctggagtgcagtggcacaatcttggctcactgcaacctccacctcccgggttgggtttcaagtgattctcctgcctcagcctcccgagtagctgggactataggcgtgtgccaccatgcctggctaatttttgtatttttagtagagacagggtttcaccatgatggccaggatggtcttgatctcttgacctcgtgatccacccgcctcggcctcccaaagtgctgggattacaggtgtgagccaccgcgcccggccctgatagccgatgaggtttttttgtcattgttcttcttgtatcattacagactcatggccttttatagctatatttctctttctcccgactctgtacaaactcctttgttttagagtttgcacaaccctctatcaaagcacctaccacctcacttttaaatcttctgcatgtatttctgtcttccttcctagactgtgagcacatctgggacagggaccatatctttttttgtttatttgttttgttttgagacagagtctcgctctgtcggccaggctggagtgcaatggcgtgatctggctataacctccacctcccgggttcaagagattctcctgcctcagcctcccaagtagctggaattacatgtgcatgccaccaagcccagttaattttttgtattttgagtagagacagggtttcaccatgttggtgaggctgatctcgaactcctgacctcaggtgatctacccacctcagcctcccaaagtgctgggattacaggcatgagccactgtgcctggccaggaccatatcttaattgtctttgtagtttcagtgtttggtacagtgcctctcactgtttctttttgcctttgagatcttccctctttgttactgtgatcttccctactggtctttgttcttctgagtctgtccctatcaccacctcaacccgagctggatgtggcctgtcctcctttttgtgtttctctcacagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttg

SEQ ID NO: 5087 - DNA, 1636 bp, Homo sapiens
actgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 5088 - DNA, 2239 bp, Homo sapiens
gcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccagcaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttg

SEQ ID NO: 5089 - DNA, 694 bp, Homo sapiens
gcgccggcgcgctccttttgcaggctcgtggcggtcggtcagcggggcgttctcccacctgtagcgactcagggccctcagaccccttccttccaaaggagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaaga

SEQ ID NO: 5090 - DNA, 1000 bp, Homo sapiens
aaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtatacttatctcctcaggtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctggggg

SEQ ID NO: 5091 - DNA, 616 bp, Homo sapiens; identical to SEQ ID NO: 5085

SEQ ID NO: 5092 - DNA, 2260 bp, Homo sapiens
gcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttg

SEQ ID NO: 5093 - DNA, 2704 bp, Homo sapiens
gtgatagaaatcatatagaaatacagaaaattgcttgatatttcccccactcttttttttttgagacagagtcttgctctgtcaccaggctggagtgcagtggcacaatcttggctcactgcaacctccacctcccgggttgggtttcaagtgattctcctgcctcagcctcccgagtagctgggactataggcgtgtgccaccatgcctggctaatttttgtatttttagtagagacagggtttcaccatgatggccaggatggtcttgatctcttgacctcgtgatccacccgcctcggcctcccaaagtgctgggattacaggtgtgagccaccgcgcccggccctgatagccgatgaggtttttttgtcattgttcttcttgtatcattacagactcatggccttttatagctatatttctctttctcccgactctgtacaaactcctttgttttagagtttgcacaaccctctatcaaagcacctaccacctcacttttaaatcttctgcatgtatttctgtcttccttcctagactgtgagcacatctgggacagggaccatatctttttttgtttatttgttttgttttgagacagagtctcgctctgtcggccaggctggagtgcaatggcgtgatctggctataacctccacctcccgggttcaagagattctcctgcctcagcctcccaagtagctggaattacatgtgcatgccaccaagcccagttaatttttgtattttgagtagagacagggtttcaccatgttggtgaggctgatctcgaactcctgacctcaggtgatctacccacctcagcctcccaaagtgctgggattacaggcatgagccactgtgcctggccaggaccatatcttaattgtctttgtagtttcagtgtttggtacagtgcctctcactgtttctttttgcctttgagatcttccctctttgttactgtgatcttccctactggtctttgttcttctgagtctgtccctatcaccacctcaacccgagctggatgtggcctgtcctcctttttgtgtttctctcacagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 5094 - DNA, 405 bp, Homo sapiens
ggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttg

SEQ ID NO: 5095 - DNA, 1639 bp, Homo sapiens
actgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccagcaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 5096 - DNA, 694 bp, Homo sapiens; identical to SEQ ID NO: 5089

SEQ ID NO: 5097 - DNA, 1549 bp, Homo sapiens
actgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccagcaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 5098 - DNA, 195 bp, Homo sapiens
actgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttg

SEQ ID NO: 5099 - DNA, 575 bp, Homo sapiens
attgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatggtaagaccctcaacctctgtaaggtgagtgatgaggaaaatgagtcagcagctgaggaagagcgttactctacagcagcactgcccaatatgggatctctcctctgtagttttactctgagctttaccagcactgagacaaaggaaagagaagtcagagttaggggctggaggtggggttagaaagatggggaaggagaggaggaccaagagatgcaaagtccacagctttgaacccctgtacccagtttctct

SEQ ID NO: 5100 - DNA, 1636 bp, Homo sapiens; identical to SEQ ID NO: 5087

SEQ ID NO: 5101 - DNA, 545 bp, Homo sapiens
cacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacaatcccctcccaggttcgagcacttggagggctgctgaagttcctgggtcgaagaagaatcggggttgaactggaagactataatgtcagcgtccccatcctgggctttaagaaatttatgttgactcatctggtgaacatagatcaagacacttacaggaatcctcaacagatgccactgtaagtggggagagaagctgctcaggctatggttcacacgtccgactcatgacctgggggagctcagttctc

SEQ ID NO: 5102 - DNA, 475 bp, Homo sapiens
actgtgtacagtgccctgggcctgagggatgcctgccgctccctgccgcagtccatccagctctttcgggacattgcccaagagttctctgatgacctgcaccatatcgccagcctcattgggaaagtatacttatctcctcaggtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctggggg

SEQ ID NO: 5103 - DNA, 2290 bp, Homo sapiens
gcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacacccccaggagatttaagatttaccccgattccactgctgatcccctcccaggttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccagcaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttg

SEQ ID NO: 5104 - DNA, 2415 bp, Homo sapiens
cgctccttttgcaggctcgtggcggtcggtcagcggggcgttctcccacctgtagcgactcaggttactgaaaaggcgggaaaacgctgcgatggcggcagctgggggaggaggaagataagcgcgtgaggctggggtcctggcgcgtggttggcagaggcagagacataagacgtgcacgactcgccccacagggccctcagaccccttccttccaaaggagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttg

SEQ ID NO: 5105 - DNA, 1546 bp, Homo sapiens
actgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 5106 - DNA, 944 bp, Homo sapiens
cttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacaggctggagtgcaatggtgcgatctcggctcaatgcaacctctgcctcctgggttcaagcgattctcctgcctcagcctcctgagtaactgggattacaggcacctgccaccacgcccagctaatttttgtatttttagtagagacggggtttcaccatgttgcccaggctggtcttgaactcctgacctca

SEQ ID NO: 5107 - DNA, 792 bp, Homo sapiens
cactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttggattggccaagggtttcaggacaggaaggaggtgattga

SEQ ID NO: 5108 - DNA, 786 bp, Homo sapiens
gttcgggagcccgcggccctcccggccgccctgcttgcgagaggagcccaggccgcccgccctcgcgcctcgccggcccctcccccggtcgccgcggctgccgcgccgccgctgcaggatagctagcggccaggagaaatacagtggaaaatgcaaaacaacgaaattataaagcctgccaaatacttctcagaattggaaaagagcatcctgctggctttagtagaaaagtataaatatgtgctggaatgtaagaaaagtgatgcgcgaactattgcccttaagcagcgtacctggcaggcgctggcccacgaatacaactctcagcccagcgtgtccctgcgggatttcaaacagctgaagaagtgctgggagaacatcaaggctcggaccaaaaaaattatggcccatgaaaggagagagaaagtgaaacggagcgtcagccctctcctgagtacccacgtcctagggaaggagaagatcgccagcatgctgccggagcagctctacttcctgcagagccccccggaggaggagcccgaataccaccccgacgcctcagcccaagttttctttcaagaaagaaaaagaagcctggaattgtcaatcatcctttctgggacttggtaggaaaaagaatcatttgctgtttcaaatagagaactgtgcgatgatgagaaagagttcatacattttccagtatgtgaggggacctctcaacctgaaccctcgtgttcagctgtcagaataacagccaataaaaactacaggagcaaaacctctcag

SEQ ID NO: 5109 - DNA, 2282 bp, Homo sapiens
cagcagaaccctgtgaaccccaggcaatgacagcaggatcctgaagcccatgcaggctctgaaccacgcggccatccagaaggggctgcaggcacctgccactaccgcagaggactgaggggccttggcccagcagggaccccagggccttgggggactgtgtgagctggaaacgtggctggccagatgggcagcaccatggagccccctgggggtgcgtacctgcacctgggcgccgtgacatcccctgtgggcacagcccgcgtgctgcagctggcctttggctgcactaccttcagcctggtggcccaccggggtggctttgcgggcgtccagggcaccttctgcatggccgcctggggcttctgcttcgccgtctctgcgctggtggtggcctgtgagttcacacggctccacggctgcctgcggctctcctggggcaacttcaccgccgccttcgccatgctggccaccctgctatgcgcgacggctgcggtcctgtatccgctgtactttgcccggcgggagtgttcccccgagcccgccggctgtgctgccagggacttccgcctggcagccagtgtcttcgccgggctcctcttcctggcctacgctgtggaggtggccctgacgcgggcccggcccggccaggtgagcagctatatggccacggtgtcggggctcctcaagatcgtccaggccttcgtggcctgcatcatcttcggggcgctggtccatgacagccgctacgggcgctacgtggccacccagtggtgcgtggccgtctacagcctgtgcttcctggccacagtggccgtggtggccctgagtgtgatgggccacacagggggcctgggctgcccctttgaccggctggtggtggtgtacaccttcctggctgtgctcctgtacctcagcgccgccgtgatctggccagtcttctgtttcgatcccaagtacggtgagcccaaacggccccccaactgtgctcggggcagctgtccctgggacagccagctggtggtggccatcttcacctacgtcaacctgctcctgtacgtcgttgacctcgcctactcccagaggattcgcttcgtgcccagcctgtagcccacagtggcagcccacccacctctgctctctggccaccagctccaggctctgcgagggaaactcaggtgaaccaaagtgtcaagtagcgagcaggagggaagccgcgggctcaggggagatgaagtacaacgggagaggtcactccccgacttccagactgggctcagagggacaagggcaggacagtagggcagaggccctgagcagacgcaggggagagcctcacctaggccaatccccaactcactctctctcaccatttcccagcgctcctggggctcagtgctggtcactggaacatcataagggaaaactttaaagcagctgctgttgtgacccattttgcagctggggacatggaggctagaagcatttgcgaggcacccagtacctccattagtgtctggagaccacagtcaggctgggtaaggcaagctgaaagaggaatgacttccagaggagacgaacccaggagagtagctgggccaggcaaggggagggaggggcgtggggagccggaaccactcctggttcagagaggcagctcccagaaccctgggaagagagccctgcctggggagctgtgccagctcacagagaaggagccagaaatctggaccagcctctcccacccacgtccgggaagcctctgggctggtagccacagtgtttggaagcaggcttcctccggagtctccgcaggctggaggtggcgcgggtggcctggaagagcctgcagagcccggcggcaccgagtgcacagtggacggggaggacctggttccgccatagccacggagccccacctggacactcaccattggctgtgacgaagcagcttcagcagtgcccggcgggcatctgtgcactgtgggcatctgtggcactgggagggagcccggctgagggcggccgctggacacagaatctgggtactgcttgcctctgctcaagggtccagttgccgaaactcctgacgccggggccatcatcctccaggctccagccagcttctcctgcacagaagcccagcctggtccagccaggagctgacccactggccacccctgagtccaagccgggtgggcagtggcacaacagcccctcagcccattgactgggccccattgacgtccttgagcaggaaataaatgctgacatttatacgt

SEQ ID NO: 5110 - DNA, 2452 bp, Homo sapiens
cttcagatgccagtcccaagtacagctgtccctttgtatccttgggggatgggatccagtacctccaaaacaccagaatccacaaggccagagtccctgatacaaaatggcatgttatttgcatataaccccctcctctggacttaaatcacctcttgattacttataacacctgaaccctgtgaaccccaggcaatgacagcaggatcctgaagcccatgcaggctctgaaccacgcggccatccagaaggggctgcaggcacctgccactaccgcagaggactgaggggccttggcccagcagggaccccagggccttgggggactgtgtgagctggaaacgtggctggccagatgggcagcaccatggagccccctgggggtgcgtacctgcacctgggcgccgtgacatcccctgtgggcacagcccgcgtgctgcagctggcctttggctgcactaccttcagcctggtggcccaccggggtggctttgcgggcgtccagggcaccttctgcatggccgcctggggcttctgcttcgccgtctctgcgctggtggtggcctgtgagttcacacggctccacggctgcctgcggctctcctggggcaacttcaccgccgccttcgccatgctggccaccctgctatgcgcgacggctgcggtcctgtatccgctgtactttgcccggcgggagtgttcccccgagcccgccggctgtgctgccagggacttccgcctggcagccagtgtcttcgccgggctcctcttcctggcctacgctgtggaggtggccctgacgcgggcccggcccggccaggtgagcagctatatggccacggtgtcggggctcctcaagatcgtccaggccttcgtggcctgcatcatcttcggggcgctggtccatgacagccgctacgggcgctacgtggccacccagtggtgcgtggccgtctacagcctgtgcttcctggccacagtggccgtggtggccctgagtgtgatgggccacacagggggcctgggctgcccctttgaccggctggtggtggtgtacaccttcctggctgtgctcctgtacctcagcgccgccgtgatctggccagtcttctgtttcgatcccaagtacggtgagcccaaacggccccccaactgtgctcggggcagctgtccctgggacagccagctggtggtggccatcttcacctacgtcaacctgctcctgtacgtcgttgacctcgcctactcccagaggattcgcttcgtgcccagcctgtagcccacagtggcagcccacccacctctgctctctggccaccagctccaggctctgcgagggaaactcaggtgaaccaaagtgtcaagtagcgagcaggagggaagccgcgggctcaggggagatgaagtacaacgggagaggtcactccccgacttccagactgggctcagagggacaagggcaggacagtagggcagaggccctgagcagacgcaggggagagcctcacctaggccaatccccaactcactctctctcaccatttcccagcgctcctggggctcagtgctggtcactggaacatcataagggaaaactttaaagcagctgctgttgtgacccattttgcagctggggacatggaggctagaagcatttgcgaggcacccagtacctccattagtgtctggagaccacagtcaggctgggtaaggcaagctgaaagaggaatgacttccagaggagacgaacccaggagagtagctgggccaggcaaggggagggaggggcgtggggagccggaaccactcctggttcagagaggcagctcccagaaccctgggaagagagccctgcctggggagctgtgccagctcacagagaaggagccagaaatctggaccagcctctcccacccacgtccgggaagcctctgggctggtagccacagtgtttggaagcaggcttcctccggagtctccgcaggctggaggtggcgcgggtggcctggaagagcctgcagagcccggcggcaccgagtgcacagtggacggggaggacctggttccgccatagccacggagccccacctggacactcaccattggctgtgacgaagcagcttcagcagtgcccggcgggcatctgtgcactgtgggcatctgtggcactgggagggagcccggctgagggcggccgctggacacagaatctgggtactgcttgcctctgctcaagggtccagttgccgaaactcctgacgccggggccatcatcctccaggctccagccagcttctcctgcacagaagcccagcctggtccagccaggagctgacccactggccacccctgagtccaagccgggtgggcagtggcacaacagcccctcagcccattgactgggccccattgacgtccttgagcaggaaataaatgctgacatttatacgta

SEQ ID NO: 5111 - DNA, 759 bp, Homo sapiens
atgtggcgcgcgccggaagcggctctgaggccggaagtgagcctagagcgccgcggccccgagatgaagccggcggtggacgagatgttccccgagggcgccgggccctacgtggacctggacgaggtggcacgggcccggcgggagtctccgagcgcgggaggcagcaccgggctcttgatggacttggcagccaatgaaaaggccgttcatgcagacttttttaacgattttgaagatctttttgatgatgatgacatccacagctcaggactgcccaggacaagccagcagtcctccatggttcccgcactgcagcgagggcagtcggagcacggggtccgtgggaaggcagcagagcggcctgtggtgtcggaagagagatgtgaactgaacgggagagaagtggcagctttggacagagcgtttgggagcacaggccatgggcagggggcggaggcgctaatgtttaccagatgcagagaacatccgctgtgtggcaccaacaaagcaacaagtgaggggaaaatgggcacaggacgcttaagaaacagtttacggaagaaccaatccaagtggctgggaagttatctagaggtgctcagaaccacaagaagcaggcgagaggtcagcgaagacagcacaatatcagtttctactcactggaggggtaaatgttttaagagtgatgaaacaccatccgttgctggtggagaagaagggaagaagaccacacagccatgcatagatgtgaggtag

SEQ ID NO: 5112 - DNA, 922 bp, Homo sapiens
ctccccgccgcggtgcgaggggccccgtgtgccgcgcacccttccacccgtgttttgctgtttttttgactctgggcgtcccaggggtgcagcggccgtggggccctggtttgctttcacctcttcatctgctcactggccgcgagtgtgtcttcttcagacaaacgtctgaaggtcaagccctgggctcctgtgaacccggccgtctttgcggcagagtctgaggctccttctttattctggatccggcctctggtcggaggcgtgctctgcaggcactgctcccattgctggcagccttttctccccgtggccgcccggccgcccatcagaggcgttgcagacgcccgccctcgccagcgcaaagacaaacgccggtggccgcggacgcgccggcggccgggagcaccccagcgggcgggcaccacagaggcgcggtcctccggcgtctagatctgccatgtggcgcgcgccggaagcggctctgaggccggaagtgagcctagagcgccgcggccccgagatgaagccggcggtggacgagatgttccccgagggcgccgggccctacgtggacctggacgaggcgggaggcagcaccgggctcttgatggacttggcagccaatgaaaaggccgttcatgcagacttttttaacgattttgaagatctttttgatgatgatgacatccagtgagatgccctctggctgcaggcggggccaagcccttggtacagagccgcagtgtgagcctgcgcaggacagtttcaggtggttttaaagaacacgtggaaatcccttgaatttaggacctggttaaccagaaagataagactgttcttaacgacctagatgattctgttcatctctgaacgggatcaggttttgtcctcactccaattaaaagaaagcaatgtcaca

SEQ ID NO: 5113 - DNA, 3808 bp, Homo sapiens
agtgctgctatatttaagacggtgcagtctccgggatcgcattcttctcccggtgcccgctgagccgagggcaagaagagaacaaggaccctctcggcctcaggaatcttctccccagagactcctaagtgggcacactgcttctgttgttgctctcgtaaccatgactctgccgcacagcttgggaggtgcgggggacccccggcccccccaggccatggaggttcacaggctggagcaccggcaggaggaggagcagaaggaggagcggcagcacagcctgcgcatgggctcctctgtgcggaggcggaccttccgcagcagcgaagaagagcatgagttcagcgccgcggactacgccctggcagcagccctggctctgacggcctcctccgagctgtcttgggaagcccagctgagacgccagacctctgccgtggagctggaggagcgagggcagaagcgggtgggcttcggcaatgactgggagaggactgagatcgccttcctgcagacccaccggctgctgcgccagaggcgggactggaagacgctgaggcggcggacagaggagaaggtccaggaggccaaggagctgagggagctgtgctacggccgcgggccctggttctggatccctcttcgctcccacgccgtctgggagcacaccacggtcctgctgacctgcactgtccaggcctcaccaccaccccaggtcacctggtacaaaaatgacacacggattgatccccgcctctttcgtgccggaaaataccgaatcaccaacaactacgggctgctgtccctggagattaggagatgcgccattgaggactcagcaacttacactgtgcgagtgaagaacgcccacggccaggcctcctccttcgccaaagtcctcgtccgcacttacctggggaaggatgctggcttcgattcagagatcttcaaaagatcgacgtttggccccagcgtggaattcacctcggtgctgaagccagtctttgctcgtgagaaggaacccttctccctgtcatgcttgttttcggaagatgtgttagatgctgagagcatccagtggttccgagatgggagcctactgaggtcctcgagacgtcggaagatcctctacacagaccgccaggcatccctgaaggtgtcctgcacctacaaggaggacgaggggctctacatggtccgggtgccctcgcccttcggaccccgggaacagagcacctacgtgcttgtgagagatgccgaggccgagaaccccggggccccaggctccccactgaacgtccgatgcctggatgtgaacagagactgcctcatcctgacttgggccccgcccagtgacacccggggcaaccccatcactgcctacaccattgagcggtgccagggcgagtctggggaatggatcgcctgccatgaggcccccggagggacttgtcggtgcccaatccaaggcctcgtcgaaggtcagagctatcggttccgggtgagagccatcagcagggtaggcagcagcgtcccctccaaggcctcagagttggttgtcatgggtgaccatgatgcagcccggaggaagacagagatcccctttgatctgggaaacaagatcaccatcagcacagacgcttttgaagatactgtgaccatcccctcaccgccaaccaatgtccatgccagcgagatccgagaggcctatgtggttctggcctgggaggagcccagcccccgggacagagcaccactgacgtactccctggagaagtcagtcataggtagtggcacctgggaggccatcagctcggaaagccctgtgagatccccgagattcgccgttctggacctggagaaaaagaagtcgtatgtcttcagagtgcgagcaatgaaccagtatggcctgagcgatccctcggagcccagcgaacccatcgccttgcggggcccgccagctaccctccctcctccagctcaagttcaagctttcagagacacacagacctctgtctccctgacatgggatcctgtgaaagacccagagctcctgggttattacatctactcccggaaggtggggacatctgagtggcaaacagttaacaacaaacccatccaaggcaccaggtttacagttcccgggctgaggacggggaaggagtacgagttttgtgtcaggtcagtcagcgaggctggggtaggcgagagctcagccgccaccgagcccatcagggtcaagcaggctctggctaccccgtctgccccatatggctttgccctcctgaactgcgggaagaatgaaatggtcattgggtggaaaccccccaagcgtcgtggaggtggcaagatcctgggctacttcctggaccagcatgactcggaagagctggactggcatgcggtcaatcagcagcccatccccacccgggtctgcaaggtcagtgaccttcatgaaggccacttctatgagttccgtgcccgggctgccaactgggcaggtgttggcgagctgtcggcacccagcagcctgtttgagtgcaaagagtggacaatgccccagccaggccccccgtacgatgtacgggcatccgaggtgcgggccacatccctggtgctgcagtgggaacccccactgtatatgggggctgggcctgtcacaggctatcacgtcagtttccaggaggaaggctctgagcagtggaagccggtcaccccaggccccatctctggcacccacctgagggtttccgacttgcagccaggaaagagttacgtgttccaggtacaggccatgaattcagctggtctggggcaaccgtccatgcccactgatcccgtgctcctggaggacaagccaggtgcccatgagatcgaggttggtgtggatgaagagggctttatctatttggcttttgaagcccctgaagcccccgactcctcagagtttcagtggtccaaagactacaagggcccactggacccccagagggtcaagatcgaggataaagttaacaagtccaaggtcatcctgaaagaacccggcctcgaggatttgggcacctactcagtcatagtcactgatgccgatgaagacatctccgcaagccacacgctaaccgaggaagagctggagaagctgaagaagctgagtcatgagatcagaaacccagtgatcaaactgatctccggctggaacattgacatcctggagcgaggggaggtgcggctttggctggaagtagaaaagttatctccagccgctgagctacatctaatcttcaacaacaaggagatcttcagctcgccgaaccgcaaaatcaattttgaccgagagaagggcctggtggaagtgatcatccagaacttgtctgaggaggacaaagggtcgtacaccgctcaactccaagatggaaaagccaaaaaccagattaccttgacactggtggatgacgattttgacaagcttctgaggaaggcagatgctaagagaagggactggaagagaaaacagggtccctattttgagcggccgttgcagtggaaggtcacggaggactgccaagtgcagctgacgtgcaaggcaagtgtgaccaacaccaagaaggagactcgctttcagtggttcttccagagggcagagatgccagatggtcagtatgacccagagacgggaacgggacttctctgcattgaagaggcaagtgtggctccagcttcagggctcactttctcctttggctgcaagccagggagggccaagagctctgggctgggagtcagggcagggccgaggctaggttga

SEQ ID NO: 5114 - DNA, 5809 bp, Homo sapiens
agtgctgctatatttaagacggtgcagtctccgggatcgcattcttctcccggtgcccgctgagccgagggcaagaagagaacaaggaccctctcggcctcaggaatcttctccccagagactcctaagtgggcacactgcttctgttgttgctctcgtaaccatgactctgccgcacagcttgggaggtgcgggggacccccggcccccccaggccatggaggttcacaggctggagcaccggcaggaggaggagcagaaggaggagcggcagcacagcctgcgcatgggctcctctgtgcggaggcggaccttccgcagcagcagcgaagaagagcatgagttcagcgccgcggactacgccctggcagcagccctggctctgacggcctcctccgagctgtcttgggaagcccagctgagacgccagacctctgccgtggagctggaggagcgagggcagaagcgggtgggcttcggcaatgactgggagaggactgagatcgccttcctgcagacccaccggctgctgcgccagaggcgggactggaagacgctgaggcggcggacagaggagaaggtccaggaggccaaggagctgagggagctgtgctacggccgcgggccctggttctggatccctcttcgctcccacgccgtctgggagcacaccacggtcctgctgacctgcactgtccaggcctcaccaccaccccaggtcacctggtacaaaaatgacacacggattgatccccgcctctttcgtgccggaaaataccgaatcaccaacaactacgggctgctgtccctggagattaggagatgcgccattgaggactcagcaacttacactgtgcgagtgaagaacgcccacggccaggcctcctccttcgccaaagtcctcgtccgcacttacctggggaaggatgctggcttcgattcagagatcttcaaaagatcgacgtttggccccagcgtggaattcacctcggtgctgaagccagtctttgctcgtgagaaggaacccttctccctgtcatgcttgttttcggaagatgtgttagatgctgagagcatccagtggttccgagatgggagcctactgaggtcctcgagacgtcggaagatcctctacacagaccgccaggcatccctgaaggtgtcctgcacctacaaggaggacgaggggctctacatggtccgggtgccctcgcccttcggaccccgggaacagagcacctacgtgcttgtgagagatgccgaggccgagaaccccggggccccaggctccccactgaacgtccgatgcctggatgtgaacagagactgcctcatcctgacttgggccccgcccagtgacacccggggcaaccccatcactgcctacaccattgagcggtgccagggcgagtctggggaatggatcgcctgccatgaggcccccggagggacttgtcggtgcccaatccaaggcctcgtcgaaggtcagagctatcggttccgggtgagagccatcagcagggtaggcagcagcgtcccctccaaggcctcagagttggttgtcatgggtgaccatgatgcagcccggaggaagacagagatcccctttgatctgggaaacaagatcaccatcagcacagacgcttttgaagatactgtgaccatcccctcaccgccaaccaatgtccatgccagcgagatccgagaggcctatgtggttctggcctgggaggagcccagcccccgggacagagcaccactgacgtactccctggagaagtcagtcataggtagtggcacctgggaggccatcagctcggaaagccctgtgagatccccgagattcgccgttctggacctggagaaaaagaagtcgtatgtcttcagagtgcgagcaatgaaccagtatggcctgagcgatccctcggagcccagcgaacccatcgccttgcggggcccgccagctaccctccctcctccagctcaagttcaagctttcagagacacacagacctctgtctccctgacatgggatcctgtgaaagacccagagctcctgggttattacatctactcccggaaggtggggacatctgagtggcaaacagttaacaacaaacccatccaaggcaccaggtttacagttcccgggctgaggacggggaaggagtacgagttttgtgtcaggtcagtcagcgaggctggggtaggcgagagctcagccgccaccgagcccatcagggtcaagcaggctctggctaccccgtctgccccatatggctttgccctcctgaactgcgggaagaatgaaatggtcattgggtggaaaccccccaagcgtcgtggaggtggcaagatcctgggctacttcctggaccagcatgactcggaagagctggactggcatgcggtcaatcagcagcccatccccacccgggtctgcaaggtcagtgaccttcatgaaggccacttctatgagttccgtgcccgggctgccaactgggcaggtgttggcgagctgtcggcacccagcagcctgtttgagtgcaaagagtggacaatgccccagccaggccccccgtacgatgtacgggcatccgaggtgcgggccacatccctggtgctgcagtgggaacccccactgtatatgggggctgggcctgtcacaggctatcacgtcagtttccaggaggaaggctctgagcagtggaagccggtcaccccaggccccatctctggcacccacctgagggtttccgacttgcagccaggaaagagttacgtgttccaggtacaggccatgaattcagctggtctggggcaaccgtccatgcccactgatcccgtgctcctggaggacaagccaggtgcccatgagatcgaggttggtgtggatgaagagggctttatctatttggcttttgaagcccctgaagcccccgactcctcagagtttcagtggtccaaagactacaagggcccactggacccccagagggtcaagatcgaggataaagttaacaagtccaaggtcatcctgaaagaacccggcctcgaggatttgggcacctactcagtcatagtcactgatgccgatgaagacatctccgcaagccacacgctaaccgaggaagagctggagaagctgaagaagctgagtcatgagatcagaaacccagtgatcaaactgatctccggctggaacattgacatcctggagcgaggggaggtgcggctttggctggaagtagaaaagttatctccagccgctgagctacatctaatcttcaacaacaaggagatcttcagctcgccgaaccgcaaaatcaattttgaccgagagaagggcctggtggaagtgatcatccagaacttgtctgaggaggacaaagggtcgtacaccgctcaactccaagatggaaaagccaaaaaccagattaccttgacactggtggatgacgattttgacaagcttctgaggaaggcagatgctaagagaagggactggaagagaaaacagggcacaggtccctattttgagcggccgttgcagtggaaggtcacggaggactgccaagtgcagctgacgtgcaaggtgaccaacaccaagaaggagactcgctttcagtggttcttccagagggcagagatgccagatggtcagtatgacccagagacgggaacgggacttctctgcattgaagagttgtccaaaaaggacaagggaatttacagagcgatggtttctgacgatcgaggggaggacgacaccatattggacctcacgggtgacgccctggatgccatcttcaccgagttgggcaggattggtgccctctctgcaactccactgaaaatccaggggaccgaggaagggatccggatcttcagcaaggtcaagtactacaacgtggagtacatgaaaaccacctggttccacaaagacaaacgtctggagagtggtgatcggataaggacgggcaccaccctggatgagatctggcttcacatcctggaccccaaagactcagacaagggcaaatacactctggaaatagctgcagggaaggaagtccggcagctctcaacagatctctcagggcaagcttttgaggatgcaatggctgaacaccagagactgaaaaccttggccatcatcgagaagaatcgtgccaaagtggtgagaggtctgccggatgtggccactatcatggaagataagaccctgtgcttgacttgcatcgtctcaggagaccccacccctgaaatctcttggctgaagaatgaccagcctgtcaccttccttgaccgataccgcatggaagtgagggggacagaggtcaccatcaccattgagaaggtcaacagtgaagacagcggccgctacggcgtcttcgtcaagaacaagtatggctccgagacgggccaggtcaccatcagtgtgttcaagcacggggacgagcccaaggagctgaagagcatgtgacagcgtgtgtccaggcacagtctgagtctagtctacatggaccagtagggacaacctgtaccagggtcacagcctggcacaggctacaggggtggggcagaaggaaaggggacaagatagaacccaggatgtgagggtgggggtggagcggatgcaccaaagtggagaagcaaagatctttctggggtcctgagtggcttccaggagagcgggatgaaccctggacctggagtaggagacccggatgcactggggctatctaacagtactggcatctgataggtagaggtcaggtacgctgctaaacactgcagctcccaccacatagaattatccgaccccagatgtcaaaagtgccaagggccatgagccctgccataaactgatacatcgcacccctcttttaggatcccatagtttcaattcatgtaagttcaacagacacctgaagtctagcatgtgggaggctgaggatggagctgggaacacaaaggcagctgataagcaggttctgcttgcaaagaggcctcagtccagtgggagaaacagacctgggcgcaaacaactccaggacaaggcaggacatgataaagattataaagcaggtccaaggaaagtgccgccagtggtccaaggagggagacagagggtcgtcccaacagggggaggtagggctttgaaaacaccttcatccaggctgggcgaggtggctcacgcctgtaatcccagtagtttgggaggccaaggcgggcagatcacctgaggtcaggagttttagaccagcctggccaacatgacgaaacccggtctctactaaaaatacaaaaattagccaggcatggtggcaggtgcctgtaatcccggctattcagaaggccgaggtgggagaatccgttgaacctgggaggcggaggttgtgatgagccaagattgagccaaaaaaaaattagcagaattggtgttgggccctgaaaaattagtccgattttgtggtggtaatgggagaaggacatcccaggagcagggtctggtgggaggaaagggaaggaggaggctaaggctgcccaggaggccttggataccaggcttggagctggtaacctccagggcttccagcacggggcctctgcctggtgtgacagataccggctggcctcacttgatggatctcagtactgagctgggcatttctctgccccccaacttttttctttttaaaaataagatggggagtgttcataaaattatagatgtttgttgtaaaattttggaaaaccctggaaattatagagaaaataaacataatctatactcccaacacca

SEQ ID NO: 5115 - DNA, 2693 bp, Homo sapiens
acacggtaagagggagagcccaggtttgaacaagtctatctgattccaaagcctaaggtccttcttagcactcttcagcctgtttagataactggggaaggggagggtgggtgctctcccagaagcatattcattcagtaaactcagagcatctattttgtgccactctgcacggtactgaacgtacaaagatgatgaagtggtctctgtgggccttgggagcccatgttcaaggcaggaccattggaaaacagcatccctcatgcttgacccggatggggcaggacattgatgaatcgtgatggagggggtgactatgggatgcttcaaaaaaaaggcttcctggaggagatgacatttaactgaagcacatggacatttccaagaaaaatagagtaaggcagggatcaagaggcagagggaaaaccattagcaagaattcagagtccagaggccagcagaggagacacatggtgaccaacaccaagaaggagactcgctttcagtggttcttccagagggcagagatgccagatggtcagtatgacccagagacgggaacgggacttctctgcattgaagagttgtccaaaaaggacaagggaatttacagagcgatggtttctgacgatcgaggggaggacgacaccatattggacctcacgggtgacgccctggatgccatcttcaccgagttgggcaggattggtgccctctctgcaactccactgaaaatccaggggaccgaggaagggatccggatcttcagcaaggtcaagtactacaacgtggagtacatgaaaaccacctggttccacaaagacaaacgtctggagagtggtgatcggataaggacgggcaccaccctggatgagatctggcttcacatcctggaccccaaagactcagacaagggcaaatacactctggaaatagctgcagggaaggaagtccggcagctctcaacagatctctcagggcaagcttttgaggatgcaatggctgaacaccagagactgaaaaccttggccatcatcgagaagaatcgtgccaaagtggtgagaggtctgccggatgtggccactatcatggaagataagaccctgtgcttgacttgcatcgtctcaggagaccccacccctgaaatctcttggctgaagaatgaccagcctgtcaccttccttgaccgataccgcatggaagtgagggggacagaggtcaccatcaccattgagaaggtcaacagtgaagacagcggccgctacggcgtcttcgtcaagaacaagtatggctccgagacgggccaggtcaccatcagtgtgttcaagcacggggacgagcccaaggagctgaagagcatgtgacagcgtgtgtccaggcacagtctgagtctagtctacatggaccagtagggacaacctgtaccagggtcacagcctggcacaggctacaggggtggggcagaaggaaaggggacaagatagaacccaggatgtgagggtgggggtggagcggatgcaccaaagtggagaagcaaagatctttctggggtcctgagtggcttccaggagagcgggatgaaccctggacctggagtaggagacccggatgcactggggctatctaacagtactggcatctgataggtagaggtcaggtacgctgctaaacactgcagctcccaccacatagaattatccgaccccagatgtcaaaagtgccaagggccatgagccctgccataaactgatacatcgcacccctcttttaggatcccatagtttcaattcatgtaagttcaacagacacctgaagtctagcatgtgggaggctgaggatggagctgggaacacaaaggcagctgataagcaggttctgcttgcaaagaggcctcagtccagtgggagaaacagacctgggcgcaaacaactccaggacaaggcaggacatgataaagattataaagcaggtccaaggaaagtgccgccagtggtccaaggagggagacagagggtcgtcccaacagggggaggtagggctttgaaaacaccttcatccaggctgggcgaggtggctcacgcctgtaatcccagtagtttgggaggccaaggcgggcagatcacctgaggtcaggagttttagaccagcctggccaacatgacgaaacccggtctctactaaaaatacaaaaattagccaggcatggtggcaggtgcctgtaatcccggctattcagaaggccgaggtgggagaatccgttgaacctgggaggcggaggttgtgatgagccaagattgagccaaaaaaaaattagcagaattggtgttgggccctgaaaaattagtccgattttgtggtggtaatgggagaaggacatcccaggagcagggtctggtgggaggaaagggaaggaggaggctaaggctgcccaggaggccttggataccaggcttggagctggtaacctccagggcttccagcacggggcctctgcctggtgtgacagataccggctggcctcacttgatggatctcagtactgagctgggcatttctctgccccccaacttttttctttttaaaaataagatggggagtgttcataaaattatagatgtttgttgtaaaattttggaaaaccctggaaattatagagaaaataaacataatctatactcccaacaccacaaagt

SEQ ID NO: 5116 - DNA, 5804 bp, Homo sapiens
agtgctgctatatttaagacggtgcagtctccgggatcgcattcttctcccggtgcccgctgagccgagggcaagaagagaacaaggaccctctcggcctcaggaatcttctccccagagactcctaagtgggcacactgcttctgttgttgctctcgtaaccatgactctgccgcacagcttgggaggtgcgggggacccccggcccccccaggccatggaggttcacaggctggagcaccggcaggaggaggagcagaaggaggagcggcagcacagcctgcgcatgggctcctctgtgcggaggcggaccttccgcagcagcgaagaagagcatgagttcagcgccgcggactacgccctggcagcagccctggctctgacggcctcctccgagctgtcttgggaagcccagctgagacgccagacctctgccgtggagctggaggagcgagggcagaagcgggtgggcttcggcaatgactgggagaggactgagatcgccttcctgcagacccaccggctgctgcgccagaggcgggactggaagacgctgaggcggcggacagaggagaaggtccaggaggccaaggagctgagggagctgtgctacggccgcgggccctggttctggatccctcttcgctcccacgccgtctgggagcacaccacggtcctgctgacctgcactgtccaggcctcaccaccaccccaggtcacctggtacaaaaatgacacacggattgatccccgcctctttcgtgccggaaaataccgaatcaccaacaactacgggctgctgtccctggagattaggagatgcgccattgaggactcagcaacttacactgtgcgagtgaagaacgcccacggccaggcctcctccttcgccaaagtcctcgtccgcacttacctggggaaggatgctggcttcgattcagagatcttcaaaagatcgacgtttggccccagcgtggaattcacctcggtgctgaagccagtctttgctcgtgagaaggaacccttctccctgtcatgcttgttttcggaagatgtgttagatgctgagagcatccagtggttccgagatgggagcctactgaggtcctcgagacgtcggaagatcctctacacagaccgccaggcatccctgaaggtgtcctgcacctacaaggaggacgaggggctctacatggtccgggtgccctcgcccttcggaccccgggaacagagcacctacgtgcttgtgagagatgccgaggccgagaaccccggggccccaggctccccactgaacgtccgatgcctggatgtgaacagagactgcctcatcctgacttgggccccgcccagtgacacccggggcaaccccatcactgcctacaccattgagcggtgccagggcgagtctggggaatggatcgcctgccatgaggcccccggagggacttgtcggtgcccaatccaaggcctcgtcgaaggtcagagctatcggttccgggtgagagccatcagcagggtaggcagcagcgtcccctccaaggcctcagagttggttgtcatgggtgaccatgatgcagcccggaggaagacagagatcccctttgatctgggaaacaagatcaccatcagcacagacgcttttgaagatactgtgaccatcccctcaccgccaaccaatgtccatgccagcgagatccgagaggcctatgtggttctggcctgggaggagcccagcccccgggacagagcaccactgacgtactccctggagaagtcagtcataggtagtggcacctgggaggccatcagctcggaaagccctgtgagatccccgagattcgccgttctggacctggagaaaaagaagtcgtatgtcttcagagtgcgagcaatgaaccagtatggcctgagcgatccctcggagcccagcgaacccatcgccttgcggggcccgccagctaccctccctcctccagctcaagttcaagctttcagagacacacagacctctgtctccctgacatgggatcctgtgaaagacccagagctcctgggttattacatctactcccggaaggtggggacatctgagtggcaaacagttaacaacaaacccatccaaggcaccaggtttacagttcccgggctgaggacggggaaggagtacgagttttgtgtcaggtcagtcagcgaggctggggtaggcgagagctcagccgccaccgagcccatcagggtcaagcaggctctggctaccccgtctgccccatatggctttgccctcctgaactgcgggaagaatgaaatggtcattgggtggaaaccccccaagcgtcgtggaggtggcaagatcctgggctacttcctggaccagcatgactcggaagagctggactggcatgcggtcaatcagcagcccatccccacccgggtctgcaaggtcagtgaccttcatgaaggccacttctatgagttccgtgcccgggctgccaactgggcaggtgttggcgagctgtcggcacccagcagcctgtttgagtgcaaagagtggacaatgccccagccaggccccccgtacgatgtacgggcatccgaggtgcgggccacatccctggtgctgcagtgggaacccccactgtatatgggggctgggcctgtcacaggctatcacgtcagtttccaggaggaaggctctgagcagtggaagccggtcaccccaggccccatctctggcacccacctgagggtttccgacttgcagccaggaaagagttacgtgttccaggtacaggccatgaattcagctggtctggggcaaccgtccatgcccactgatcccgtgctcctggaggacaagccaggtgcccatgagatcgaggttggtgtggatgaagagggctttatctatttggcttttgaagcccctgaagcccccgactcctcagagtttcagtggtccaaagactacaagggcccactggacccccagagggtcaagatcgaggataaagttaacaagtccaaggtcatcctgaaagaacccggcctcgaggatttgggcacctactcagtcatagtcactgatgccgatgaagacatctccgcaagccacacgctaaccgaggaagagctggagaagctgaagaagctgagtcatgagatcagaaacccagtgatcaaactgatctccggctggaacattgacatcctggagcgaggggaggtgcggctttggctggaagtagaaaagttatctccagccgctgagctacatctaatcttcaacaacaaggagatcttcagctcgccgaaccgcaaaatcaattttgaccgagagaagggcctggtggaagtgatcatccagaacttgtctgaggaggacaaagggtcgtacaccgctcaactccaagatggaaaagccaaaaaccagattaccttgacactggtggatgacgattttgacaagcttctgaggaaggcagatgctaagagaagggactggaagagaaaacagggtccctattttgagcggccgttgcagtggaaggtcacggaggactgccaagtgcagctgacgtgcaaggtgaccaacaccaagaaggagactcgctttcagtggttcttccagagggcagagatgccagatggtcagtatgacccagagacgggaacgggacttctctgcattgaagagttgtccaaaaaggacaagggaatttacagagcgatggtttctgacgatcgaggggaggacgacaccatattggacctcacgggtgacgccctggatgccatcttcaccgagttgggcaggattggtgccctctctgcaactccactgaaaatccaggggaccgaggaagggatccggatcttcagcaaggtcaagtactacaacgtggagtacatgaaaaccacctggttccacaaagacaaacgtctggagagtggtgatcggataaggacgggcaccaccctggatgagatctggcttcacatcctggaccccaaagactcagacaagggcaaatacactctggaaatagctgcagggaaggaagtccggcagctctcaacagatctctcagggcaagcttttgaggatgcaatggctgaacaccagagactgaaaaccttggccatcatcgagaagaatcgtgccaaagtggtgagaggtctgccggatgtggccactatcatggaagataagaccctgtgcttgacttgcatcgtctcaggagaccccacccctgaaatctcttggctgaagaatgaccagcctgtcaccttccttgaccgataccgcatggaagtgagggggacagaggtcaccatcaccattgagaaggtcaacagtgaagacagcggccgctacggcgtcttcgtcaagaacaagtatggctccgagacgggccaggtcaccatcagtgtgttcaagcacggggacgagcccaaggagctgaagagcatgtgacagcgtgtgtccaggcacagtctgagtctagtctacatggaccagtagggacaacctgtaccagggtcacagcctggcacaggctacaggggtggggcagaaggaaaggggacaagatagaacccaggatgtgagggtgggggtggagcggatgcaccaaagtggagaagcaaagatctttctggggtcctgagtggcttccaggagagcgggatgaaccctggacctggagtaggagacccggatgcactggggctatctaacagtactggcatctgataggtagaggtcaggtacgctgctaaacactgcagctcccaccacatagaattatccgaccccagatgtcaaaagtgccaagggccatgagccctgccataaactgatacatcgcacccctcttttaggatcccatagtttcaattcatgtaagttcaacagacacctgaagtctagcatgtgggaggctgaggatggagctgggaacacaaaggcagctgataagcaggttctgcttgcaaagaggcctcagtccagtgggagaaacagacctgggcgcaaacaactccaggacaaggcaggacatgataaagattataaagcaggtccaaggaaagtgccgccagtggtccaaggagggagacagagggtcgtcccaacagggggaggtagggctttgaaaacaccttcatccaggctgggcgaggtggctcacgcctgtaatcccagtagtttgggaggccaaggcgggcagatcacctgaggtcaggagttttagaccagcctggccaacatgacgaaacccggtctctactaaaaatacaaaaattagccaggcatggtggcaggtgcctgtaatcccggctattcagaaggccgaggtgggagaatccgttgaacctgggaggcggaggttgtgatgagccaagattgagccaaaaaaaaattagcagaattggtgttgggccctgaaaaattagtccgattttgtggtggtaatgggagaaggacatcccaggagcagggtctggtgggaggaaagggaaggaggaggctaaggctgcccaggaggccttggataccaggcttggagctggtaacctccagggcttccagcacggggcctctgcctggtgtgacagataccggctggcctcacttgatggatctcagtactgagctgggcatttctctgccccccaacttttttctttttaaaaataagatggggagtgttcataaaattatagatgtttgttgtaaaattttggaaaaccctggaaattatagagaaaataaacataatctatactcccaacaccacaaa

SEQ ID NO: 5117 - DNA, 2319 bp, Homo sapiens
atggacatttccaagaaaaatagagtaaggcagggatcaagaggcagagggaaaaccattagcaagaattcagagtccagaggccagcagaggagacacatggtgaccaacaccaagaaggagactcgctttcagtggttcttccagagggcagagatgccagatggtcagtatgacccagagacgggaacgggacttctctgcattgaagaggcaagtttgtccaaaaaggacaagggaatttacagagcgatggtttctgacgatcgaggggaggacgacaccatattggacctcacgggtgacgccctggatgccatcttcaccgagttgggcaggattggtgccctctctgcaactccactgaaaatccaggggaccgaggaagggatccggatcttcagcaaggtcaagtactacaacgtggagtacatgaaaaccacctggttccacaaagacaaacgtctggagagtggtgatcggataaggacgggcaccaccctggatgagatctggcttcacatcctggaccccaaagactcagacaagggcaaatacactctggaaatagctgcagggaaggaagtccggcagctctcaacagatctctcagggcaagcttttgaggatgcaatggctgaacaccagagactgaagttcctctacatttctcagtatcgtgccaaagtggtgagaggtctgccggatgtggccactatcatggaagataagaccctgtgcttgacttgcatcgtctcaggagaccccacccctgaaatctcttggctgaagaatgaccagcctgtcaccttccttgaccgataccgcatggaagtgagggggacagaggtcaccatcaccattgagaaggtcaacagtgaagacagcggccgctacggcgtcttcgtcaagaacaagtatggctccgagacgggccaggtcaccatcagtgtgttcaagcacggggacgagcccaaggagctgaagagcatgtgacagcgtgtgtccaggcacagtctgagtctagtctacatggaccagtagggacaacctgtaccagggtcacagcctggcacaggctacaggggtggggcagaaggaaaggggacaagatagaacccaggatgtgagggtgggggtggagcggatgcaccaaagtggagaagcaaagatctttctggggtcctgagtggcttccaggagagcgggatgaaccctggacctggagtaggagacccggatgcactggggctatctaacagtactggcatctgataggtagaggtcaggtacgctgctaaacactgcagctcccaccacatagaattatccgaccccagatgtcaaaagtgccaagggccatgagccctgccataaactgatacatcgcacccctcttttaggatcccatagtttcaattcatgtaagttcaacagacacctgaagtctagcatgtgggaggctgaggatggagctgggaacacaaaggcagctgataagcaggttctgcttgcaaagaggcctcagtccagtgggagaaacagacctgggcgcaaacaactccaggacaaggcaggacatgataaagattataaagcaggtccaaggaaagtgccgccagtggtccaaggagggagacagagggtcgtcccaacagggggaggtagggctttgaaaacaccttcatccaggctgggcgaggtggctcacgcctgtaatcccagtagtttgggaggccaaggcgggcagatcacctgaggtcaggagttttagaccagcctggccaacatgacgaaacccggtctctactaaaaatacaaaaattagccaggcatggtggcaggtgcctgtaatcccggctattcagaaggccgaggtgggagaatccgttgaacctgggaggcggaggttgtgatgagccaagattgagccaaaaaaaaattagcagaattggtgttgggccctgaaaaattagtccgattttgtggtggtaatgggagaaggacatcccaggagcagggtctggtgggaggaaagggaaggaggaggctaaggctgcccaggaggccttggataccaggcttggagctggtaacctccagggcttccagcacggggcctctgcctggtgtgacagataccggctggcctcacttgatggatctcagtactgagctgggcatttctctgccccccaacttttttctttttaaaaataagatggggagtgttcataaaattatagatgtttgttgtaaaattttggaaaaccctggaaattatagagaaaataaacataatctatactcccaacacca

SEQ ID NO: 5118 - DNA, 1372 bp, Homo sapiens
accagcagtgaaaatctagagctggagctcagcctctgggaaggcccagcatggaggcagccacagctccggaggtggccgcaggatccaagctgaaggtgaaagaagccagcccagcggatgctgaaccaccccaggcttcacctggacagggggctggcagccccactccccagctcctgccccctatagaagagcaccccaagatctggctacctcgggccctgaggcagacctacatccggaaggttggggacacagtgaacctactaatcccattccagggcaagcccaaacctcaagccatctggacacatgatggctgtgccttggacaccaggcgtgtgagtgtgcggaatggggagcaagactccatcctcttcatccgagaagcccaacgtgctgactcaggtcgctaccaactccgcgtgcagctgggtgggctggaggccaccgccaccattgacatcctggtgattgagaggccaggccctcctcagagtattaagctggtggacgtttggggcttcagcgctacactggaatggacaccgccccaagatacggggaatacagcacttctgggatacacggtgcagaaggctgacacaaaatccgggctgtggttcacggtgctggagcactatcaccgcaccagctgcatcgtctctgacctcatcatcggcaactcctatgccttccgtgtctttgctgaaaaccagtgcggactcagtgaaacagcccccatcactacggacctcgcccacatccagaaagcagctactgtttacaagaccaaggggtttgcccaacgagacttctctgaagccccaaagtttacccagcctctggccgactgcactacagtcaccggctataatacccagctcttctgctgtgtccgcgcctctccccggcccaagatcatctggctgaagaacaagatggatatccaaggcaaccctaagtacagagccctgactcacctgggaatctgctccctagagatccgcaagccgggtccctttgatggaggcatctatacctgcaaggcggtgaaccccctaggggaggcatctgtggactgtcgggtggatgtgaaagttcctaattgaggacacctaagaaggcatggtactctgacaaagccagtgcccagcaatgaagtgaattcatggcacaggagccagggaccgtgacaacggtgccctcagcagcctggtgtcctctggccatttgctgtcatggctacaaagtgctccctcttttcagtgcctccaggaagcccgccagtggtgagactgtgtcctcaaggagcttcggcaccatgtctggtttggattcatctaaataaatatgtggttccccagtg

SEQ ID NO: 5119 - DNA, 9401 bp, Homo sapiens
atgggcaggaaccagcgcaaagcgccccagcgcctggagaggcccgggaggccggcctcaggggagcaggagtcggggtcggccagcgcggatggcgcgcccagccgggaacgccgttccgaccgcgggcaggcggacagggcgaaaccggcggccgagcctgccaccgccgggggccagggaacccctggtggccgcaggaagcccactgcagaggggaacggcggctgcagacgcccaggggctgggctgtccccgaaagcccaggagaggcaaagcaacgcgcagcgtcagggacgcgggcccaggggcggccgcggggggcgcctggaggagggaagcctctccggaggagaagagctgggcggccgccgtaggaggaagcggaaagataaggggccctcggctcggcggggccgccggacgcccaggagcctcaatggggacacgtcgggtggggacggaggcagctcctgtccggacagcgaaacccgcgaggcccaggagagcggcagccagcgcggcacagcccgggagctgcggcccacgccggagcctacggacatgggctcggaagggacaaaaaccgggccggagtcagcgctggagccaagcagcgacggcctggacagcgactggccccacgcagatacccggggccgggaagggtcgtcggggacggggcccctgggagccagcgagcattccggcggggactccgactcgagtccgctggggaccggacctggacggggctctcgggcagctatggcctccaggaccttcgaggacagctcgcgggctcctcgggacactgggccggccaaggacgcgagcgacaaccgggcgcagcggggcgccgagccagaaacaatgcaggcctcgacggcccgggctccgcgccaccaggtcggaaaggcggtggggcaggtgccagcggcggcaggcgagggcgaagcgggagccgcagcaggagcggggccggaggacccagccccgctggcggccctcctggtggtccgcaggctcctcgcgaggcccccgccaggcgccgcttcccaggccgtgggcccccgccgcgctggcctcaaggagcggctcctgagtgtagcgcgagccctgggcctcctgcgctggctgcggcggcggctgcggctgcggcggcggccgccagagggcgaggggcagggtaccgggccacgggcgagcgaggggtggggccgccggaaaccggacgaggggcggggtcatgggagaggaagcaaggggcggggccgcgggaaagcggatgaagggcggggccacgagcgaggggacgagggtcggggccgcgggaaagcggacgaagggcggggccacgagcgagggtacgaggggcggggctgcgggaaagcggacgaggggcggggtcacgagagaggtgacgagggccgggaccaccagagagggtacgaggggtggggccgtgagcccgggctgcggcaccgtctagcgttgcgcctggctggcttagcagggctggggggtatgccgagggcttcccctggtggccgctccccgcaggtcccgacaagcccagtccccggcgacccttttgatcaggaggacgagactccagatcccaagttcgcggtcgtgttccccaggatccacagggcagggcgggcgtcgagcagccgcagctctgaagaagcgtccgcagatgcccccacgggggaaggccgaggttggcctcgtgcaggggtgggggggcacagtgaggggtgcaggacgagtggggaaggggtgtccgggcttcgtcgcggctccctccttgccccgactgcacccgacgggccttccctcgacgagagcggctccagcagtgaggcggagttggagaccctcaatgacgagcccccggtgcgctgggcgcagggctcaggcccccacgagggtcctaggcttggcgccgccgtgctgctaccccgactctccttggagacccgcctgcagcaggagggagacccgggcctccgtgggtccctgagggagctgtgggaacccgaggatgaggacgaggcggtgctggagagggacctggagctgagcctccggccgggcctggaggcgccacccttccccggtgccaagggcaggagcctcggagacggcctggaagacatggaggacctggcgcggttgcgacacatctttgccatcgtggcatcagcctatgacctggctcagaatactgggcaggacccatgcatcctcctgtgtgggcacagtggctcagggaagacggaagccgccaaaaagatcatgcagttcctaagcagcctggagcaggatcagacggggaaccgagagtgtcaggtggaggatatgctgcctatactcagcagctttggccatgccaagaccatcctcaatgccaatgccagccgcttcggccaggtcttctgcctctacctacagcaaggggtcatcgtgggagcctctgtgtctcattatctacttgagacctccagggtggtgtttcaggcccaggctgagcggagcttccatgttttttacaagctgctggcagggctggactccatagagcgggagcggctctccctgcagggaccggagacttactactacctcaaccagggccaggcctgcaggctgcaaggcaaggaggatgcccaggactttgaggggctgctgaaggcactgcaggggctcggcttgtgcccagaggagttgaatgccgtctgggctgtgctggccgccatcctgcagctgggcaacatctgcttctcctcctcagagcgagagtcccaggaggtggctgctgtgtctagctgggctgagatccacacagcagcccgactgctgcgggtaccaccagagtgcctggagggggctgtcaccaggagggtcacggagacgccctatggccaggtctcgcgatccctgcccgtggaaagtgcctttgatgccagggacgccctggccaaggcactgtattcccgcctcttccaccggcttctgaggagaaccaatgcacggctggcaccaccaggggagggaggcagcattggcaccgtcactgtcgtggatgcctacggctttgaggccctgcgggtgaatggcctggagcaactgtgcaacaacctcgccagcgagcgcctacagctcttctccagccagatgctgctggcccaggaggagcctccgagggagtcctgcctagacctcctggtagatcagccccacagcctcctgagtatcctggacgcccagacatggctgtcccaggccacggaccacaccttcctccagaagagccactatcaccatggtgaccaccccagctatgccaagccccggctgcccctgcccgtgttcaccgtgcgacattatgcagggactgtcacctaccaggttcacaagtttttaaacagaaaccgggatcagctggaccctgctgtggtggagatgcttggccagagccagctccagctggtgggcagcctgttccaggaggcagagccccagtccaggggagggcgaggcagacccacgctggcctctcgcttccagcaggccctggaggacctcatagcccggctgggcaggagccatgtctatttcatccagtgcctcacccctaaccctggaaagcttccaggcctctttgacgtgggacatgtgacagagcaactgcaccaggcagccatactggaggccgtgggcacccgcagtgccaacttccccgtgcgtgtgccctttgaggccttcctggccagcttccaggccctggggtcagaagggcaggaagacctctctgaccgggagaagtgtggtgccgtcctgagccaggtgctgggggccgaatcacctctctatcaccttggagccaccaaggtcctgctgcaggagcagggctggcagcggctggaggagctccgggaccagcagcgctcccaggccctggtcgacctgcaccgcagcttccacacctgcatctcccgccagcgcgtcctgccccggatgcaggctcgcatgcgtgggttccaggccaggtctgcaggcgttggagccagggctgaagtgggtgggcctgtcttcacacattcctccaacagctgttggctgaccgtctgcctcatctacccttgggccagatgctggaagcggtacctccggcggcgggcagctttgggacagctgaacaccatcctgctggtggcccagcccctgctccagaggcggcagagactgcaggagctggggcgcttggagatcccggctgagctggccgtcatgctgaagacggcggaaagccatcgggacgccctggctgggagcatcaccgagtgcctgccgcctgaggttcctgcccggcccagcctgactctcccagcagacattgacctgttccctttctccagcttcgtcgccatcggctttcaggccagggcagccactggcgaagcccctaacccagctggatggagacaaccctcagcgtgccctggacatcaacaaagtgatgctgcggctcctgggggacggatccctggagtcctggcagaggcagatcatgggcgcatacctggtgcggcaggggcagtgccggccagggctgcggaatgagctctttagccagctggtggcccagctatggcagaacccagatgaacagcagagccagcgtggctgggccctcatggctgttttgctcagcgcctttcccccactgcctgtcctacagaagccactgctcaagttcgtgtctgaccaggcccccaggggcatggcagcgctgtgccagcacaagctgctgggggccttggagcagtcgcagctggcctcgggggccactcgggcccaccccccgacccagctggagtggctggccggatggcggcggggccgcatggcgctggatgtgttcaccttcagcgaggagtgctactcggccgaggtggagtcttggaccaccggggagcagctggctgggtggatcctgcagagcagggacgcatggcaggacttggctggctgcgactttgtgctggacctgatcagccagactgaggacctgggggacccagctcgcccccgcagctaccccatcactcctcttggctcagccgaggccattccccttgcccctggcattcaggccccctcactgcccccaggaccccctccaggtccagccccaacgctgcccagcagggaccacacaggggaggtccagaggtcagggagcctggacggcttcctggaccagatcttccagccagtgatatcctccggcctcagcgatctggaacaaagctgggctctgagcagccgcatgaagggagggggcgccattgggcccacacagcagggctaccccatggtgtacccaggaatgattcagatgcctgcataccagccaggcatggtccctgcacccatgcccatgatgccagcaatgggcacagtccctgccatgccagccatggtggtgccgccgcagccaccgcttcccagcctggatgcagggcagctggccgtccagcagcagaactttatccagcagcaggcgctaatcctggcccagcagatgacagcccaggccatgtccctgtccctggagcagcagatgcagcagcggcagcagcaggctcgggcctccgaggctgcgtcccaggcctcaccctcagccgtcacctccaagcccaggaagccccccacacccccggagaagccacagcgtgacctgggatcagagggtggctgcctgagggagacctccgaggaggctgaagacaggccctatcagcccaagagcttccagcagaaacggaactatttccagaggatggggcagccacagatcacagtgaggacgatgaagcccccggccaaggtccacatcccccagggggaagcgcaggaggaggaggaggaggaggaggaggaggaggagcaggaggagcaagaagtggaaacaagagcagtgccgtcccctcctcctccccccatcgtgaagaagccatgaagcaaggtggggccaaagctccaaaagaggctgaggctgagccagccaaggagacagcggccaagggccatggccaagggccagcccaaggcagggggactgtggtgcgcagctcagactccaagcccaagcggccacaacccagcagggaaattggcaacatcatccgcatgtaccagagccgcccgggccccgtgcctgtgcccgtgcagccatccaggcctcccaaagctttcctgaggaaaatcgaccccaaggacgaggctctggccaagctgggtatcaacggtgcccactcgtccccgccgatgctgtcccccagcccaggaaagggccccccgccagctgtggctcctcgacccaaggccccgctacagcttgggccctctagctccatcaaggaaaagcaggggccccttctggacctgtttggccagaagctgcctattgcccacacacccccacctccaccagcgccaccactgcctctgcccgaggacccagggaccctttcagcagagcgtcgttgcttgacacagcccgtggaggaccagggggtctccacccagctactcgcgccctctggcagcgtgtgcttctcctacaccggcacgccctggaagttgttcctacgcaaggaggtgttctacccacgggagaacttcagccatccctactacctgaggctcctctgtgagcagatcctacgggacaccttctccgagtcctgtatccggatttcccagaatgagcggcggaaaatgaaagacctgctgggaggcttggaggtggacctggattctctcaccaccaccgaagacagcgtcaagaagcgcatcgtggtggccgctcgggacaactgggccaattacttctcccgcttctttcctgtctcgggcgagagtggcagcgacgtgcagctgttagccgtgtcccaccgtgcgctagcccacgaccctgggctagaggtgggggcaggtggcaaggtgacctcagttcatgcccgatccctgcgcagctttgcggaggtgctgggtgtggagtgccggggcggctccaccctggagctgtcactgaagagcgagcagctggtgctgcacacagcccgggcaagggccatcgaggcgctggttgagctattcctgaatgagcttaagaaggactccggctatgtcatcgccctgcgcagctacatcactgacaactgcagcctcctcagcttccaccgtggggacctcatcaagctgctgccggtggccaccctggagccaggctggcagtttggctctgccgggggccgttccggactctttcctgccgacatagtgcagccggctgccgctcccgacttttccttctccaaggagcagaggagtggctggcacaagggtcagctgtccaacggggaaccagggctggctcggtgggacagggcctcagagcgccctgcccacccttggagccaggcacacagtgacgactcggaggccaccagcctgtcctctgtggcctatgcctttctgcccgactcccacagctacaccatgcaggaattcgcccggcgttacttccggaggtcccaggccttgctgggccagactgatggaggtgccgcaggaaaggacacggacagcctggtgcagtacaccaaggctcccatccaggagtcgctcctcagcctcagtgatgatgtgagcaagctggctgtagccagcttcctggccctgatgcggtttatgggtgaccagtccaagccccggggcaaggatgagatggatctgctctatgaactgctgaagctgtgccagcaggagaagctgagggatgagatttactgccaggttatcaagcaggtcacgggacacccccggccggaacactgcactcgaggctggagcttcctcagccttctcacaggcttcttccccccgtcgaccaggctgatgccctacctgaccaagtttctgcaggattcaggccccagccaagagctggcccggagcagccaggagcacctccagcgcacagtcaaatatggggggcgccggcggatgcccccaccgggtgaaatgaaggctttcctgaaaggacaagcgattcgcctgcttcttattcacctgccggggggtgtggattataggacgaatatccagactttcacagtagcagcagaagtgcaggaggagctgtgccggcaaatgggtatcacggagcctcaggaagtgcaggaattcgccctcttcctcatcaaagagaagagccagctggtgcggcccctgcagcccgccgaatacctcaacagcgtggtagtggaccaggacgtgagcctgcacagccggcggctccactgggagaccccactgcacttcgataactccacctacatcagcacccactacagccaggtgctgtgggactaccttcaggggaagctgccagtcagcgccaaggcagacgcgcagctcgccaggctggccgccctgcagcacctcagcaaggccaacaggaataccccctcagggcaggacctgctagcttacgtgccaaagcagctgcaacggcaggtgaacacggcctccatcaagaacctgatgggtcaggagctgagacggctggaaggacacagcccccaggaagcacagatcagcttcattgaggccatgagccagctgcccctcttcggctacaccgtctatggggtgctgcgagtgagcatgcaggccctgtccggacccactctcctggggctcaaccgccagcatctcatcctcatggaccccagctcccagagcctgtactgccgcattgccctgaagagcctgcagcggctccacctgctaagccctctggaggagaaggggccccctggcctggaagtcaactatggctcagctgacaacccccagaccatctggtttgagctgccacaggcccaggagctgctatacaccactgtcttcctgatagacagcagtgcctcttgcactgagtggcccagcatcaactgagaggagtgcaggccggggagagaagaggatgaggcctcccccggcccaagtctcacccacatggtctgccttggatgctatcagatcactgttctagaacctgcctcagcacagcccagccggcccacatgcaggccatgaggcaggggctgctatcacgtcaccagcaggcaaagaaaacagccagaccctctccaggacggcctggggccaaagcgggctgcaggaactcggctggggcacctgaggttgcccagtctgagggagatgcccacccgaccccaggctccgcccaggccccacattagcacaagcccaggcatgggagaaacagctgctgaggaaataaaactccctgg

SEQ ID NO: 5120 - DNA, 2755 bp, Homo sapiens
gggtaacgcggggccgccaggtgacagctaatggcggcggccgcctgaggcgggcgggcggtatagagcgggcggcaggaggcaagcagcgaaaccttcccggccgccgctcccgtcccgacggcggcttccccaaggcggcaggactcggcgcgccatggacaggccggcggcggcggcggcggcgggctgcgagggcggcgggggcccgaacccggggccggcgggcggcaggaggcctcctcgggccgcggggggcgccaccgccggctcccggcagcccagcgtggagaccctggacagtcccacaggatcacatgttgaatggtgtaaacagcttatagctgctacaatttctagtcagatttcaggttcagtgacatcagaaaatgtgtccagagattacaaggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagacaaagggtggaggatatgaaagtgaaagtgcttacccaaatgcagaacttgtgttcttggagatccacaacattcatgtcatgcgagagtcactacgcaaattaaaagagattgtgtacccttcgatcgatgaggcgcggtggctctccaatgtggatgggacgcattggctggaatatataaggatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagatgcccattcaccagaatctcaaggagctgctggccgtcagggcggagctgcagaagcgtgtggagggcctacagcgggaggtggccacgcgcgccgtctcatcctcatctgagcggggctcctcgccctcccactccgccacctccgtccacacctcggtctgatgggcgagaaatatgtaatcccctggctgactaggactgttaaacatagtgtggactggatgatgccttcgacaaaccagagaagccaagttggggggagctggtgcctggagtgggccctgtgcacctcacctggcggaggctggggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgtttgctccctggtcttttttaagtaagtaagtaagtatcttagtagatttttcctttgaggaaaatcggtaataaaataacatggattgaatgtttactgtgcgtcaagcacagttaatatatgatgatgtaaagtaactaactttatgtgatttaattcattcagtaaattgtaaatgtat

SEQ ID NO: 5121 - DNA, 1106 bp, Homo sapiens
gttaattatttattgtaaagatttcagaattgtcagatttcgctttgatgaatcaggtcccgaaagtgctaaaaagcaaacaaaattaatggaattccctcaggagatggaggaggaggaggaggaggaggtaatggagctggtggtggcagcagccagaaaactccactctttgaaacttactcggattgggacagagaaatcaagaggacaggtgcttccgggtggagagtttgttctattaacgagggttacatgatatccacttgccttccagaatacattgtagtgccaagttctttagcagaccaagatctaaagatcttttcccattcttttgttgggagaaggatgccactctggtgctggagccactctaacggcagtgctcttgtgcgaatggccctcatcaaagacgtgctgcagcagaggaagattgaccagaggatttgtaatgcaataactaaaagtcacccacagagaagtgatgtttacaaatcagatttggataagaccttgcctaatattcaagaagtacaggcagcatttgtaaaactgaagcagctatgcgttaatgagccttttgaagaaactgaagagaaatggttatcttcactggaaaatactcgatggttagaatatgtaagggcattccttaagcattcagcagaacttgtatacatgctagaaagcaaacatctctctgtagtcctacaagaggaggaaggaagagacttgagctgttgtgtagcttctcttgttcaagtgatgctggatccctattttaggacaattactggatttcagagtctgatacagaaggagtgggtcatggcaggatatcagtttctagacagatgcaaccatctaaagagatcagagaaagagtctcctttatttttgctattcttggatgccacctggcagctgttagaacaatatcctgcagcttttgagttctccgaaacctacctggcagtgttgtatgacagcacccggatctcactgtttggcaccttcctgttcaactcccctcaccagcgagtgaagcaaagcacggtctggctcttgtaaccgtgatcaaactgttcatgttgtctgctaca

SEQ ID NO: 5122 - DNA, 1715 bp, Homo sapiens
agaaagggcctgggcggccgcactgagagctttacgcccggaggcgtcggcgctgccactggcccgcgacgggaacggggcgaaaaggcggcggcaccatgttctccctcaagccgcccaaacccaccttcaggtcctacctcctgccaccgccccagactgacgataagatcaattcggaaccgaagattaaaaaactggagccagtccttttgccaggagaaattgtcgtaaatgaagtcaattttgtgagaaaatgcattgcaacagacacaagccagtacgatttgtggggaaagctgatatgcagtaacttcaaaatctcctttattacagatgacccaatgccattacagaaattccattacagaaaccttcttcttggtgaacacgatgtccctttaacatgtattgagcaaattgtcacagtaaacgaccacaagaggaagcagaaagtcctaggccccaaccagaaactgaaatttaatccaacagagttaattatttattgtaaagatttcagaattgtcagatttcgctttgatgaatcaggtcccgaaagtgctaaaaaggtatgccttgcaatagctcattattcccagccaacagacctccagctactctttgcatttgaatatgttgggaaaaaataccacaattcagcaaacaaaattaatggaattccctcaggagatggaggaggaggaggaggaggaggtaatggagctggtggtggcagcagccagaaaactccactctttgaaacttactcggattgggacagagaaatcaagaggacaggtgcttccgggtggagagtttgttctattaacgagggttacatgatatccacttgccttccagaatacattgtagtgccaagttctttagcagaccaagatctaaagatcttttcccattcttttgttgggagaaggatgccactctggtgctggagccactctaacggcagtgctcttgtgcgaatggccctcatcaaagacgtgctgcagcagaggaagattgaccagaggatttgtaatgcaataactaaaagtcacccacagagaagtgatgtttacaaatcagatttggataagaccttgcctaatattcaagaagtacaggcagcatttgtaaaactgaagcagctatgcgttaatgagccttttgaagaaactgaagagaaatggttatcttcactggaaaatactcgatggttagaatatgtaagggcattccttaagcattcagcagaacttgtatacatgctagaaagcaaacatctctctgtagtcctacaagaggaggaaggaagagacttgagctgttgtgtagcttctcttgttcaagtgatgctggatccctattttaggacaattactggatttcagagtctgatacagaaggagtgggtcatggcaggatatcagtttctagacagatgcaaccatctaaagagatcagagaaagagtctcctttatttttgctattcttggatgccacctggcagctgttagaacaatatcctgcagcttttgagttctccgaaacctacctggcagtgttgtatgacagcacccggatctcactgtttggcaccttcctgttcaactcccctcaccagcgagtgaagcaaagcacggataaaaagttgtacaaaacaagattattttccttcacgagtttgaagtttctggtcacaattcattga

SEQ ID NO: 5123 - DNA, 4870 bp, Homo sapiens
agaaagggcctgggcggccgcactgagagctttacgcccggaggcgtcggcgctgccactggcccgcgacgggaacggggcgaaaaggcggcggcaccatgttctccctcaagccgcccaaacccaccttcaggtcctacctcctgccaccgccccagactgacgataagatcaattcggaaccgaagattaaaaaactggagccagtccttttgccaggagaaattgtcgtaaatgaagtcaattttgtgagaaaatgcattgcaacagacacaagccagtacgatttgtggggaaagctgatatgcagtaacttcaaaatctcctttattacagatgacccaatgccattacagaaattccattacagaaaccttcttcttggtgaacacgatgtccctttaacatgtattgagcaaattgtcacagtaaacgaccacaagaggaagcagaaagtcctaggccccaaccagaaactgaaatttaatccaacagagttaattatttattgtaaagatttcagaattgtcagatttcgctttgatgaatcaggtcccgaaagtgctaaaaagcaaacaaaattaatggaattccctcaggagatggaggaggaggaggaggaggaggtaatggagctggtggtggcagcagccagaaaactccactctttgaaacttactcggattgggacagagaaatcaagaggacaggtgcttccgggtggagagtttgttctattaacgagggttacatgatatccacttgccttccagaatacattgtagtgccaagttctttagcagaccaagatctaaagatcttttcccattcttttgttgggagaaggatgccactctggtgctggagccactctaacggcagtgctcttgtgcgaatggccctcatcaaagacgtgctgcagcagaggaagattgaccagaggatttgtaatgcaataactaaaagtcacccacagagaagtgatgtttacaaatcagatttggataagaccttgcctaatattcaagaagtacaggcagcatttgtaaaactgaagcagctatgcgttaatgagccttttgaagaaactgaagagaaatggttatcttcactggaaaatactcgatggttagaatatgtaagggcattccttaagcattcagcagaacttgtatacatgctagaaagcaaacatctctctgtagtcctacaagaggaggaaggaagagacttgagctgttgtgtagcttctcttgttcaagtgatgctggatccctattttaggacaattactggatttcagagtctgatacagaaggagtgggtcatggcaggatatcagtttctagacagatgcaaccatctaaagagatcagagaaagagtctcctttatttttgctattcttggatgccacctggcagctgttagaacaatatcctgcagcttttgagttctccgaaacctacctggcagtgttgtatgacagcacccggatctcactgtttggcaccttcctgttcaactcccctcaccagcgagtgaagcaaagcacggaatttgctataagcaaaaacatccaattgggtgatgagaagggcttaaaattcccctctgtttgggactggtctctccagtttacagcaaaggatcgcacccttttccataaccccttctacattggaaagagcacaccttgtatacagaatggctccgtgaagtcttttaaacggacaaagaaaagctacagctccacactaagaggaatgccgtctgccttaaagaatggaatcatcagtgaccaagaattacttccaaggagaaattcattgatattaaaaccaaagccagatccagctcagcaaaccgacagccagaacagtgatacggagcagtattttagagaatggttttccaaacccgccaacctgcacggtgttattctgccacgtgtctctggaacacacataaaactgtggaaactgtgctacttccgctgggttcccgaggcccagatcagcctgggtggctccatcacagcctttcacaagctctccctcctggctgatgaagtcgacgtactgagcaggatgctgcggcaacagcgcagtggccccctggaggcctgctatggggagctgggccagagcaggatgtacttcaacgccagcggccctcaccacaccgacacctcggggacaccggagtttctctcctcctcatttccattttctcctgtagggaatctgtgcagacgaagcattttaggaacaccattaagcaaatttttaagtggggccaaaatatggttgtctactgagacattagcaaatgaagactaaaatagggtgttttctgaacattttgagggaagctgtcaacttttttcctctgaattaacattgctaacctaggcgtttgaatctctaataactttatatgtaagaataatagttggaatttgcactaatatttaaaaacatgttgaatcatgcttctttcacacttattttaagagagatgtaaattttgttcctgtcctctttctgtcattacaggtctggctcttgtaaccgtgatcaaactgttcatgttgtctgctacatttttgtctccatccatttttcctaccacctcctgaaggctatctgatagtcagtcacattagcagccccaggcagcagacaacaggaaagttaggaaatttgtgtttcgtgtcatttttaggagcatctgataaaacctccagcaggttttaggaagtattcatgtatttttctggttactttctgtcgtctctaattgaactcacctgatgaaggttcagtgttctggggccagaatttatgattttagatcaccttctttggaaccttagatcactgtgttttgaaatcatgagtttgcttttaacttcatagggtcaactttaaaatgatatgcactgttaattttaaagcatttgctgcagataattaaacttagaagtgcctttgactttaggatacaaatattacagaagaaaatataatttcactttttaaaattggggtgggaaaatcccattgcatatttgaaataggcttttcatactaagcttcatagccaggagtccccagagtcttgttcctctgaaagccactggggagtggcctctggggtgctgattccacagaggtgtatgctgtagacaggagagtgccatctatgccaaaactcgccctcaaaaacaaacaaggcttgctgggaggcgtgctgggcttggccatcagtatttccagtgtggtaaactattgctggcacttccccctggaaataactaatgaggttacgagttgggcacctgcacagatgtccttctctcatagttcctaatgcttaggaatagaggagaaataaaaaaatggattctctcaaaacactgccatttgaatagcgacagaagtgctcccccagcccccaactttggacagcaaagttgaggagaatgagcagacacagttgtttgcttgatctgaatctctctaaagtaaagtatttccaaactgtgtgacaagagcctacctaccactgtagcggtcaaagctgaagcttcttacagcagtgaaacggggcaccacctcccccacactcctcattccccgcttaaaacatggatactttcaaatttgactgtttcttaaactgccatcctaagatatggaaaatttttatagtaaagtgtctagttagcttatttccttttctaaaacaagtgttttcaagataactgtattttacctttatatgtactgaatagctgtttctttttgaattatttgccttttaaaatttgataatgtctctggatataacaggacaggagttcttaaaaaatatcttaagaaattcactttatgggtaaacccaaggtttttgccaacttgttgcctagaaaataagggctagtttcagtttatacaaatagaattattaaacattttacagtccttgattagaaaccagacccaatctccttataacaccacagcgtatcctgccattgacagtgtaatcacaattctccctttttcatttagctgcttttttattattactaaatgttttggattgagcatttttccctctgtaattttcttccttcacgtttattttaactcttgtagtattttattgttgttaatttacaagtttaaaaatattaggtactattaataatggttaaaaatagaaaaatgcatatttttgtatgataatcaaatgtaaaatacttttatttttgctggacagttgttatatcatgattattgtgctacagtttattgtgcataatatgaaaaacaactatgacagccttcagtcgggccagggtgaagctgcttataccacctctgccgtcagagggacatgtggtgacagcagtggtgtggctgcacagggcgcactagagagagctcagcacccctgctgcccgccagcagagcccgtgctgagggaatgccgcacagatgctgatgcactgggtgaaatttctagtattgaacgtaaaggtgtacagtgtcttgctgttattttatgatggaaactgattttgaaaccaaaaatagctaactaactttatttaaggaaaggatattaatttgtactaacagagggtgaaagctgttcacatttgtcaacaaaatctgcttgctgcagtagtaacctcaagtggttaaaacttgatttcccgagaaaactaaaacctttgtgcctaaaattgatgacttgagttcaagtgggatgagcaagaagatgtgttatcttgttgttcaacagtattgaatgtgaaggaaattttgatggcttaataaaattccacagcgactgtt

SEQ ID NO: 5124 - DNA, 4961 bp, Homo sapiens
agaaagggcctgggcggccgcactgagagctttacgcccggaggcgtcggcgctgccactggcccgcgacgggaacggggcgaaaaggcggcggcaccatgttctccctcaagccgcccaaacccaccttcaggtcctacctcctgccaccgccccagactgacgataagatcaattcggaaccgaagattaaaaaactggagccagtccttttgccaggagaaattgtcgtaaatgaagtcaattttgtgagaaaatgcattgcaacagacacaagccagtacgatttgtggggaaagctgatatgcagtaacttcaaaatctcctttattacagatgacccaatgccattacagaaattccattacagaaaccttcttcttggtgaacacgatgtccctttaacatgtattgagcaaattgtcacagtaaacgaccacaagaggaagcagaaagtcctaggccccaaccagaaactgaaatttaatccaacagagttaattatttattgtaaagatttcagaattgtcagatttcgctttgatgaatcaggtcccgaaagtgctaaaaaggtatgccttgcaatagctcattattcccagccaacagacctccagctactctttgcatttgaatatgttgggaaaaaataccacaattcagcaaacaaaattaatggaattccctcaggagatggaggaggaggaggaggaggaggtaatggagctggtggtggcagcagccagaaaactccactctttgaaacttactcggattgggacagagaaatcaagaggacaggtgcttccgggtggagagtttgttctattaacgagggttacatgatatccacttgccttccagaatacattgtagtgccaagttctttagcagaccaagatctaaagatcttttcccattcttttgttgggagaaggatgccactctggtgctggagccactctaacggcagtgctcttgtgcgaatggccctcatcaaagacgtgctgcagcagaggaagattgaccagaggatttgtaatgcaataactaaaagtcacccacagagaagtgatgtttacaaatcagatttggataagaccttgcctaatattcaagaagtacaggcagcatttgtaaaactgaagcagctatgcgttaatgagccttttgaagaaactgaagagaaatggttatcttcactggaaaatactcgatggttagaatatgtaagggcattccttaagcattcagcagaacttgtatacatgctagaaagcaaacatctctctgtagtcctacaagaggaggaaggaagagacttgagctgttgtgtagcttctcttgttcaagtgatgctggatccctattttaggacaattactggatttcagagtctgatacagaaggagtgggtcatggcaggatatcagtttctagacagatgcaaccatctaaagagatcagagaaagagtctcctttatttttgctattcttggatgccacctggcagctgttagaacaatatcctgcagcttttgagttctccgaaacctacctggcagtgttgtatgacagcacccggatctcactgtttggcaccttcctgttcaactcccctcaccagcgagtgaagcaaagcacggaatttgctataagcaaaaacatccaattgggtgatgagaagggcttaaaattcccctctgtttgggactggtctctccagtttacagcaaaggatcgcacccttttccataaccccttctacattggaaagagcacaccttgtatacagaatggctccgtgaagtcttttaaacggacaaagaaaagctacagctccacactaagaggaatgccgtctgccttaaagaatggaatcatcagtgaccaagaattacttccaaggagaaattcattgatattaaaaccaaagccagatccagctcagcaaaccgacagccagaacagtgatacggagcagtattttagagaatggttttccaaacccgccaacctgcacggtgttattctgccacgtgtctctggaacacacataaaactgtggaaactgtgctacttccgctgggttcccgaggcccagatcagcctgggtggctccatcacagcctttcacaagctctccctcctggctgatgaagtcgacgtactgagcaggatgctgcggcaacagcgcagtggccccctggaggcctgctatggggagctgggccagagcaggatgtacttcaacgccagcggccctcaccacaccgacacctcggggacaccggagtttctctcctcctcatttccattttctcctgtagggaatctgtgcagacgaagcattttaggaacaccattaagcaaatttttaagtggggccaaaatatggttgtctactgagacattagcaaatgaagactaaaatagggtgttttctgaacattttgagggaagctgtcaacttttttcctctgaattaacattgctaacctaggcgtttgaatctctaataactttatatgtaagaataatagttggaatttgcactaatatttaaaaacatgttgaatcatgcttctttcacacttattttaagagagatgtaaattttgttcctgtcctctttctgtcattacaggtctggctcttgtaaccgtgatcaaactgttcatgttgtctgctacatttttgtctccatccatttttcctaccacctcctgaaggctatctgatagtcagtcacattagcagccccaggcagcagacaacaggaaagttaggaaatttgtgtttcgtgtcatttttaggagcatctgataaaacctccagcaggttttaggaagtattcatgtatttttctggttactttctgtcgtctctaattgaactcacctgatgaaggttcagtgttctggggccagaatttatgattttagatcaccttctttggaaccttagatcactgtgttttgaaatcatgagtttgcttttaacttcatagggtcaactttaaaatgatatgcactgttaattttaaagcatttgctgcagataattaaacttagaagtgcctttgactttaggatacaaatattacagaagaaaatataatttcactttttaaaattggggtgggaaaatcccattgcatatttgaaataggcttttcatactaagcttcatagccaggagtccccagagtcttgttcctctgaaagccactggggagtggcctctggggtgctgattccacagaggtgtatgctgtagacaggagagtgccatctatgccaaaactcgccctcaaaaacaaacaaggcttgctgggaggcgtgctgggcttggccatcagtatttccagtgtggtaaactattgctggcacttccccctggaaataactaatgaggttacgagttgggcacctgcacagatgtccttctctcatagttcctaatgcttaggaatagaggagaaataaaaaaatggattctctcaaaacactgccatttgaatagcgacagaagtgctcccccagcccccaactttggacagcaaagttgaggagaatgagcagacacagttgtttgcttgatctgaatctctctaaagtaaagtatttccaaactgtgtgacaagagcctacctaccactgtagcggtcaaagctgaagcttcttacagcagtgaaacggggcaccacctcccccacactcctcattccccgcttaaaacatggatactttcaaatttgactgtttcttaaactgccatcctaagatatggaaaatttttatagtaaagtgtctagttagcttatttccttttctaaaacaagtgttttcaagataactgtattttacctttatatgtactgaatagctgtttctttttgaattatttgccttttaaaatttgataatgtctctggatataacaggacaggagttcttaaaaaatatcttaagaaattcactttatgggtaaacccaaggtttttgccaacttgttgcctagaaaataagggctagtttcagtttatacaaatagaattattaaacattttacagtccttgattagaaaccagacccaatctccttataacaccacagcgtatcctgccattgacagtgtaatcacaattctccctttttcatttagctgcttttttattattactaaatgttttggattgagcatttttccctctgtaattttcttccttcacgtttattttaactcttgtagtattttattgttgttaatttacaagtttaaaaatattaggtactattaataatggttaaaaatagaaaaatgcatatttttgtatgataatcaaatgtaaaatacttttatttttgctggacagttgttatatcatgattattgtgctacagtttattgtgcataatatgaaaaacaactatgacagccttcagtcgggccagggtgaagctgcttataccacctctgccgtcagagggacatgtggtgacagcagtggtgtggctgcacagggcgcactagagagagctcagcacccctgctgcccgccagcagagcccgtgctgagggaatgccgcacagatgctgatgcactgggtgaaatttctagtattgaacgtaaaggtgtacagtgtcttgctgttattttatgatggaaactgattttgaaaccaaaaatagctaactaactttatttaaggaaaggatattaatttgtactaacagagggtgaaagctgttcacatttgtcaacaaaatctgcttgctgcagtagtaacctcaagtggttaaaacttgatttcccgagaaaactaaaacctttgtgcctaaaattgatgacttgagttcaagtgggatgagcaagaagatgtgttatcttgttgttcaacagtattgaatgtgaaggaaattttgatggcttaataaaattccacagcgactgtt

SEQ ID NO: 5125 - DNA, 2249 bp, Homo sapiens
catctctcccgccctctccagagtcgactgaagtttccgaggagacttctcaggctgggctggacacacctttccaaggacccccaaactctgctccgtgcacgtcaaatgctcctttcccttgtgtccaaccccctacccctctccctaacacccctcttctcaacaagactcagcctctccccgaggtgggtgagcatccttgaggtttcccacccttaactgctgtgtccccggatggagccagagaaatgtggtgggggggccggggccagagtttcaacattgccccccagaaggaggagccagagatggggtctgtccaggaaaataggatgccggagcccaggagtcgtcagcctagcagttgcctggcctccagatgcctcccaggggagcagatcctagcatgggccccaggggtgaggaagggcctggaaccagaattgtctggaaccctgatctgtaccaactttagggtcaccttccagccctgtggatggcagtggaatcaggacactcccttgaacagtgaatacgattttgccctggtcaacattggacgattagaggctgtgagcggcttgtcccgagtccagctcctccgtccagggtccctgcataaatttatccctgaggagattctgattcatggccgagacttccggctgctcagagttggttttgaggctggaggcctagagcctcaggcttttcaggtgaccatggccattgtccaagccagagctcagagcaatcaagcccaacagtattcggggataaccctgagcaaggctggccagggttctggctccagaaaaccaccaattcctctcatggagacagcggaagactgggagactgagcggaagaagcaggcagccagaggctggagggtcagcacggtcaacgagaggttcgacgtagccaccaggctccggtgtttctcctcttccttgattgtgtctggcagctcctccagcagtttccagctgattttgaattctctgagtttttccttcttgctcttcatgacagtgtcagggttcctgacacccttaccttcctgagaaataccccctgggagcgcggaaagcagagcggacagttaaactcctatacacaagtctacaccccaggatactcccagcctccagctgggaactcttttaacctgcagctgtctgtctgggactgggatttacgttatagcaatgcacagatactacaattccagaatcctggctatgacccagaacactgtccagattcctggctccctagaccacagccaagcttcatggttcctggaccccccagttctgtgtggctcttctctagaggagcattgacccccctgaatcagctctgtccttggcgggacagtccttccctgctggcagtctcttctcgttggctccctcgacctgctatctcctctgaaagcctggctgaccaggaatggggtctcccctcacattggggagcttgccctttacctccagggctgctgctgcctgggtatctgggaccccagatcaggctctggagacgctgctacctgaggggaaggcctgaggtccagatgggcctctcagctcccacaatctctggcctccaggatgagctatcccatcttcaggagttattacggaaatggacaccaagaatatctcctgaggatcactccaagaaaagagatccacataccattctcaatcccactgaaattgctggcattctcaaaggcagggcagagggggatctggggtagaggagggttctgtctaatcttttttttttttttttgtatctgcacttgcagcctcagctttcacacttcagcccttaagttcactaagaaggtctgagtttctgctgcagatagtggtgttaactgctccaactcttgtcttgcttagtttctacaaatatttttgcttcttgtcatttgaaggattaagaaacaaaaacaatccagaaattgatcggtttttttaggccaatcccatcccttctggataaccagatgttaaatcatgagatcagagatgctgttcatcagtcccaacaagatggcctagaaatcgcattctcacctcgccttgctgctgctttaattccaagttctatttcttcccttatagttttctatgggaatgaggcggatacaggaaacaccctatctcctctgtatttttgtagtggaatttctatttaaggggctcattaaagcatagtatttatac

SEQ ID NO: 5126 - DNA, 2324 bp, Homo sapiens
acagacactgatctcagtttcccccgagagtgtgagtgtaggcctctacaggcagctgcctctggggagttggggagcctaggggttaactctagacccccctcaaccctctggaccaaagtctgtccaggaaaataggatgccggagcccaggagtcgtcagcctagcagttgcctggcctccagatgcctcccagggtcaccttccagccctgtggatggcagtggaatcaggacactcccttgaacagtgaatacgattttgccctggtcaacattggacgattagaggctgtgagcggcttgtcccgagtccagctcctccgtccagggtccctgcataaatttatccctgaggagattctgattcatggccgagacttccggctgctcagagttggttttgaggctggaggcctagagcctcaggcttttcaggtgaccatggccattgtccaagccagagctcagagcaatcaagcccaacagtattcggggataaccctgagcaaggctggccagggttctggctccagaaaaccaccaattcctctcatggagacagcggaagactgggagactgagcggaagaagcaggcagccagaggctggagggtcagcacggtcaacgagaggttcgacgtagccaccagcctcccccgttacttctgggtccctaaccgaattctggacagtgaggtcaggagagcatttggccactttcatcagggccgtggaccgcgcttgtcctggcatcaccctgggggcagtgatcttctccgctgtggaggcttctatacagccagtgaccctaacaaggaggatatcagagcagtggagttgatgctccaggctgggcattcagatgttgtcctggtagacactatggatgagctgcccagccttgcagatgtccaacttgcccacctgaggctgagggccctctgcctgcctgattcatctgtagctgaggataaatggctttcagccctggaaggaacacgatggctggactatgtcagggcttgtcttcgaaaggccagtgacatttcagtattagtgacatccagggttcgttctgtaatacttcaagagcgcggtgatcgtgatctcaatggcctcctctcttcactcgtccagctgctttcagcccccgaagcccgaacactgtttggcttccaatcactagtacagcgagagtgggtggcagctggacatcccttcctgactcggcttgggggaactggggccagtgaagaggctccggtgtttctcctcttccttgattgtgtctggcagctcctccagcagtttccagctgattttgaattctctgagtttttccttcttgctcttcatgacagtgtcagggttcctgacacccttaccttcctgagaaataccccctgggagcgcggaaagcagagcggacagttaaactcctatacacaagtctacaccccaggatactcccagcctccagctgggaactcttttaacctgcagctgtctgtctgggactgggatttacgttatagcaatgcacagatactacaattccagaatcctggctatgacccagaacactgtccagattcctggctccctagaccacagccaagcttcatggttcctggaccccccagttctgtgtggctcttctctagaggagcattgacccccctgaatcagctctgtccttggcgggacagtccttccctgctggcagtctcttctcgttggctccctcgacctgctatctcctctgaaagcctggctgaccaggaatggggtctcccctcacattggggagcttgccctttacctccagggctgctgctgcctgggtatctgggaccccagatcaggctctggagacgctgctacctgaggggaaggcctgaggtccagatgggcctctcagctcccacaatctctggcctccaggatgagctatcccatcttcaggagttattacggaaatggacaccaagaatatctcctgaggatcactccaagaaaagagatccacataccattctcaatcccactgaaattgctggcattctcaaaggccaatcccatcccttctggataaccagatgttaaatcatgagatcagagatgctgttcatcagtcccaacaagatggcctagaaatcgcattctcacctcgccttgctgctgctttaattccaagttctatttcttcccttatagttttctatgggaatgaggcggatacaggaaacaccctatctcctctgtatttttgtagtggaatttctatttaaggggctcattaaagcatagtatttatacac

SEQ ID NO: 5127 - DNA, 1458 bp, Homo sapiens
ctttccaaggacccccaaactctgctccgtgcacgtcaaatgctcctttcccttgtgtccaaccccctacccctctccctaacacccctcttctcaacaagactcagcctctccccgaggtgggtgagcatccttgaggtttcccacccttaactgctgtgtccccggatggagccagagaaatgtggtgggggggccggggccagagtttcaacattgccccccagaaggaggagccagagatggggtctgtccaggaaaataggatgccggagcccaggagtcgtcagcctagcagttgcctggcctccagatgcctcccaggacactcccttgaacagtgaatacgattttgccctggtcaacattggacgattagaggctgacttcagtgagcggcttgtcccgagtccagctcctccgtccagggtccctgcataaatttatccctgaggagattctgattcatggccgagacttccggctgctcagagttggttttgaggctggaggcctagagcctcaggcttttcaggtgaccatggccattgtccaagccagagctcagagcaatcaagcccaacagtattcggggataaccctgagcaaggctggccagggttctggctccagaaaaccaccaattcctctcatggagacagcggaagactgggagactgagcggaagaagcaggcagccagaggctggagggtcagcacggtcaacgagaggttcgacgtagccaccagcctcccccgttacttctgggtccctaaccgaattctggacagtgaggtcaggagagcatttggccactttcatcagggccgtggaccgcgcttgtcctggcatcaccctgggggcagtgatcttctccgctgtggaggcttctatacagccagtgaccctaacaaggaggatatcagagcagtggagttgatgctccaggctgggcattcagatgttgtcctggtagacactatggatgagctgcccagccttgcagatgtccaacttgcccacctgaggctgagggccctctgcctgcctgattcatctgtagctgaggataaatggctttcagccctggaaggaacacgatggctggactatgtcagggcttgtcttcgaaaggccagtgacatttcagtattagtgacatccagggttcgttctgtaatacttcaagctgctttcagcccccgaagcccgaacactgtttggcttccaatcactagtacagcgagagtgggtggcagctggacatcccttcctgactcggcttgggggaactggggccagtgaagaggctccggtgtttctcctcttccttgattgtgtctggcagctcctccagcagtttccagctgattttgaattctctgagtttttccttcttgctcttcatgacagtgtcagggttcctgacacccttaccttcctgagaaataccccct

SEQ ID NO: 5128 - DNA, 2689 bp, Homo sapiens
catctctcccgccctctccagagtcgactgaagtttccgaggagacttctcaggctgggctggacacacctttccaaggacccccaaactctgctccgtgcacgtcaaatgctcctttcccttgtgtccaaccccctacccctctccctaacacccctcttctcaacaagactcagcctctccccgaggtgggtgagcatccttgaggtttcccacccttaactgctgtgtccccggatggagccagagaaatgtggtgggggggccggggccagagtttcaacattgccccccagaaggaggagccagagatggggtctgtccaggaaaataggatgccggagcccaggagtcgtcagcctagcagttgcctggcctccagatgcctcccaggggagcagatcctagcatgggccccaggggtgaggaagggcctggaaccagaattgtctggaaccctgatctgtaccaactttagggtcaccttccagccctgtggatggcagtggaatcaggacactcccttgaacagtgaatacgattttgccctggtcaacattggacgattagaggctgtgagcggcttgtcccgagtccagctcctccgtccagggtccctgcataaatttatccctgaggagattctgattcatggccgagacttccggctgctcagagttggttttgaggctggaggcctagagcctcaggcttttcaggtgaccatggccattgtccaagccagagctcagagcaatcaagcccaacagtattcggggataaccctgagcaaggctggccagggttctggctccagaaaaccaccaattcctctcatggagacagcggaagactgggagactgagcggaagaagcaggcagccagaggctggagggtcagcacggtcaacgagaggttcgacgtagccaccagcctcccccgttacttctgggtccctaaccgaattctggacagtgaggtcaggagagcatttggccactttcatcagggccgtggaccgcgcttgtcctggcatcaccctgggggcagtgatcttctccgctgtggaggcttctatacagccagtgaccctaacaaggaggatatcagagcagtggagttgatgctccaggctgggcattcagatgttgtcctggtagacactatggatgagctgcccagccttgcagatgtccaacttgcccacctgaggctgagggccctctgcctgcctgattcatctgtagctgaggataaatggctttcagccctggaaggaacacgatggctggactatgtcagggcttgtcttcgaaaggccagtgacatttcagtattagtgacatccagggttcgttctgtaatacttcaaggctccggtgtttctcctcttccttgattgtgtctggcagctcctccagcagtttccagctgattttgaattctctgagtttttccttcttgctcttcatgacagtgtcagggttcctgacacccttaccttcctgagaaataccccctgggagcgcggaaagcagagcggacagttaaactcctatacacaagtctacaccccaggatactcccagcctccagctgggaactcttttaacctgcagctgtctgtctgggactgggatttacgttatagcaatgcacagatactacaattccagaatcctggctatgacccagaacactgtccagattcctggctccctagaccacagccaagcttcatggttcctggaccccccagttctgtgtggctcttctctagaggagcattgacccccctgaatcagctctgtccttggcgggacagtccttccctgctggcagtctcttctcgttggctccctcgacctgctatctcctctgaaagcctggctgaccaggaatggggtctcccctcacattggggagcttgccctttacctccagggctgctgctgcctgggtatctgggaccccagatcaggctctggagacgctgctacctgaggggaaggcctgaggtccagatgggcctctcagctcccacaatctctggcctccaggatgagctatcccatcttcaggagttattacggaaatggacaccaagaatatctcctgaggatcactccaagaaaagagatccacataccattctcaatcccactgaaattgctggcattctcaaaggcagggcagagggggatctggggtagaggagggttctgtctaatcttttttttttttttttgtatctgcacttgcagcctcagctttcacacttcagcccttaagttcactaagaaggtctgagtttctgctgcagatagtggtgttaactgctccaactcttgtcttgcttagtttctacaaatatttttgcttcttgtcatttgaaggattaagaaacaaaaacaatccagaaattgatcggtttttttaggccaatcccatcccttctggataaccagatgttaaatcatgagatcagagatgctgttcatcagtcccaacaagatggcctagaaatcgcattctcacctcgccttgctgctgctttaattccaagttctatttcttcccttatagttttctatgggaatgaggcggatacaggaaacaccctatctcctctgtatttttgtagtggaatttctatttaaggggctcattaaagcatagtatttatac

SEQ ID NO: 5129 - DNA, 2856 bp, Homo sapiens
catctctcccgccctctccagagtcgactgaagtttccgaggagacttctcaggctgggctggacacacctttccaaggacccccaaactctgctccgtgcacgtcaaatgctcctttcccttgtgtccaaccccctacccctctccctaacacccctcttctcaacaagactcagcctctccccgaggtgggtgagcatccttgaggtttcccacccttaactgctgtgtccccggatggagccagagaaatgtggtgggggggccggggccagagtttcaacattgccccccagaaggaggagccagagatggggtctgtccaggaaaataggatgccggagcccaggagtcgtcagcctagcagttgcctggcctccagatgcctcccaggggagcagatcctagcatgggccccaggggtgaggaagggcctggaaccagaattgtctggaaccctgatctgtaccaactttagggtcaccttccagccctgtggatggcagtggaatcaggacactcccttgaacagtgaatacgattttgccctggtcaacattggacgattagaggctgtgagcggcttgtcccgagtccagctcctccgtccagggtccctgcataaatttatccctgaggagattctgattcatggccgagacttccggctgctcagagttggttttgaggctggaggcctagagcctcaggcttttcaggtgaccatggccattgtccaagccagagctcagagcaatcaagcccaacagtattcggggataaccctgagcaaggctggccagggttctggctccagaaaaccaccaattcctctcatggagacagcggaagactgggagactgagcggaagaagcaggcagccagaggctggagggtcagcacggtcaacgagaggttcgacgtagccaccagcctcccccgttacttctgggtccctaaccgaattctggacagtgaggtcaggagagcatttggccactttcatcagggccgtggaccgcgcttgtcctggcatcaccctgggggcagtgatcttctccgctgtggaggcttctatacagccagtgaccctaacaaggaggatatcagagcagtggagttgatgctccaggctgggcattcagatgttgtcctggtagacactatggatgagctgcccagccttgcagatgtccaacttgcccacctgaggctgagggccctctgcctgcctgattcatctgtagctgaggataaatggctttcagccctggaaggaacacgatggctggactatgtcagggcttgtcttcgaaaggccagtgacatttcagtattagtgacatccagggttcgttctgtaatacttcaagagcgcggtgatcgtgatctcaatggcctcctctcttcactcgtccagctgctttcagcccccgaagcccgaacactgtttggcttccaatcactagtacagcgagagtgggtggcagctggacatcccttcctgactcggcttgggggaactggggccagtgaagaggctccggtgtttctcctcttccttgattgtgtctggcagctcctccagcagtttccagctgattttgaattctctgagtttttccttcttgctcttcatgacagtgtcagggttcctgacacccttaccttcctgagaaataccccctgggagcgcggaaagcagagcggacagttaaactcctatacacaagtctacaccccaggatactcccagcctccagctgggaactcttttaacctgcagctgtctgtctgggactgggatttacgttatagcaatgcacagatactacaattccagaatcctggctatgacccagaacactgtccagattcctggctccctagaccacagccaagcttcatggttcctggaccccccagttctgtgtggctcttctctagaggagcattgacccccctgaatcagctctgtccttggcgggacagtccttccctgctggcagtctcttctcgttggctccctcgacctgctatctcctctgaaagcctggctgaccaggaatggggtctcccctcacattggggagcttgccctttacctccagggctgctgctgcctgggtatctgggaccccagatcaggctctggagacgctgctacctgaggggaaggcctgaggtccagatgggcctctcagctcccacaatctctggcctccaggatgagctatcccatcttcaggagttattacggaaatggacaccaagaatatctcctgaggatcactccaagaaaagagatccacataccattctcaatcccactgaaattgctggcattctcaaaggcagggcagagggggatctggggtagaggagggttctgtctaatcttttttttttttttttgtatctgcacttgcagcctcagctttcacacttcagcccttaagttcactaagaaggtctgagtttctgctgcagatagtggtgttaactgctccaactcttgtcttgcttagtttctacaaatatttttgcttcttgtcatttgaaggattaagaaacaaaaacaatccagaaattgatcggtttttttaggccaatcccatcccttctggataaccagatgttaaatcatgagatcagagatgctgttcatcagtcccaacaagatggcctagaaatcgcattctcacctcgccttgctgctgctttaattccaagttctatttcttcccttatagttttctatgggaatgaggcggatacaggaaacaccctatctcctctgtatttttgtagtggaatttctatttaaggggctcattaaagcatagtatttatac

SEQ ID NO: 5130 - DNA, 837 bp, Homo sapiens
agcgagcccagctccggtcccagccccggccgtcccggcgtcgcttcggagcgcggcggcagctgactgcgccttcacgatccgctgggacccgcgagccccgccgccgttatgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagaggatcagtgaagtggagcccaaatactatgcagatggggaggacgcctatgccatgaagcgggacctcactcagatggccgacgagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactggg

SEQ ID NO: 5131 - DNA, 1772 bp, Homo sapiens
cgcgccgagggaggggccggctccagctccggggcagcgcccgccccgcccccaggcccgccccgcgctgaccggctccgcgcattggcccgccccgtgcgctggcctgtcccgcgcattggccaagcggccgggaggacgggcccggcggccgtgcacttccggccggtggccggcccggcgcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagagtaaccgggccgccctgcacctctattccaacaccctcaactttcagatcagtgaagtggagcccaaatactatgcagatggggaggacgcctatgccatgaagcgggacctcactcagatggccgacgagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactggggaactttgtgtgtgagcgcgcgcacatttagagggtgtgtttctccaggtcctctggtggggatgtgagccttggccttttgacccagagcatcctgccaggcccgagtacaaggaaagagctttggaggtgggactccctagtctcatgaccttcagcagctgtggccccggggaaggaggccctggacttatgggagagaccctgccttggaggtctgcttggccacgctgaatgtgttttgtggcacaagccggggctgctcaggctcaaagctcaacagcagggctcccactcttggtggccttcagttctcttcccaccttcaccttcagactttctctccctaatcacacctgcttcgggctacagcagctccccagcatacccgtgggctccagatgtggacatccaactgctcattgggcttatctacaaatgtcctgtctgagtaatgacccagccagatgccccatcaacagtccttgagtcctccctcccctgccaccctaatggtcagtgagtccatgatacctcttgagtctactccctaacctgagtttgcatttgaaaataatttatttttagtacaattccccgcgtttccccattgacattttgtattagttggtgtatttgttattgttgatgcgccaatactgataagttattgtaaactaca

SEQ ID NO: 5132 - DNA, 3664 bp, Homo sapiens
agggccgtccgctctgctgccgccgctgttgcagccaccgccgttgccgcctccctgccggcaagtgtgtgaagaagaagctgagcgttgtcgccgccgctatggggagaaagtcaagcaaagccaaggagaagaagcagaagcggttggaggagcgagcagccatggatgccgtttgtgccaaagtggacgctgccaacaggcttggagaccctctggaggctttcccagtgttcaagaaatatgatagaaacgggttgaatgtctccattgaatgtaagcgagtgtctggactggagccagccaccgtggattgggccttcgacctgaccaaaacgaatatgcaaaccatgtatgagcagagcgagtggggctggaaggaccgagagaaacgggaggaaatgacagatgaccgagcctggtacctcatcgcgtgggaaaacagctccgtccctgttgccttttctcacttccggtttgacgtggagtgtggggatgaagtcctgtactgctatgaagtgcagttggaaagcaaggtgcggcggaaaggcctggggaagttcctcatacagatcctgcagctcatggccaacagcacacagatgaagaaggttatgttaacagtatttaaacacaatcatggtgcctaccagttcttcagagaagcgttgcaatttgaaattgatgactcttcccccagcatgtccggttgctgtggggaggattgctcctatgagatcctgagccggaggaccaagtttggggacagccatcactcccacgcgggtgggcactgtggtggctgctgccactgaactctcagagccactttcaagtcacaatgctctctcctaaggcctttcctctttcctggtctcactgttcaccgggtgtcctcagagctgtggcctccccagccctgcacgtgccaggctgcgccctgagagcacagaaccctggggagaagtggtatcagctgctcctcctctcctaggagaccagagtgctagaagggaatgaaagggagagggaagagtaggtggggccgggcagtgaagctcatcctccacagtggctgcctcctcatttggctcctggggcctgcagtggaggttctcgcacctctgcagcccctagattcctggcaacctcccctcccctgacacatacacacttggacaaatggaatgtttatgtccacctttatgaaagttctggagtcctgggtctggggtttgctggtccccaaagaggaacacactgggtgtaagatctgggtgtagagggcggcttcagagagactcacgcttgcgcagttggaattgctgttaacggagactgggaagatcttttgtgccaagatgcagggaaatgaagaaagctctttccagctgtttttatggattcatggagtgggctcatgttgggaccagctgactctgggaggaagactgcctctccatcgctgtcagagagcctgaaaggaccaacaatgaggtgttcttgggacccgccatggggatgattgcttctctaggctcctggatgttgctgcattctaagcttaacctcctggtctcatggcagtgacttgagcttttgattcatagaagaaagccagaggttctgcttgttcttgtctgccagccctcgtcgttctttctcctctgcctctcacctctaccccaaatacctctgttcttagtctcaaggggagaataacatcagggagcccctcatcttccccagaaggacttctcgttcctcatgtagttaactccattgattttcctatcttggtgctgatagctctctaagggtagggcacacctccccacagccaccctccctcttcagagagcccccagccagcagcaggcccctctgcctgcactcctcaggcttgcccctcgctgcctcagtgaggcactagtgccactgccgtggcccagccgggccatagctcaggctgcagcagaaatgcctctcagtggccaacagttgcttttctctctggtgtcaccctgtggcaacaggctggagcaggggaaggagaaagccttcctcttctctcataggatagaaaggcaggctcagaactaatgctcatcctgatctctaggccttgttcctcttccagggaagaaaagccaaatccttatcaaggaaaaagcacctaacagctccctttggatatccctgagctctgctgtggggagtatcataaaggttctagccttcgtgaagttgttctcgtggaggtctgttggtccctctgacctcagcatctgctcacatcccaccctctgcccaactctggcagtctctcctggcagatctccccagagtggtccttgcttctcacctggattcctgcttgtgcaggagcctgtgtacacagggcctccctcacccagcctggcccctctgctgagcactttgcgctgctcttgatgggcagcagtgggactgggaactccttagagagggccttgcagctttacactggaataagtctgcctctgcctctgcctcaccctgctggctcctggtgggtttcatcccaggcagagttgacattgctggaggggtttggtggactcctaagaatcatgaaaccacaggagcatgtttaggaagagatttgtctctggtccctgtctctgaaaggacacagatgctaaatatttattgtcttagatcatggattcctgatacctctcactcaaggggaccaaaagggacccccccgtgttcatcccttgtaaggtgagttcagtctacgttgtctctttccagtcactggatacgtggcaccaactggtcaatgggtgcttggtgccataccctgctcaccctagtctctgcaggccatgtcctgaagggttcctcaggaggtcgggactagggtgggagaggcactatctgagacctgcaatcactcttgttggtcttgagcccattcatttccaaaacatccatctttctccacttcccccaggtcttggttttgagaaacagcaggcatggctgagtgcggtggcttacacctgtaatcccagcactttgggaggctgaggcaggcgggtcacctgaggtcaggagttcaagaccagcctggtcaacatggcaaaagcccatctctactaaaaaatacaaaaatcagccaggcgtggttgtggcctgtaatcccagctactcgggaggctgaggcaggagactcgcttgaacccaggaggtggaggttgtggtgagctgagatcacgccattgcactccagcctaggcgacagagtgagactccatctcaaaaaaaaaaaaaagagaaacatagcaggccttttttaccaggctttttgtgttttgtttgtttgtttggagcatgttaagatttttttaagatttttaaaattttagttatatccaccctatttcaggttatttttgttggtgtcaagtatgtataggacatgtgaatggttctttttaatttttttttaagaggaaatttggaagataaactccttgatatatatatatatatatatatttttttttttctttagcagcttgttatcactggaatcaaagggaaaaagtgatctcttcttgcattggttgtatttgtatgtcacaaataaaagacactttggtcagctgctgag

SEQ ID NO: 5133 - DNA, 958 bp, Homo sapiens
agggccgtccgctctgctgccgccgctgttgcagccaccgccgttgccgcctccctgccggcaagtgtgtgaagaagaagctgagcgttgtcgccgccgctatggggagaaagtcaagcaaagccaaggagaagaagcagaagcggttggaggagcgagcagccatggatgccgtttgtgccaaagtggacgctgccaacagggttgaatgtctccattgaatgtaagcgagtgtctggactggagccagccaccgtggattgggccttcgacctgaccaaaacgaatatgcaaaccatgtatgagcagagcgagtggggctggaaggaccgagagaaacgggaggaaatgacagatgaccgagcctggtacctcatcgcgtgggaaaacagctccgtccctgttgccttttctcacttccggtttgacgtggagtgtggggatgaagtcctgtactgctatgaagtgcagttggaaagcaaggtgcggcggaaaggcctggggaagttcctcatacagatcctgcagctcatggccaacagcacacagatgaagaaggttatgttaacagtatttaaacacaatcatggtgcctaccagttcttcagagaagcgttgcaatttgaaattgatgactcttcccccagcatgtccggttgctgtggggaggattgctcctatgagatcctgagccggaggaccaagtttggggacagccatcactcccacgcgggtgggcactgtggtggctgctgccactgaactctcagagccactttcaagtcacaatgctctctcctaaggcctttcctctttcctggtctcactgttcaccgggtgtcctcagagctgtggcctccccagccctgcacgtgccaggctgcgccctgagagcacagaaccctggggagaagtggtatcagctgctcctcctctcctaggagaccagagtgctaga

SEQ ID NO: 5134 - DNA, 875 bp, Homo sapiens
gagtggcgggttcgggcgcagctgtagggttggctgcgcgccgccgaggcgttttggactgggttataaacaacttgtgaaatgagtgatttggaagatgatgagacaccccagctttctgcccatgccttagcagctctccaggaattttatgctgagcaaaagcaacaaattgagccaggcgaggatgataaatataacattggaataatagaagagaattggcaactgagccagttttggtatagtcaggaaactgctctgcagctggcacaggaggcaattgcagctgtaggagaaggtggcagaatcgcatgtgtgagtgcccctagtgtttaccagaaactcagagagctgtgcagagaaaacttttcgatatacatctttgaatatgacaaaagatttgccatgtatggagaggagtttattttctatgattacaataatccattggacttacccgaaagaattgctgcacatagttttgacatcgtaatagcagatcctccctatctttcggaggaatgtctcagaaaaacatcggaaaccgtcaagtacctgacgcggggcaagattctgctgtgcacaggtgccatcatggaagaacaggcagcagaactccttggagtgaagatgtgcacgtttgttccaagacacacccggaacttggcaaatgagtttcgctgttatgtgaattatgattctgggctggactgtgggatctgattacagacggtgacataacacaggaaggaaccctgtcacattcctctttttgtattttcgtagtagatttaaaagttataatctcttcccctccccccaaactggagctgtccctggcctggttttcaaaataaagtgtgcgatcttca

SEQ ID NO: 5135 - DNA, 1042 bp, Homo sapiens
gagtctgggcgactgcgcacgcgcggctggttataaacaacttgtgaaatgagtgatttggaagatgatgagacaccccagctttctgcccatgccttagcagctctccaggaattttatgctgagcaaaagcaacaaattgagccaggcgaggatgataaatataacattggaataatagaagagaattggcaactgagccagttttggtatagtcaggaaactgctctgcagctggcacaggaggcaattgcagctgtaggagaaggtggcagaatcgcatgtgtgagtgcccctagtgtttaccagaaactcagagagctgtgcagagaaaacttttcgatatacatctttgaatatgacaaaagatttgccatgtatggagaggagtttattttctatgattacaataatccattggacttacccgaaagaattgctgcacatagttttgacatcgtaatagcagatcctccctatctttcggaggaatgtctcagaaaaacatcggaaaccgtcaagtacctgacgcggggcaagattctgctgtgcacaggtgccatcatggaagaacaggcagcagaactccttggagtgaagatgtgcacgtttgttccaagacacacccggaacttggcaaatgagtttcgctgttatgtgaattatgattctgggctggactgtgggatctgattacagacggtgacataacacaggaaggaaccctgtcacattcctctttttgtattttcgtagtagatttaaaagttataatctcttcccctccccccaaactggagctgtccctggcctggttttcaaaataaagtgtgcgatcttcattattgtttccttagggagggcgtccctagagctcagtcttctgccaacctgaatccatggaattcgagttggaagaaaccttagaatctgcctgatcttctctcctcatttaacatgtgtaaaaacagaagaacagttgtgtggcttgcccaagggctcctgaatgagacaggaccttggcctctgcctcgggccagag

SEQ ID NO: 5136 - DNA, 2935 bp, Homo sapiens
gaaccgatgggcgccccggcccgcgtcgccaacggagctgcggcgctgccccagcgctgaccgacgttagagtcgggctccgacagcgcggccgagtccccgcgcgtcatcctcctttgactcttgggggctccaaagggacctctctcttggcaccgggggtgtctgcgcccgccgcccgccccgcttggctttgcggcatctcggccctggctccagctccggctccggcgagggtcatgaagctggaagccagctgtggcacagccacctcagaggtccctaagccggaaaagaagactgcccgagatgcagagccaagctctgaaacccggccacaggaggtggaggccgagcccaggtcgggatcggggcctgaggctgaggccgagccattggacttcgtggtggccacggaacgggagtttgaggaagtgctggccatctcggggggcatctacggcggcctggactaccttcctagccgctaccacagctggctccgggaccccgaccgcacggtggtgctggccaagcgcaacggaggcgtgatcgcgctggagtcggtgaacgtgatcgacgccggggagacggtgctggtggaggggctgcgcgtggcgccctgggagcgcgggaagggcgtggccgggctgctgcagcgcttctgctcgcagctggtcaagagacagcacccgggggtcaaggtggcacggctcacccgggacgaccagctgggcccccgggagctgaagaaataccgcctaatcaccaagcagggcatccttttggtccgattcaacgcgtccgcgctgctggccgggctgggcgcgcggctggcggcgctgcggacctctggcaccttctcgccgctgcccaccgaggccgtgtccgaggcaggcggcgacgtggcacgcctcctgctgtcaccctccgtgcagcgcgacgtgcttccaggcgggaccatcatccaggactggcagccctaccggcctagcgaaagcaacctgcgcctgctggcggccaagggcctggagtggcgcgtggacagccgcgcgcgcccgcgcgtgctcacgctgtgcacgcgccccttccccatcccgcacggaggggacggcacttggcgctatctcaacatcgacgccttcggtagcgacggcgcgcaggtgcagagccagctgctgtggcacctgcagcgccaggccccgcgcctcgttggcctcaacgtcatgtgccagctcttcctggagccccagctgtggtcacagctggctgacttctgccaggtcgggctgggactggagctggtgaagggttatactgaacagtacctgctggaggccgacatctgaggcctctcctctggcggggagggggaaaaagacccgcccccttccgcagtttccccagccagcctctttcctgccatttccgacgctgcgtctcctgggaagtcccctctgactcctgccctcctgcccttaccggcgcaggtccccccactctgtcccttttgcccttactatcttgcctctagctcccccaaacaccattgcccactccctgacctgaacttgcggactattaggtgggggctgggggtgggggccttgagctgctgttatccaccctctgtttttccaaagaactggtccccgcacaggcttcagagtccttccttccctctccatcacctcacccggggcgtgaactccccctttcctggcttctcccttctgccccctcgtgggtggaagaactcaggagtgtgtgggatgcccagcctcgttcccgagcgcagccgcccaatccgcgtttcttttcttccttctgccctttctaaagccctaaaaactggtcctgcattgccctccacaccccaatcccctccccctgctcaagcttctggtgccagagatcagtgccctctccccacttctctctagcccctcatcctcatcctcgctggatctctacgacgcttaacaccgcagtgcccatttttctgtccctgttttccttcccatcaccagcccagtgtgcaatccagagagagagagagtgatactgtaaaatgaaatgtatttagaatgctcccccatttgggtccttgttcatctggtgatgcactttctgagcctgcctctctcactggggtttcctcctgctttgcacaactttgctatttcgcaggctcccccgtgccccagctcacccgagccgggcggggtggtggtggtggtggtggtgtgtgtgtggtgtggttctagctgaagagtttggtacagtggagggcgggtccctcagcctggcataggggctgtctcctggttccaaccaggccgccttctagtgcaactggaattcccacctcctggtatttctggacaccactccctttctctggatcatttatgcttttagaactttgagagtcttctatttaattgcaagtagtaacagctgcatctgcacagcgctgtctccaatactggttccccacatcaaaggcagagggagaaaacagaaggctgggaaagatcaaagtgacttctaagtcattcaaagtagctaggagcctcccagcgaatagaacccgggtgtcccaagcctagagcatgacctagaacttcactctgtgggatgatgttagcttgaacttcttgttgggcaatgcgtaggtgctaggagaatgttgacagtgagtttggggttcgctgggatgggatccgagatgtgggcagaggtggacaccagcaggtggaagaatgtggacaaggtggggggtaggggcagccgccgcttcgccactttccgcagctctggttttgctactgtgctgctctccttgggtgcatcctgtgcctggccacgctgccaccctccttgtcacggtgaccacgattgtatgacaataaaatggaccttttggccaccc

SEQ ID NO: 5137 - DNA, 613 bp, Homo sapiens
ttttcgctctcatctttgggcgctttgtgcagctgccttctttgtctccgcctctccggcgactgggctctcccttccctccctctcctccctcccccagtgtcaagaagccatcggcctcaagggcatcgatatttcagggtcatgaagctggaagccagctgtggcacagccacctcagaggtccctaagccggaaaagaagactgcccgagatgcagagccaagctctgaaacccggccacaggaggtggaggccgagcccaggtcgggatcggggcctgaggctgaggccgagccattggacttcgtggtggccacggaacgggagtttgaggaagtgctggccatctcggggggcatctacggcggcctggactaccttcctagccgctaccacagctggctccgggaccccgaccgcacggtggtgctggccaagcgcaacggaggcgtgatcgcgctggagtcggtgaacgtgatcgacgccggggagacggtgctggtggaggggctgcgcgtggcgccctgggagcgcgggaagggcgtggccgggctgctgcagcgcttctgctcgcagctggtcaagagacagcacccgggggtcaaggtgg

SEQ ID NO: 5138 - DNA, 1492 bp, Homo sapiens
cgacgttagagtcgggctccgacagcgcggccgagtccccgcgcgtcatcctcctttgactcttgggggctccaaagggacctctctcttggcaccgggggtgtctgcgcccgccgcccgccccgcttggctttgcggcatctcggccctggctccagctccggctccggcgagtgtcaagaagccatcggcctcaagggcatcgatatttcagggtcatgaagctggaagccagctgtggcacagccacctcagaggtccctaagccggaaaagaagactgcccgagatgcagagccaagctctgaaacccggccacaggaggtggaggccgagcccaggtcgggatcggggcctgaggctgaggccgagccattggacttcgtggtggccacggaacgggagtttgaggaagtgctggccatctcggggggcatctacggcggcctggactaccttcctagccgctaccacagctggctccgggaccccgaccgcacggtggtgctggccaagcgcaacggaggcgtgatcgcgctggagtcggtgaacgtgatcgacgccggggagacggtgctggtggaggggctgcgcgtggcgccctgggagcgcgggaagggcgtggccgggctgctgcagcgcttctgctcgcagctggtcaagagacagcacccgggggtcaaggtggcacggctcacccgggacgaccagctgggcccccgggagctgaagaaataccgcctaatcaccaagcagggcatccttttggtccgattcaacgcgtccgcgctgctggccgggctgggcgcgcggctggcggcgctgcggacctctggcaccttctcgccgctgcccaccgaggccgtgtccgaggcaggcggcgacgtggcacgcctcctgctgtcaccctccgtgcagcgcgacgtgcttccaggcgggaccatcatccaggactggcagccctaccggcctagcgaaagcaacctgcgcctgctggcggccaagggcctggagtggcgcgtggacagccgcgcgcgcccgcgcgtgctcacgctgtgcacgcgccccttccccatcccgcacggaggggacggcacttggcgctatctcaacatcgacgccttcggtagcgacggcgcgcaggtgcagagccagctgctgtggcacctgcagcgccaggccccgcgcctcgttggcctcaacgtcatgtgccagctcttcctggagccccagctgtggtcacagctggctgacttctgccaggtcgggctgggactggagctggtgaagggttatactgaacagtacctgctggaggccgacatctgaggcctctcctctggcggggagggggaaaaagacccgcccccttccgcagtttccccagccagcctctttcctgccatttccgacgctgcgtctcctgggaagtcccctctgactcctgccctcctgcccttaccggcgcaggtccccccactctgtcccttttg

SEQ ID NO: 5139 - DNA, 1163 bp, Homo sapiens
gaccaaagggtgcggctgctgcagaggtggctgatgcaggcaagagctgactctgagccctggcccagccaagctgacccctacactagaccctacacaccggatggagctgatcctgagtaccagcccagctgagctgactctggatcctgcgtgccagccaaagctgcccctggattccacatgccaaccagagatgaccttcaatcctggtccaactgagcttaccctggatcctgaacaccagccagaggagaccccagctcctagcctggctgagttgaccctggagcctgtgcaccgccgacccgagctcctggatgcttgtgctgacctcatcaatgatcagtggccccgcagccgcacctcccgcctgcactccctgggccagtcctcagatgccttccccctctgcctgatgctgctaagcccccaccccacacttgaagcagcacccgttgtggtgggccatgcccgcctgtcacgggtgctgaaccagccccagagcctcttagtggagacagtggtggtggcccgggccctgaggggccgtggctttggccgccgcctcatggagggcctggaggtctttgctcgggcccggggcttccgcaagctgcatctcaccacccatgaccaggtgcacttctatacccacctgggctaccagctgggtgagcctgtgcagggcctggtcttcaccagcagacggctgcctgccaccctgcttaatgccttccccacagccccctctccccggccacccaggaaggccccaaacctgactgcccaagctgccccaaggggtcccaagggacctccattgccaccaccccctcccctacctgagtgcctgaccatctcacccccagttccatcagggcccccttcaaaaagcctgctggagacacaatatcaaaatgtgagggggcgccccatattctggatggaaaaagacatctgaggccatccagggcaaggaactgtctttctggttcaatagactgccccgacagtctacaagcctcagcccactgaccatacctcagcccctagcccctggggggcagctttaacctgggcatgtttcctgggtaccagtggggccaggaggtggctctggctcagagccgtcagtgtggctgaataaaggctctcttggg

SEQ ID NO: 5140 - DNA, 1464 bp, Homo sapiens
aaaccaggggcgggttctaagcggcgacgcgcgggtgctgggaggccttagaacgccgtggcgtgccgcaggacgcgacggctgcagaacatccgccgcaccgctgggggccaacgttgtcggaccgaggagtccgaggtggcgactgagtgagatacccagctgtgcggagctaggacgcggaacatcccagaggccagcatcaacatgaggagagccactgtggtctgaagagatgctactgcctggagactggggtcttaacctccagcctggcactgagccacctgcaacctagcagcaggtgaccttggctcccagcctgactcagctgaacctggatcctgtgcataggcaagagctgactctgagccctggcccagccaagctgacccctacactagaccctacacaccggatggagctgatcctgagtaccagcccagctgagctgactctggatcctgcgtgccagccaaagctgcccctggattccacatgccaaccagagatgaccttcaatcctggtccaactgagcttaccctggatcctgaacaccagccagaggagaccccagctcctagcctggctgagttgaccctggagcctgtgcaccgccgacccgagctcctggatgcttgtgctgacctcatcaatgatcagtggccccgcagccgcacctcccgcctgcactccctgggccagtcctcagatgccttccccctctgcctgatgctgctaagcccccaccccacacttgaagcagcacccgttgtggtgggccatgcccgcctgtcacgggtgctgaaccagccccagagcctcttagtggagacagtggtggtggcccgggccctgaggggccgtggctttggccgccgcctcatggagggcctggaggtctttgctcgggcccggggcttccgcaagctgcatctcaccacccatgaccaggtgcacttctatacccacctgggctaccagctgggtgagcctgtgcagggcctggtcttcaccagcagacggctgcctgccaccctgcttaatgccttccccacagccccctctccccggccacccaggaaggccccaaacctgactgcccaagctgccccaaggggtcccaagggacctccattgccaccaccccctcccctacctgagtgcctgaccatctcacccccagttccatcagggcccccttcaaaaagcctgctggagacacaatatcaaaatgtgagggggcgccccatattctggatggaaaaagacatctgaggccatccagggcaaggaactgtctttctggttcaatagactgccccgacagtctacaagcctcagcccactgaccatacctcagcccctagcccctggggggcagctttaacctgggcatgtttcctgggtaccagtggggccaggaggtggctctggctcagagccgtcagtgtggctgaata

SEQ ID NO: 5141 - DNA, 1873 bp, Homo sapiens
gggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccagcaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacggagtgaccacgctaggtctgaccaagtttgaggctaaaattgggcaaggaaatgaaccaagcatccggatgttccagaaacttcactttgagcaggtggctacgagcagtgtttttcaggaggtgaccctcagactgacagtgagtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagaccagagccctgcactgggagagtgctcctggcccaggctgggaatcacctttcgaggcccttcagactctggcggggcttgctgtggcctccctccagctagtggtgtggctgagcagactccagggccagggccagttcccttctcccctcccggccaaacccagacccagactctaggaagctggaatggagggcagggatccatgggagatgtcgggatgaaggtgggagctggaggtgcagggggacctggaacatggatgggagtggacaggcctttctccttagaggccagaggtgctgccctggctgggagtgaagctccaggcactaccagctttcctgattttcccgtttggtccatgtgaagagctaccacgagccccagcctcacagtgtccactcaagggcagcttggtcctcttgtcctgcagaggcaggctggtgtgaccctgggaacttgacccgggaacaacaggtggtccagagtgagtgtggcctggcccctcaacctagtgtccgtcctcctctctcctggagccagtcttgagtttaaaggcattagtgttagatacagctccttgtggctggaaaacacccctctgctgataaagctcagggggcactgaggaagcagaggccccttgggggtgccctcctgaagagagcgtcaggccatcagctctgtccctctggtgctcccacgtctgttcctcaccctccatctctgggagcagctgcacctgactggccacgcgggggcagtggaggcacaggctcagggtggccgggctacctggcaccctatggcttacaaagtagagttggcccagtttccttccacctgaggggagcactctgactcctaacagtcttccttgccctgccatcatctggggtggctggctgtcaagaaaggccgggcatgctttctaaacacagccacaggaggcttgtagggcatcttccaggtggggaaacagtcttagataagtaaggtgacttgcctaaggcctcccagcacccttgatcttggagtctcacagcagactgcatgtgaacaactggaaccgaaaacatgcctcagtataaaacaaacattataaaacg

SEQ ID NO: 5142 - DNA, 5687 bp, Homo sapiens
atggactcacaattccacatggctggggaggcctcacaatcatggctgaaggcaaaggagaagcaaagaggcacatcttacatggtggcagtcattgagtgggagatagagcggagcctgctgagctcagaggaccgggaacagggagccaccgtcttccttagagagatccaagacctccacaaacacatccttgaagactgcgcccttaggatggtggaccggctcgcggatggctgcctggacgctgatgcccagaaccttctcagcagcctcaaaagtcacatcactgacatgcacccaggggtcctcaagacccaccgcctgccgtggagccgcgacttggtgaaccccaagaacaagactcacgcctgctacctgaaggagctgggtgagcagtttgtggtgagggccaatcaccaggtcctcacacgcctccgtgagctggatacggccggacaggagttggcgtggctctaccaagagatccgccaccacctttggcagagctcggaggtcattcagaccttctgcggacgccaggaactcctggcccggcttgggcagcagctcaggcacgatgacagcaagcagcacacccccctggtactctttgggcccccaggcattggaaagacagccctgatgtgcaagctggctgagcagatgccaaggctgctggggcacaagacagtgaccgtcctgcggctgctggggacgtcacaaatgagctcagatgcccgtggcctgctgaagagcatctgcttccaggtgtgcctggcctatgggctgcccttgccccctgcccaggttctggacgcccacaccagggtggtccagtttttccataccctcctccacactgtctcttgcagaaacttcgagtctctcgtgctcctgctggatgctatggatgacctggactctgtccgccatgctcggagggttccctggctgcctctcaactgccccccgagggtgcacctcatcctctcagcttgctcgggggcactgggggttttggacaccttgcagcgggtgctcctggacccggaggcctactgggaggtgaagcccctttccggaaaccaaggccagcagatgatccaactcctgctggcagctgcaaggaggacgctgagcccggtgcacacagatttgctctgggccagcctcccagagtgtgggaacccagggcggctgaggctggcgtttgaggaagcccggaaatgggcctctttcaccgtgcctgtcccgctggccaccaccgcagaggaagccacgcaccaactctgcacccgcctggagcagacacacgggcagctcctcgtggcccacgtgctgggctacattgtgtcttcccgacacggtctctcggaggcggagctgaaggatgttttgtccctggacgacgaggtcctgcaggatgtgtaccgagattggaccccgcccagcaaggagctgctgcgcttcccgcccctgctgtgggtgcggcttcgtcgggatctgggatactacttggcccggcggcccgtggatggcttcaccctcctggccattgcccacagacagctggtcgaggtggtccgtgagcgctacctgtcaggatccgagagagccaagaggcatggcgtcctggccgacttcttctcagggacctggagccagggtaccaagaagctcatcactctgccacttgtggggaaaccactgaacttggaccgaaaggtggccccgcagcctctgtggttctcacatacggttgcaaacctgcggaagctgaaggagttgccctatcacctgcttcactcgggccgcctggaggagctgaaacaggaggttctgggcagcatgagctggatttcctgccggggcatctctgggggcattgaagacctgctggatgactttgacctgtgtgcccctcacctggactcccctgaggttggcctggtccgtgaagccctccagctctgccgccctgctgtggagctccgaggcatggagaggagcctcctgtacacagaactgctggccagactccatttcttcgccacctcacatccagcactggtgggacagctatgccaacaggcccagagctggttccagttgtgcgcacaccctgtgctggtgcccctcggaggattcctccagcccccgggaggacccctccgggcaactctcagcggctgtcacaaaggcatcaccgccatggcatggggtgtggaggagaagctgctggtgattggcacccaggatggcatcatggctgtgtgggacatggaagagcagcatgtgatccacatgctaactggacacacaggagaggtgaggtgtgtgaaaatatttgccaaagggaccctcgccaactctgcttcaaaggattacacgctgcacttgtggaacttactctctggccaggagaaatttaccatttgggatggaggctcaaaaaatcccgctgaacctcagatctggaaccttcatgtggatgaggcacacaaagttgtgtattcagcatctggctcaaagatcaatgcttggaatctggaaactgcagagccggtattccatatcctgggagatgcctctgatccttggatgtgcatggccgtgctggcctcccaggccacactgctgacagtgtccagggatggtgtggtcagtctgtggagctcagctacgggaaaacttcaggggaagcaacatatgtccagcatcaaagaagaaacacctacctgtgccgtctcagtccagaagcaaggaaagcttgttaccgggtttagcaatggctccatctctttggtttcctccaaaggggacagattgctggagaagcttccagatgctgtgaggttcctggtggtctctgaagatgagtccctcctcgccgcaggctttggaagatcggtgcggatattcttggcggactcgaggggctttcgccgattcatggccatggatctggaacatgaagacatggtggagacggctgtttttggtactgagaacaacctgatcatcacggggtcccttgatgcgctcattcaggtgtggagtctgtcagaacaggggacccttctggacatcctggaaggcgtcggggcccccgtgagcctgctggcccgcggcggggctttggtggcatctgcttccccacagtcctcatctttcaaggtctgggatctcagcgatgctcataggtcccgggtgcctgcaccatttctggaccgcaccggcctcaccgcagtgtcccacaatggaagctacgtctacttccccaaaattggggacaaaaacaaagtcactatttgggacttggcagaaggcgaggaacaagattccctggacacctccagtgagatcaggtgtctggaggttgctgagcagcgcaagctcctatttacgggcctcgtgtcgggggtcgtccttgtgttccccctgaattccaggcaggacgtgatatgcattccccctcccgaggcccggaaagcaatcaactgcatgtccctgagcaagtgcgaggaccgcctggccatcgcctatgacaacatcgtcctggtgctggacatcacctccggggacccctgcccggtcatcgatgggccaagatacaccttttacactcagctgcccgagaccctctccagcgtggccattctgacggactaccgcgtggtctacagcatgaccaatggggacctctttctttacgagtgtgcaacttccaaagcgtttcccttggagacccacaggagccgagttgcctgtgtggaggtcagccacaaggagcagctggtggtcagcgggtctgaggatgccctgctgtgtctctgggacctgcaggcacgcaagtggaaattcgagatgagctacacgagttcttactgcagaggggtccaatgtgcttgcttctccaaggatgacaagtatgtgtacgtgggcttaaaggatcgctctatacttgtttggagtgtgctggatggcaccctgctgacagtccagtttgtccatgctgtggtaaacagaatcatcccaaccaccagtggcttcattgcccccaccaggcatggttatctgatccgagagaatttccagtgcctttcagcaaaagcctcaccgcaggaccctcttaagaacttcaagaaggcaatgtggatggtcaaatccaggcagagagaggagctagttgcagctgcaggagctccccaggacttggagtcagaaagtgcccagggaaatgaaaccaaatcaaacaaatgctcacaagtgtgcctgatagtgtaaaaaaataaaaataaaaaaaccctgtgggggtatggggctccagtgagttagccccatttaatctagttaaagcaaaaagaatacgtttgctggtgtatatctggacccatggcttcagattatggcttcagaccttgtctcttctcatctttccattattctttcctctttttcattttcattctcagacttgccacccccaggttagcaacatggtggccaatatgctgctgtctccaatttcaatagaaaagagagcttctctttcccaacagtcctagcctcaactctactggtcccaattggcccatacgcctagccctaaaccaattattatatctgggagaatgcagagctctaatcggctagactgatccaatgtccaccactgggactgagaatagaagagattactcctgagatgcaaactggagttctggtaccagatgaagggggaacggatgaatgtgagatacagcaaatcactgatgtggaccacagaacctcacagtttataaagctgtaggtgctgtcatctgatcctcatcacaactcatactttagggagggcaggagtttctgtatctattttacagatgaggaaactgagccttgcggaagtagttataatttgattcaggtcacaagtccaaggtgcaagagctctgagagtgagccttctgtcccattcctgttagacctcactccaatttcagtctgcagagcacaaccatctcttccacaggcaccacactcaaatgctcacaggagctagtgactaatctagacacttccatgcacctgggtgagcagcagggagagacagagactggacatgtggaaggcagagattgtgtctagggtgggtatgagcagcctgactgtagcccagaatcaccatggccaaacaagcccactgctgtcagtgcttccagttgtaataagcaaagccagaaatccagacttttatgcaaaaatgttctgacttttaaagttggcgattggttgaatttatatctatagtgcatttggcatgtgcgtctttggttaatgagctgacttcaggactcacgctggcagtaaaacaatcaacatgttatagttcatccctctctattccttggctcccaaacttttgggataaagatgtgggtttttaatcttaaaaactggaggctcttggaagtagaaagagctgctgatctctccctgctttgcttttgaactgtctgccttgtgcaagttcaacagtcaaactgttttcattccacttaagtggatctttcttctttgcccacagccttctaaaagcccttctcagtcttctcaggcttttactttaatgctaggatagtctaaatcttcaaggtggctatcccttctcccctccgtggaat

SEQ ID NO: 5143 - DNA, 5989 bp, Homo sapiens
tggatgcagagagggaagccctgcagagcactgcctaccctgaagtgccagaccttctgccagaggcacggcttgatgtttgaggtcgttgatctgaggtggggtattcggaacattgaagccactgaccacttgaccacagaactctgcttggaggaggttgaccggtgttggaaaacatccatagggccagcttttgttgccctcatcggtgatcagtacggcccctgtctgattccctcgcggatcgatgagaaggagtgggaggtattgagggaccatctgactgccaggccaagtgacctggagctggtggcacgatacttccagagggacgagaatgcgtttcctcccacctacgtcctgcaggcaccaggtactggggaggcctgtgaaccagaggaggccaccttaacttctgtcctacgctctggagcccaggaggcccggaggctggggctcatcacccaggagcagtggcagcactaccaccggtcagtcattgagtgggagatagagcggagcctgctgagctcagaggaccgggaacagggagccaccgtcttccttagagagatccaagacctccacaaacacatccttgaagactgcgcccttaggatggtggaccggctcgcggatggctgcctggacgctgatgcccagaaccttctcagcagcctcaaaagtcacatcactgacatgcacccaggggtcctcaagacccaccgcctgccgtggagccgcgacttggtgaaccccaagaacaagactcacgcctgctacctgaaggagctgggtgagcagtttgtggtgagggccaatcaccaggtcctcacacgcctccgtgagctggatacggccggacaggagttggcgtggctctaccaagagatccgccaccacctttggcagagctcggaggtcattcagaccttctgcggacgccaggaactcctggcccggcttgggcagcagctcaggcacgatgacagcaagcagcacacccccctggtactctttgggcccccaggcattggaaagacagccctgatgtgcaagctggctgagcagatgccaaggctgctggggcacaagacagtgaccgtcctgcggctgctggggacgtcacaaatgagctcagatgcccgtggcctgctgaagagcatctgcttccaggtgtgcctggcctatgggctgcccttgccccctgcccaggttctggacgcccacaccagggtggtccagtttttccataccctcctccacactgtctcttgcagaaacttcgagtctctcgtgctcctgctggatgctatggatgacctggactctgtccgccatgctcggagggttccctggctgcctctcaactgccccccgagggtgcacctcatcctctcagcttgctcgggggcactgggggttttggacaccttgcagcgggtgctcctggacccggaggcctactgggaggtgaagcccctttccggaaaccaaggccagcagatgatccaactcctgctggcagctgcaaggaggacgctgagcccggtgcacacagatttgctctgggccagcctcccagagtgtgggaacccagggcggctgaggctggcgtttgaggaagcccggaaatgggcctctttcaccgtgcctgtcccgctggccaccaccgcagaggaagccacgcaccaactctgcacccgcctggagcagacacacgggcagctcctcgtggcccacgtgctgggctacattgtgtcttcccgacacggtctctcggaggcggagctgaaggatgttttgtccctggacgacgaggtcctgcaggatgtgtaccgagattggaccccgcccagcaaggagctgctgcgcttcccgcccctgctgtgggtgcggcttcgtcgggatctgggatactacttggcccggcggcccgtggatggcttcaccctcctggccattgcccacagacagctggtcgaggtggtccgtgagcgctacctgtcaggatccgagagagccaagaggcatggcgtcctggccgacttcttctcagggacctggagccagggtaccaagaagctcatcactctgccacttgtggggaaaccactgaacttggaccgaaaggtggccccgcagcctctgtggttctcacatacggttgcaaacctgcggaagctgaaggagttgccctatcacctgcttcactcgggccgcctggaggagctgaaacaggaggttctgggcagcatgagctggatttcctgccggggcatctctgggggcattgaagacctgctggatgactttgacctgtgtgcccctcacctggactcccctgaggttggcctggtccgtgaagccctccagctctgccgccctgctgtggagctccgaggcatggagaggagcctcctgtacacagaactgctggccagactccatttcttcgccacctcacatccagcactggtgggacagctatgccaacaggcccagagctggttccagttgtgcgcacaccctgtgctggtgcccctcggaggattcctccagcccccgggaggacccctccgggcaactctcagcggctgtcacaaaggcatcaccgccatggcatggggtgtggaggagaagctgctggtgattggcacccaggatggcatcatggctgtgtgggacatggaagagcagcatgtgatccacatgctaactggacacacaggagaggtgaggtgtgtgaaaatatttgccaaagggaccctcgccaactctgcttcaaaggattacacgctgcacttgtggaacttactctctggccaggagaaatttaccatttgggatggaggctcaaaaaatcccgctgaacctcagatctggaaccttcatgtggatgaggcacacaaagttgtgtattcagcatctggctcaaagatcaatgcttggaatctggaaactgcagagccggtattccatatcctgggagatgcctctgatccttggatgtgcatggccgtgctggcctcccaggccacactgctgacagtgtccagggatggtgtggtcagtctgtggagctcagctacgggaaaacttcaggggaagcaacatatgtccagcatcaaagaagaaacacctacctgtgccgtctcagtccagaagcaaggaaagcttgttaccgggtttagcaatggctccatctctttggtttcctccaaaggggacagattgctggagaagcttccagatgctgtgaggttcctggtggtctctgaagatgagtccctcctcgccgcaggctttggaagatcggtgcggatattcttggcggactcgaggggctttcgccgattcatggccatggatctggaacatgaagacatggtggagacggctgtttttggtactgagaacaacctgatcatcacggggtcccttgatgcgctcattcaggtgtggagtctgtcagaacaggggacccttctggacatcctggaaggcgtcggggcccccgtgagcctgctggcccgcggcggggctttggtggcatctgcttccccacagtcctcatctttcaaggtctgggatctcagcgatgctcataggtcccgggtgcctgcaccatttctggaccgcaccggcctcaccgcagtgtcccacaatggaagctacgtctacttccccaaaattggggacaaaaacaaagtcactatttgggacttggcagaaggcgaggaacaagattccctggacacctccagtgagatcaggtgtctggaggttgctgagcagcgcaagctcctatttacgggcctcgtgtcgggggtcgtccttgtgttccccctgaattccaggcaggacgtgatatgcattccccctcccgaggcccggaaagcaatcaactgcatgtccctgagcaagtgcgaggaccgcctggccatcgcctatgacaacatcgtcctggtgctggacatcacctccggggacccctgcccggtcatcgatgggccaagatacaccttttacactcagctgcccgagaccctctccagcgtggccattctgacggactaccgcgtggtctacagcatgaccaatggggacctctttctttacgagtgtgcaacttccaaagcgtttcccttggagacccacaggagccgagttgcctgtgtggaggtcagccacaaggagcagctggtggtcagcgggtctgaggatgccctgctgtgtctctgggacctgcaggcacgcaagtggaaattcgagatgagctacacggcaccctgctgacagtccagtttgtccatgctgtggtaaacagaatcatcccaaccaccagtggcttcattgcccccaccaggcatggttatctgatccgagagaatttccagtgcctttcagcaaaagcctcaccgcaggaccctcttaagaacttcaagaaggcaatgtggatggtcaaatccaggcagagagaggagctagttgcagctgcaggagctccccaggacttggagtcagaaagtgcccagggaaatgaaaccaaatcaaacaaatgctcacaagtgtgcctgatagtgtaaaaaaataaaaataaaaaaaccctgtgggggtatggggctccagtgagttagccccatttaatctagttaaagcaaaaagaatacgtttgctggtgtatatctggacccatggcttcagattatggcttcagaccttgtctcttctcatctttccattattctttcctctttttcattttcattctcagacttgccacccccaggttagcaacatggtggccaatatgctgctgtctccaatttcaatagaaaagagagcttctctttcccaacagtcctagcctcaactctactggtcccaattggcccatacgcctagccctaaaccaattattatatctgggagaatgcagagctctaatcggctagactgatccaatgtccaccactgggactgagaatagaagagattactcctgagatgcaaactggagttctggtaccagatgaagggggaacggatgaatgtgagatacagcaaatcactgatgtggaccacagaacctcacagtttataaagctgtaggtgctgtcatctgatcctcatcacaactcatactttagggagggcaggagtttctgtatctattttacagatgaggaaactgagccttgcggaagtagttataatttgattcaggtcacaagtccaaggtgcaagagctctgagagtgagccttctgtcccattcctgttagacctcactccaatttcagtctgcagagcacaaccatctcttccacaggcaccacactcaaatgctcacaggagctagtgactaatctagacacttccatgcacctgggtgagcagcagggagagacagagactggacatgtggaaggcagagattgtgtctagggtgggtatgagcagcctgactgtagcccagaatcaccatggccaaacaagcccactgctgtcagtgcttccagttgtaataagcaaagccagaaatccagacttttatgcaaaaatgttctgacttttaaagttggcgattggttgaatttatatctatagtgcatttggcatgtgcgtctttggttaatgagctgacttcaggactcacgctggcagtaaaacaatcaacatgttatagttcatccctctctattccttggctcccaaacttttgggataaagatgtgggtttttaatcttaaaaactggaggctcttggaagtagaaagagctgctgatctctccctgctttgcttttgaactgtctgccttgtgcaagttcaacagtcaaactgttttcattccacttaagtggatctttcttctttgcccacagccttctaaaagcccttctcagtcttctcaggcttttactttaatgctaggatagtctaaatcttcaaggtggctatcccttctcccctccgtggaat

SEQ ID NO: 5144 - DNA, 8398 bp, Homo sapiens
gaggagtctaaattggtcgttcaactaccagcaaaggctaaagagaggctggagcccccaggacagccagaacgctgacactgcaaagggcctctgtccttactggggaagcccagtcctgctcagctgtcttcttcagcaacaaacagaagtccagaaagagaaacagttgtggaggaagctgttgtgatgataatttactgagcacctactatgtgccaggcacgccagccttaccagacaagatccttgggctcatggaattcactttctcgtgggacagacaaacaataacatgtagaaacatatcagctgttgcaggcagtaaccaagggagcgtggccaggcgctgaagtgaattcgggtccaaggagcctgctgggacccaggaaaacgagagaaggaacagaaattgtggtggaggcaaattcaagatcagaagattggggaggaggtgctaagagaggtctggagagatgctgggacccagaactggggcctcagtgagatcagcaggctgcagctaaactgtggtatccaggtgagttgtgggaaggtggctggggggccgggctgggtttatgggggcggggtccgtggaggagaggggataccctccatgcccttccttgcagatatggatgcagagagggaagccctgcagagcactgcctaccctgaagtgccagaccttctgccagaggcacggcttgatgtttgaggtcgttgatctgaggtggggtattcggaacattgaagccactgaccacttgaccacagaactctgcttggaggaggttgaccggtgttggaaaacatccatagggccagcttttgttgccctcatcggtgatcagtacggcccctgtctgattccctcgcggatcgatgagaaggagtgggaggtattgagggaccatctgactgccaggccaagtgacctggagctggtggcacgatacttccagagggacgagaatgcgtttcctcccacctacgtcctgcaggcaccaggtactggggaggcctgtgaaccagaggaggccaccttaacttctgtcctacgctctggagcccaggaggcccggaggctggggctcatcacccaggagcagtggcagcactaccaccggtcaggtgaggccgcagggactcccctctggagacccacaagaaactgaccacgtgttcagaatatccatcccctgttggcaaaaatgcaacagtctgcatttcttgcaaatgccaaaccagtcaacctctggtccctcggctctgagaaaggctgttttactgatccaagatagttcagccatgttcctgatcaatcttggtctcaggatcttcctctcctcgctggctctttcttcttgtctcccagggaggttcctggcacaggggccgtattagtctgttctcatgccactaataaaggcatacttgaggctgggtaatttacaaaggaaagaggtttaatggactcacaattccacatggctggggaggcctcacaatcatggctgaaggcaaaggagaagcaaagaggcacatcttacatggtggcagtcattgagtgggagatagagcggagcctgctgagctcagaggaccgggaacagggagccaccgtcttccttagagagatccaagacctccacaaacacatccttgaagactgcgcccttaggatggtggaccggctcgcggatggctgcctggacgctgatgcccagaaccttctcagcagcctcaaaagtcacatcactgacatgcacccaggggtcctcaagacccaccgcctgccgtggagccgcgacttggtgaaccccaagaacaagactcacgcctgctacctgaaggagctgggtgagcagtttgtggtgagggccaatcaccaggtcctcacacgcctccgtgagctggatacggccggacaggagttggcgtggctctaccaagagatccgccaccacctttggcagagctcggaggtcattcagaccttctgcggacgccaggaactcctggcccggcttgggcagcagctcaggcacgatgacagcaagcagcacacccccctggtactctttgggcccccaggcattggaaagacagccctgatgtgcaagctggctgagcagatgccaaggctgctggggcacaagacagtgaccgtcctgcggctgctggggacgtcacaaatgagctcagatgcccgtggcctgctgaagagcatctgcttccaggtgtgcctggcctatgggctgcccttgccccctgcccaggttctggacgcccacaccagggtggtccagtttttccataccctcctccacactgtctcttgcagaaacttcgagtctctcgtgctcctgctggatgctatggatgacctggactctgtccgccatgctcggagggttccctggctgcctctcaactgccccccgagggtgcacctcatcctctcagcttgctcgggggcactgggggttttggacaccttgcagcgggtgctcctggacccggaggcctactgggaggtgaagcccctttccggaaaccaaggccagcagatgatccaactcctgctggcagctgcaaggaggacgctgagcccggtgcacacagatttgctctgggccagcctcccagagtgtgggaacccagggcggctgaggctggcgtttgaggaagcccggaaatgggcctctttcaccgtgcctgtcccgctggccaccaccgcagaggaagccacgcaccaactctgcacccgcctggagcagacacacgggcagctcctcgtggcccacgtgctgggctacattgtgtcttcccgacacggtctctcggaggcggagctgaaggatgttttgtccctggacgacgaggtcctgcaggatgtgtaccgagattggaccccgcccagcaaggagctgctgcgcttcccgcccctgctgtgggtgcggcttcgtcgggatctgggatactacttggcccggcggcccgtggatggcttcaccctcctggccattgcccacagacagctggtcgaggtggtccgtgagcgctacctgtcaggatccgagagagccaagaggcatggcgtcctggccgacttcttctcagggacctggagccagggtaccaagaagctcatcactctgccacttgtggggaaaccactgaacttggaccgaaaggtggccccgcagcctctgtggttctcacatacggttgcaaacctgcggaagctgaaggagttgccctatcacctgcttcactcgggccgcctggaggagctgaaacaggaggttctgggcagcatgagctggatttcctgccggggcatctctgggggcattgaagacctgctggatgactttgacctgtgtgcccctcacctggactcccctgaggttggcctggtccgtgaagccctccagctctgccgccctgctgtggagctccgaggcatggagaggagcctcctgtacacagaactgctggccagactccatttcttcgccacctcacatccagcactggtgggacagctatgccaacaggcccagagctggttccagttgtgcgcacaccctgtgctggtgcccctcggaggattcctccagcccccgggaggacccctccgggcaactctcagcggctgtcacaaaggcatcaccgccatggcatggggtgtggaggagaagctgctggtgattggcacccaggatggcatcatggctgtgtgggacatggaagagcagcatgtgatccacatgctaactggacacacaggagaggtgaggtgtgtgaaaatatttgccaaagggaccctcgccaactctgcttcaaaggattacacgctgcacttgtggaacttactctctggccaggagaaatttaccatttgggatggaggctcaaaaaatcccgctgaacctcagatctggaaccttcatgtggatgaggcacacaaagttgtgtattcagcatctggctcaaagatcaatgcttggaatctggaaactgcagagccggtattccatatcctgggagatgcctctgatccttggatgtgcatggccgtgctggcctcccaggccacactgctgacagtgtccagggatggtgtggtcagtctgtggagctcagctacgggaaaacttcaggggaagcaacatatgtccagcatcaaagaagaaacacctacctgtgccgtctcagtccagaagcaaggaaagcttgttaccgggtttagcaatggctccatctctttggtttcctccaaaggggacagattgctggagaagcttccagatgctgtgaggttcctggtggtctctgaagatgagtccctcctcgccgcaggctttggaagatcggtgcggatattcttggcggactcgaggggctttcgccgattcatggccatggatctggaacatgaagacatggtggagacggctgtttttggtactgagaacaacctgatcatcacggggtcccttgatgcgctcattcaggtgtggagtctgtcagaacaggggacccttctggacatcctggaaggcgtcggggcccccgtgagcctgctggcccgcggcggggctttggtggcatctgcttccccacagtcctcatctttcaaggtctgggatctcagcgatgctcataggtcccgggtgcctgcaccatttctggaccgcaccggcctcaccgcagtgtcccacaatggaagctacgtctacttccccaaaattggggacaaaaacaaagtcactatttgggacttggcagaaggcgaggaacaagattccctggacacctccagtgagatcaggtgtctggaggttgctgagcagcgcaagctcctatttacgggcctcgtgtcgggggtcgtccttgtgttccccctgaattccaggcaggacgtgatatgcattccccctcccgaggcccggaaagcaatcaactgcatgtccctgagcaagtgcgaggaccgcctggccatcgcctatgacaacatcgtcctggtgctggacatcacctccggggacccctgcccggtcatcgatgggccaagatacaccttttacactcagctgcccgagaccctctccagcgtggccattctgacggactaccgcgtggtctacagcatgaccaatggggacctctttctttacgagtgtgcaacttccaaagcgtttcccttggagacccacaggagccgagttgcctgtgtggaggtcagccacaaggagcagctggtggtcagcgggtctgaggatgccctgctgtgtctctgggacctgcaggcacgcaagtggaaattcgagatgagctacacgagttcttactgcagaggggtccaatgtgcttgcttctccaaggatgacaagtatgtgtacgtgggcttaaaggatcgctctatacttgtttggagtgtgctggatggcaccctgctgacagtccagtttgtccatgctgtggtaaacagaatcatcccaaccaccagtggcttcattgcccccaccaggcatggttatctgatccgagagaatttccagtgcctttcagcaaaagcctcaccgcaggaccctcttaagaacttcaagaaggcaatgtggatggtcaaatccaggcagagagaggagctagttgcagctgcaggagctccccaggacttggagtcagaaagtgcccagggaaatgaaaccaaatcaaacaaatgctcacaagtgtgcctgatagtgtaaaaaaataaaaataaaaaaaccctgtgggggtatggggctccagtgagttagccccatttaatctagttaaagcaaaaagaatacgtttgctggtgtatatctggacccatggcttcagattatggcttcagaccttgtctcttctcatctttccattattctttcctctttttcattttcattctcagacttgccacccccaggttagcaacatggtggccaatatgctgctgtctccaatttcaatagaaaagagagcttctctttcccaacagtcctagcctcaactctactggtcccaattggcccatacgcctagccctaaaccaattattatatctgggagaatgcagagctctaatcggctagactgatccaatgtccaccactgggactgagaatagaagagattactcctgagatgcaaactggagttctggtaccagatgaagggggaacggatgaatgtgagatacagcaaatcactgatgtggaccacagaacctcacagtttataaagctgtaggtgctgtcatctgatcctcatcacaactcatactttagggagggcaggagtttctgtatctattttacagatgaggaaactgagccttgcggaagtagttataatttgattcaggtcacaagtccaaggtgcaagagctctgagagtgagccttctgtcccattcctgttagacctcactccaatttcagtctgcagagcacaaccatctcttccacaggcaccacactcaaatgctcacaggagctagtgactaatctagacacttccatgcacctgggtgagcagcagggagagacagagactggacatgtggaaggcagagattgtgtctagggtgggtatgagcagcctgactgtagcccagaatcaccatggccaaacaagcccactgctgtcagtgcttccagttgtaataagcaaagccagaaatccagacttttatgcaaaaatgttctgacttttaaagttggcgattggttgaatttatatctatagtgcatttggcatgtgcgtctttggttaatgagctgacttcaggactcacgctggcagtaaaacaatcaacatgttatagttcatccctctctattccttggctcccaaacttttgggataaagatgtgggtttttaatcttaaaaactggaggctcttggaagtagaaagagctgctgatctctccctgctttgcttttgaactgtctgccttgtgcaagttcaacagtcaaactgttttcattccacttaagtggatctttcttctttgcccacagccttctaaaagcccttctcagtcttctcaggcttttactttaatgctaggatagtctaaatcttcaaggtggctatcccttctcccctccgtggaattcctgatagagtctcaataaaagcaaccttagaaacagaggcttttgagctgaacaagaccctactgctgtcttattcatccattttccaaaccagttttccaaggcaggttttggtagttctgcaaatgttagtgtcaaatttcatttaaaaatattttaaactgtaattttaagatgtatgcttggatgtattgggcagcagcttctaaggtgttgaagattactaaggttggtgcaaaaagtaactgtggttttcgccattaaaaatattaaaaataatggcaaaaactggctgggcacagtggctcacacctgtggtcccagctctttggaaggccgaggcaggtggatcacctgaggtcaggagtttgagaccagcctggacaacatggtgaaacccttctctactaaaaatacaaaaatcagccaggcatggtggtgagtgcctgtaatctcagttactcaggaggctgagtcaggagaatcacttgaacccgggaggcggaggttgcagtgagctgagattgtgccactgcactccagcctgggtgacagagcaagactccatctcataataataataataatggcaaaagcctcggtggctcacgcctgtaatcccagcactttgggaggctgaggcgggtggatcacttgaggccaggtgttcaagagcagcctggtcaacatggtgaaactctgtctctactcaaaaatacaaaaattagcctggtgtggtgacgtacacctgtaattccagctacttgggaggctgaggcaggagaatggcttgaacccgggaggcggaggttgcagtgagccgagatcgcaccactgcactccagcatgagtgacagagactctgtctccaaaaaaaaaaaaaaaaaaaagtaatggcaaaaaccacaattaattttgcatcaacctaataatttaggattcttctgccattttcatttaactgatttaactgaagagcccaattaaattgtgaagggagccctgaaaaaattagctactctttgccactgcttctctgtgaatcaagggcttacccaatgcagaaataaagtagatgttgagaccaattaagatttcacctacaaattctgattttaaatgcctgtgtccatctccacagcctcagtgagaattgattgttttgtagataaatcctaatttaaacattggaaatgcctttttactaataaaatgctacaacaaattattgctt

SEQ ID NO: 5145 - DNA, 6162 bp, Homo sapiens
tggatgcagagagggaagccctgcagagcactgcctaccctgaagtgccagaccttctgccagaggcacggcttgatgtttgaggtcgttgatctgaggtggggtattcggaacattgaagccactgaccacttgaccacagaactctgcttggaggaggttgaccggtgttggaaaacatccatagggccagcttttgttgagaaatgtgctgatccctgtcctggacagtaaagagggaaaaagtaaagaaaagtaccatggccaggccctcatcggtgatcagtacggcccctgtctgattccctcgcggatcgatgagaaggagtgggaggtattgagggaccatctgactgccaggccaagtgacctggagctggtggcacgatacttccagagggacgagaatgcgtttcctcccacctacgtcctgcaggcaccaggtactggggaggcctgtgaaccagaggaggccaccttaacttctgtcctacgctctggagcccaggaggcccggaggctggggctcatcacccaggagcagtggcagcactaccaccggtcagtcattgagtgggagatagagcggagcctgctgagctcagaggaccgggaacagggagccaccgtcttccttagagagatccaagacctccacaaacacatccttgaagactgcgcccttaggatggtggaccggctcgcggatggctgcctggacgctgatgcccagaaccttctcagcagcctcaaaagtcacatcactgacatgcacccaggggtcctcaagacccaccgcctgccgtggagccgcgacttggtgaaccccaagaacaagactcacgcctgctacctgaaggagctgggtgagcagtttgtggtgagggccaatcaccaggtcctcacacgcctccgtgagctggatacggccggacaggagttggcgtggctctaccaagagatccgccaccacctttggcagagctcggaggtcattcagaccttctgcggacgccaggaactcctggcccggcttgggcagcagctcaggcacgatgacagcaagcagcacacccccctggtactctttgggcccccaggcattggaaagacagccctgatgtgcaagctggctgagcagatgccaaggctgctggggcacaagacagtgaccgtcctgcggctgctggggacgtcacaaatgagctcagatgcccgtggcctgctgaagagcatctgcttccaggtgtgcctggcctatgggctgcccttgccccctgcccaggttctggacgcccacaccagggtggtccagtttttccataccctcctccacactgtctcttgcagaaacttcgagtctctcgtgctcctgctggatgctatggatgacctggactctgtccgccatgctcggagggttccctggctgcctctcaactgccccccgagggtgcacctcatcctctcagcttgctcgggggcactgggggttttggacaccttgcagcgggtgctcctggacccggaggcctactgggaggtgaagcccctttccggaaaccaaggccagcagatgatccaactcctgctggcagctgcaaggaggacgctgagcccggtgcacacagatttgctctgggccagcctcccagagtgtgggaacccagggcggctgaggctggcgtttgaggaagcccggaaatgggcctctttcaccgtgcctgtcccgctggccaccaccgcagaggaagccacgcaccaactctgcacccgcctggagcagacacacgggcagctcctcgtggcccacgtgctgggctacattgtgtcttcccgacacggtctctcggaggcggagctgaaggatgttttgtccctggacgacgaggtcctgcaggatgtgtaccgagattggaccccgcccagcaaggagctgctgcgcttcccgcccctgctgtgggtgcggcttcgtcgggatctgggatactacttggcccggcggcccgtggatggcttcaccctcctggccattgcccacagacagctggtcgaggtggtccgtgagcgctacctgtcaggatccgagagagccaagaggcatggcgtcctggccgacttcttctcagggacctggagccagggtaccaagaagctcatcactctgccacttgtggggaaaccactgaacttggaccgaaaggtggccccgcagcctctgtggttctcacatacggttgcaaacctgcggaagctgaaggagttgccctatcacctgcttcactcgggccgcctggaggagctgaaacaggaggttctgggcagcatgagctggatttcctgccggggcatctctgggggcattgaagacctgctggatgactttgacctgtgtgcccctcacctggactcccctgaggttggcctggtccgtgaagccctccagctctgccgccctgctgtggagctccgaggcatggagaggagcctcctgtacacagaactgctggccagactccatttcttcgccacctcacatccagcactggtgggacagctatgccaacaggcccagagctggttccagttgtgcgcacaccctgtgctggtgcccctcggaggattcctccagcccccgggaggacccctccgggcaactctcagcggctgtcacaaaggcatcaccgccatggcatggggtgtggaggagaagctgctggtgattggcacccaggatggcatcatggctgtgtgggacatggaagagcagcatgtgatccacatgctaactggacacacaggagaggtgaggtgtgtgaaaatatttgccaaagggaccctcgccaactctgcttcaaaggattacacgctgcacttgtggaacttactctctggccaggagaaatttaccatttgggatggaggctcaaaaaatcccgctgaacctcagatctggaaccttcatgtggatgaggcacacaaagttgtgtattcagcatctggctcaaagatcaatgcttggaatctggaaactgcagagccggtattccatatcctgggagatgcctctgatccttggatgtgcatggccgtgctggcctcccaggccacactgctgacagtgtccagggatggtgtggtcagtctgtggagctcagctacgggaaaacttcaggggaagcaacatatgtccagcatcaaagaagaaacacctacctgtgccgtctcagtccagaagcaaggaaagcttgttaccgggtttagcaatggctccatctctttggtttcctccaaaggggacagattgctggagaagcttccagatgctgtgaggttcctggtggtctctgaagatgagtccctcctcgccgcaggctttggaagatcggtgcggatattcttggcggactcgaggggctttcgccgattcatggccatggatctggaacatgaagacatggtggagacggctgtttttggtactgagaacaacctgatcatcacggggtcccttgatgcgctcattcaggtgtggagtctgtcagaacaggggacccttctggacatcctggaaggcgtcggggcccccgtgagcctgctggcccgcggcggggctttggtggcatctgcttccccacagtcctcatctttcaaggtctgggatctcagcgatgctcataggtcccgggtgcctgcaccatttctggaccgcaccggcctcaccgcagtgtcccacaatggaagctacgtctacttccccaaaattggggacaaaaacaaagtcactatttgggacttggcagaaggcgaggaacaagattccctggacacctccagtgagatcaggtgtctggaggttgctgagcagcgcaagctcctatttacgggcctcgtgtcgggggtcgtccttgtgttccccctgaattccaggcaggacgtgatatgcattccccctcccgaggcccggaaagcaatcaactgcatgtccctgagcaagtgcgaggaccgcctggccatcgcctatgacaacatcgtcctggtgctggacatcacctccggggacccctgcccggtcatcgatgggccaagatacaccttttacactcagctgcccgagaccctctccagcgtggccattctgacggactaccgcgtggtctacagcatgaccaatggggacctctttctttacgagtgtgcaacttccaaagcgtttcccttggagacccacaggagccgagttgcctgtgtggaggtcagccacaaggagcagctggtggtcagcgggtctgaggatgccctgctgtgtctctgggacctgcaggcacgcaagtggaaattcgagatgagctacacgagttcttactgcagaggggtccaatgtgcttgcttctccaaggatgacaagtatgtgtacgtgggcttaaaggatcgctctatacttgtttggagtgtgctggatggcaccctgctgacagtccagtttgtccatgctgtggtaaacagaatcatcccaaccaccagtggcttcattgcccccaccaggcatggttatctgatccgagagaatttccagtgcctttcagcaaaagcctcaccgcaggaccctcttaagaacttcaagaaggcaatgtggatggtcaaatccaggcagagagaggagctagttgcagctgcaggagctccccaggacttggagtcagaaagtgcccagggaaatgaaaccaaatcaaacaaatgctcacaagtgtgcctgatagtgtaaaaaaataaaaataaaaaaaccctgtgggggtatggggctccagtgagttagccccatttaatctagttaaagcaaaaagaatacgtttgctggtgtatatctggacccatggcttcagattatggcttcagaccttgtctcttctcatctttccattattctttcctctttttcattttcattctcagacttgccacccccaggttagcaacatggtggccaatatgctgctgtctccaatttcaatagaaaagagagcttctctttcccaacagtcctagcctcaactctactggtcccaattggcccatacgcctagccctaaaccaattattatatctgggagaatgcagagctctaatcggctagactgatccaatgtccaccactgggactgagaatagaagagattactcctgagatgcaaactggagttctggtaccagatgaagggggaacggatgaatgtgagatacagcaaatcactgatgtggaccacagaacctcacagtttataaagctgtaggtgctgtcatctgatcctcatcacaactcatactttagggagggcaggagtttctgtatctattttacagatgaggaaactgagccttgcggaagtagttataatttgattcaggtcacaagtccaaggtgcaagagctctgagagtgagccttctgtcccattcctgttagacctcactccaatttcagtctgcagagcacaaccatctcttccacaggcaccacactcaaatgctcacaggagctagtgactaatctagacacttccatgcacctgggtgagcagcagggagagacagagactggacatgtggaaggcagagattgtgtctagggtgggtatgagcagcctgactgtagcccagaatcaccatggccaaacaagcccactgctgtcagtgcttccagttgtaataagcaaagccagaaatccagacttttatgcaaaaatgttctgacttttaaagttggcgattggttgaatttatatctatagtgcatttggcatgtgcgtctttggttaatgagctgacttcaggactcacgctggcagtaaaacaatcaacatgttatagttcatccctctctattccttggctcccaaacttttgggataaagatgtgggtttttaatcttaaaaactggaggctcttggaagtagaaagagctgctgatctctccctgctttgcttttgaactgtctgccttgtgcaagttcaacagtcaaactgttttcattccacttaagtggatctttcttctttgcccacagccttctaaaagcccttctcagtcttctcaggcttttactttaatgctaggatagtctaaatcttcaaggtggctatcccttctcccctccgtggaat

SEQ ID NO: 5146 - DNA, 7641 bp, Homo sapiens
agtctaaattggtcgttcaactaccagcaaaggctaaagagaggctggagcccccaggacagccagaacgctgacactgcaaagggcctctgtccttactggggaagcccagtcctgctcagctgtcttcttcagcaacaaacagaagtccagaaagagaaacagttgtggaggaagctgttgtgatgataatttactgagcacctactatgtgccaggcacgccagccttaccagacaagatccttgggctcatggaattcactttctcgtgggacagacaaacaataacatgtagaaacatatcagctgttgaccatgcggccgatgccctgggagggagaccacttgcttaagtcctccaggagggcgatggaggagccggcattccaaccaggctcacggatgccaagatatggatgcagagagggaagccctgcagagcactgcctaccctgaagtgccagaccttctgccagaggcacggcttgatgtttgaggtcgttgatctgaggtggggtattcggaacattgaagccactgaccacttgaccacagaactctgcttggaggaggttgaccggtgttggaaaacatccatagggccagcttttgttgccctcatcggtgatcagtacggcccctgtctgattccctcgcggatcgatgagaaggagtgggaggtattgagggaccatctgactgccaggccaagtgacctggagctggtggcacgatacttccagagggacgagaatgcgtttcctcccacctacgtcctgcaggcaccaggtactggggaggcctgtgaaccagaggaggccaccttaacttctgtcctacgctctggagcccaggaggcccggaggctggggctcatcacccaggagcagtggcagcactaccaccggtcagtcattgagtgggagatagagcggagcctgctgagctcagaggaccgggaacagggagccaccgtcttccttagagagatccaagacctccacaaacacatccttgaagactgcgcccttaggatggtggaccggctcgcggatggctgcctggacgctgatgcccagaaccttctcagcagcctcaaaagtcacatcactgacatgcacccaggggtcctcaagacccaccgcctgccgtggagccgcgacttggtgaaccccaagaacaagactcacgcctgctacctgaaggagctgggtgagcagtttgtggtgagggccaatcaccaggtcctcacacgcctccgtgagctggatacggccggacaggagttggcgtggctctaccaagagatccgccaccacctttggcagagctcggaggtcattcagaccttctgcggacgccaggaactcctggcccggcttgggcagcagctcaggcacgatgacagcaagcagcacacccccctggtactctttgggcccccaggcattggaaagacagccctgatgtgcaagctggctgagcagatgccaaggctgctggggcacaagacagtgaccgtcctgcggctgctggggacgtcacaaatgagctcagatgcccgtggcctgctgaagagcatctgcttccaggtgtgcctggcctatgggctgcccttgccccctgcccaggttctggacgcccacaccagggtggtccagtttttccataccctcctccacactgtctcttgcagaaacttcgagtctctcgtgctcctgctggatgctatggatgacctggactctgtccgccatgctcggagggttccctggctgcctctcaactgccccccgagggtgcacctcatcctctcagcttgctcgggggcactgggggttttggacaccttgcagcgggtgctcctggacccggaggcctactgggaggtgaagcccctttccggaaaccaaggccagcagatgatccaactcctgctggcagctgcaaggaggacgctgagcccggtgcacacagatttgctctgggccagcctcccagagtgtgggaacccagggcggctgaggctggcgtttgaggaagcccggaaatgggcctctttcaccgtgcctgtcccgctggccaccaccgcagaggaagccacgcaccaactctgcacccgcctggagcagacacacgggcagctcctcgtggcccacgtgctgggctacattgtgtcttcccgacacggtctctcggaggcggagctgaaggatgttttgtccctggacgacgaggtcctgcaggatgtgtaccgagattggaccccgcccagcaaggagctgctgcgcttcccgcccctgctgtgggtgcggcttcgtcgggatctgggatactacttggcccggcggcccgtggatggcttcaccctcctggccattgcccacagacagctggtcgaggtggtccgtgagcgctacctgtcaggatccgagagagccaagaggcatggcgtcctggccgacttcttctcagggacctggagccagggtaccaagaagctcatcactctgccacttgtggggaaaccactgaacttggaccgaaaggtggccccgcagcctctgtggttctcacatacggttgcaaacctgcggaagctgaaggagttgccctatcacctgcttcactcgggccgcctggaggagctgaaacaggaggttctgggcagcatgagctggatttcctgccggggcatctctgggggcattgaagacctgctggatgactttgacctgtgtgcccctcacctggactcccctgaggttggcctggtccgtgaagccctccagctctgccgccctgctgtggagctccgaggcatggagaggagcctcctgtacacagaactgctggccagactccatttcttcgccacctcacatccagcactggtgggacagctatgccaacaggcccagagctggttccagttgtgcgcacaccctgtgctggtgcccctcggaggattcctccagcccccgggaggacccctccgggcaactctcagcggctgtcacaaaggcatcaccgccatggcatggggtgtggaggagaagctgctggtgattggcacccaggatggcatcatggctgtgtgggacatggaagagcagcatgtgatccacatgctaactggacacacaggagaggtgaggtgtgtgaaaatatttgccaaagggaccctcgccaactctgcttcaaaggattacacgctgcacttgtggaacttactctctggccaggagaaatttaccatttgggatggaggctcaaaaaatcccgctgaacctcagatctggaaccttcatgtggatgaggcacacaaagttgtgtattcagcatctggctcaaagatcaatgcttggaatctggaaactgcagagccggtattccatatcctgggagatgcctctgatccttggatgtgcatggccgtgctggcctcccaggccacactgctgacagtgtccagggatggtgtggtcagtctgtggagctcagctacgggaaaacttcaggggaagcaacatatgtccagcatcaaagaagaaacacctacctgtgccgtctcagtccagaagcaaggaaagcttgttaccgggtttagcaatggctccatctctttggtttcctccaaaggggacagattgctggagaagcttccagatgctgtgaggttcctggtggtctctgaagatgagtccctcctcgccgcaggctttggaagatcggtgcggatattcttggcggactcgaggggctttcgccgattcatggccatggatctggaacatgaagacatggtggagacggctgtttttggtactgagaacaacctgatcatcacggggtcccttgatgcgctcattcaggtgtggagtctgtcagaacaggggacccttctggacatcctggaaggcgtcggggcccccgtgagcctgctggcccgcggcggggctttggtggcatctgcttccccacagtcctcatctttcaaggtctgggatctcagcgatgctcataggtcccgggtgcctgcaccatttctggaccgcaccggcctcaccgcagtgtcccacaatggaagctacgtctacttccccaaaattggggacaaaaacaaagtcactatttgggacttggcagaaggcgaggaacaagattccctggacacctccagtgagatcaggtgtctggaggttgctgagcagcgcaagctcctatttacgggcctcgtgtcgggggtcgtccttgtgttccccctgaattccaggcaggacgtgatatgcattccccctcccgaggcccggaaagcaatcaactgcatgtccctgagcaagtgcgaggaccgcctggccatcgcctatgacaacatcgtcctggtgctggacatcacctccggggacccctgcccggtcatcgatgggccaagatacaccttttacactcagctgcccgagaccctctccagcgtggccattctgacggactaccgcgtggtctacagcatgaccaatggggacctctttctttacgagtgtgcaacttccaaagcgtttcccttggagacccacaggagccgagttgcctgtgtggaggtcagccacaaggagcagctggtggtcagcgggtctgaggatgccctgctgtgtctctgggacctgcaggcacgcaagtggaaattcgagatgagctacacggcaccctgctgacagtccagtttgtccatgctgtggtaaacagaatcatcccaaccaccagtggcttcattgcccccaccaggcatggttatctgatccgagagaatttccagtgcctttcagcaaaagcctcaccgcaggaccctcttaagaacttcaagaaggcaatgtggatggtcaaatccaggcagagagaggagctagttgcagctgcaggagctccccaggacttggagtcagaaagtgcccagggaaatgaaaccaaatcaaacaaatgctcacaagtgtgcctgatagtgtaaaaaaataaaaataaaaaaaccctgtgggggtatggggctccagtgagttagccccatttaatctagttaaagcaaaaagaatacgtttgctggtgtatatctggacccatggcttcagattatggcttcagaccttgtctcttctcatctttccattattctttcctctttttcattttcattctcagacttgccacccccaggttagcaacatggtggccaatatgctgctgtctccaatttcaatagaaaagagagcttctctttcccaacagtcctagcctcaactctactggtcccaattggcccatacgcctagccctaaaccaattattatatctgggagaatgcagagctctaatcggctagactgatccaatgtccaccactgggactgagaatagaagagattactcctgagatgcaaactggagttctggtaccagatgaagggggaacggatgaatgtgagatacagcaaatcactgatgtggaccacagaacctcacagtttataaagctgtaggtgctgtcatctgatcctcatcacaactcatactttagggagggcaggagtttctgtatctattttacagatgaggaaactgagccttgcggaagtagttataatttgattcaggtcacaagtccaaggtgcaagagctctgagagtgagccttctgtcccattcctgttagacctcactccaatttcagtctgcagagcacaaccatctcttccacaggcaccacactcaaatgctcacaggagctagtgactaatctagacacttccatgcacctgggtgagcagcagggagagacagagactggacatgtggaaggcagagattgtgtctagggtgggtatgagcagcctgactgtagcccagaatcaccatggccaaacaagcccactgctgtcagtgcttccagttgtaataagcaaagccagaaatccagacttttatgcaaaaatgttctgacttttaaagttggcgattggttgaatttatatctatagtgcatttggcatgtgcgtctttggttaatgagctgacttcaggactcacgctggcagtaaaacaatcaacatgttatagttcatccctctctattccttggctcccaaacttttgggataaagatgtgggtttttaatcttaaaaactggaggctcttggaagtagaaagagctgctgatctctccctgctttgcttttgaactgtctgccttgtgcaagttcaacagtcaaactgttttcattccacttaagtggatctttcttctttgcccacagccttctaaaagcccttctcagtcttctcaggcttttactttaatgctaggatagtctaaatcttcaaggtggctatcccttctcccctccgtggaattcctgatagagtctcaataaaagcaaccttagaaacagaggcttttgagctgaacaagaccctactgctgtcttattcatccattttccaaaccagttttccaaggcaggttttggtagttctgcaaatgttagtgtcaaatttcatttaaaaatattttaaactgtaattttaagatgtatgcttggatgtattgggcagcagcttctaaggtgttgaagattactaaggttggtgcaaaaagtaactgtggttttcgccattaaaaatattaaaaataatggcaaaaactggctgggcacagtggctcacacctgtggtcccagctctttggaaggccgaggcaggtggatcacctgaggtcaggagtttgagaccagcctggacaacatggtgaaacccttctctactaaaaatacaaaaatcagccaggcatggtggtgagtgcctgtaatctcagttactcaggaggctgagtcaggagaatcacttgaacccgggaggcggaggttgcagtgagctgagattgtgccactgcactccagcctgggtgacagagcaagactccatctcataataataataataatggcaaaagcctcggtggctcacgcctgtaatcccagcactttgggaggctgaggcgggtggatcacttgaggccaggtgttcaagagcagcctggtcaacatggtgaaactctgtctctactcaaaaatacaaaaattagcctggtgtggtgacgtacacctgtaattccagctacttgggaggctgaggcaggagaatggcttgaacccgggaggcggaggttgcagtgagccgagatcgcaccactgcactccagcatgagtgacagagactctgtctccaaaaaaaaaaaaaaaaaaaagtaatggcaaaaaccacaattaattttgcatcaacctaataatttaggattcttctgccattttcatttaactgatttaactgaagagcccaattaaattgtgaagggagccctgaaaaaattagctactctttgccactgcttctctgtgaatcaagggcttacccaatgcagaaataaagtagatgttgagaccaattaagatttcacctacaaattctgattttaaatgcctgtgtccatctccacagcctcagtgagaattgattgttttgtagataaatcctaatttaaacattggaaatgcctttttactaataaaatgctacaacaaattattgctta

SEQ ID NO: 5147 - DNA, 4972 bp, Homo sapiens
cccgcggcccgggatcccgagtgtccggagctccgtggtttctgttggacctcgcgggaggcggttttctcccgcctgctgtgctctgtgacctctctgctgcctcctccacggtctctgggcggagcaatccacactgctgagcctggggtggtttggaattcttcggcgaagtggagcgggctgagagtgggtttcccgtccccgagccctccctcatctcggagatgccgcacttgtgagcgacagggcttcatttgaattttcgcacctcgcgagttgcggagcctgcatctctgaagctgcctcggtgaagagccacagcattattttttttctctttgggagagtagctgtctgggatttgagatcctatcttccctgcaaattaccaggttgcatcttcactgataggaatacatttcttcaccaaaggacatggatgaaaatgaaagcaaccagtctctgatgacaagcagccaatatcctaaagaagcagtaagaaaacgtcaaaattcagcacggaattccggagcaagtgattcttctaggttttctaggaaaagcttcaaactggattatagactagaagaagatgtaactaaatccaagaaaggaaaagatgggagatttgtgaatccgtggccaacatggaaaaacccctctattccaaatgttctcagatggctgataatggagaaagatcacagcagtgttccaagttctaaagaggaactagacaaagaactcccagtgcttaagccatattttatcactaaccctgaagaagctggagtgagggaagctggcttaagagtcacatggctgggacatgccacggtaatggtggaaatggatgagctcatatttctcacggatcccatctttagctctcgtgcttcaccatcgcagtacatgggtccaaagcgatttcgtcgttccccgtgcacaataagtgaactccctccaatagatgcggtccttatcagtcacaaccactatgaccatctggactacaattctgtcattgctttgaatgagcgatttggtaatgagttgagatggtttgtgcctttgggtctccttgactggatgcaaaaatgtggctgtgagaatgtgattgagttggactggtgggaggagaattgtgtccccggacatgataaggtcacttttgtctttacaccttcccagcactggtgtaaaaggactctaatggatgacaacaaggtgctatggggcagctggtctgtcttggggccttggaatcgattttttttcgcaggagatactggttattgccctgcttttgaagagataggaaaaagatttggaccttttgaccttgcagctattcccatcggagcttatgaaccgaggtggtttatgaaataccagcatgtagacccagaagaagctgtaaggattcacactgatgtccaaacaaagaaatctatggcaattcactggggaacttttgccttagcaaatgagcattacttagagcctccagtgaagctgaatgaagctctagagagatacggacttaacgctgaagatttttttgtcttgaagcatggagaatcaagatacctaaataatgatgatgaaaacttttaataaataatttcctgaggtgaaaaaccgatattgaagattcatttttcttttttccattcttcaggaccttcggcaaggtgagtcaaggctctctacctacctagatgtttttcagaggcctacaaatacaagtatctttcttatatgcacattctaataaatgatgaaattcagtccaacatgcttattataaacatagcaattcttgctctatcaaattagcttatatgccaaatattaaatatggtttatttaggtaagcataaaaacataggggctatcatttttaaagacttgattttctctattgtggtaaaatatataaatacatatttgccattttaaacatttaccattttaaccatttttaagtgtacagttctttcgcattaatgcacccatgaccaccattcacttaaatttttaaaagaacagtatattctttttttcctagagccttcagatgagagggaacagtatattctattgcacgtctacaattcccaaaagacctcttactttgggaggccaaggtgggtgggtcacttgaacccaggagtttgacatcaacctgggcaacatggtgacctcccgtctctctcggaaaaaaaaaaagaaaaaagaaaaagccgggtgaggtggtgtgtacctgtagtcacaggtacttgggaggctgaggtgggaggatcacttgagcccaggagatagaggctgcagtgagctgtgatcgtaccactgcactccagcctgggcgacaaaatgagaccctgtctcaaaagaaagccctctccttagctgagcagaggaagggaaggagtgtggctatgagaatatgatttatgccattttctgtttttaaatctagaagatcttctaagcacaaatacagctacaatgaaatattttacagacaaaatgttaatagaccatattctttgaattaaatttgtttttaattttctctacacattttttttttcctggagtctcttagctctaaatatatcaatcagatttataattttttttacctgattcagatgtcttacatttttatattaaatgaaccttaagcatgattcttttggtaagccagtatgaatgccagtggttggggggcggggggggagtcagttgacataagatttagtcctaataaggactctgtattcacttgattattctgacccttcctaagggagggaggtggattagataccactggaggcccattctgtattcctaatccagtctcagcactttattcatacaaaataatcaaaataggttttctacaccaaatgctacccaggcagtgctctataatttatttgcacacctgtatgtgtggtgccacgttagccactaaatctgaacttttaccctgctttcatcatggatttttttgtgtaacctgaaacaagtcaccagtgctcactgtgcctgtttcctcatttgcaacaagaggataattccgacctacctctgaaaaatgtgtagattaaatgagtttttaaagcactttagaaaatataagggagaaaatgatttcttaagatatcactgcctaatatagacaggtatatttgaaagctaaatacaggttaatgcttttgataatgtattgttcctgttgcaaatttaagcattatatattaggagactaaacattgaaaactttcactgatttttaaattggagtaatagcctaaataagtgtaaataatctttatcaaaatttagtgtttatctacaaagatgcgaatcagtcaaggggaaatgtgtatgcaatgtgtgtgtatatgatgtatgcgaacatatgtgattttggggtactaaagcacaaaaaaatcccccataaaataaaccttcctgaaaagactgatcataaactttttcactccaagcagatgtgaatcaagatgttaggtttatggtgagttagctttgaggtgtgttgccctaatactagccagcgttgttgtagccatattccctgctgctgcacgccgaattgaaaatccatctcttacctcttctctatgaagcaagccaggtatgtcttgcttaagtatttcttctccatgaatggccttaacattattttgtattcacgtgtactgtttaactgagggtctcaaagcactttaaactgttgtgttctatttccactcgtctggcctgcctcatttttctaggcccttttgtaagctgtaattttttattaccactcatgttctttctacactgacactattcattaagaacatcaagcttcatctctgcttacagaatctcaccttattgagtgggttccactttatttttcatttgttatctacattttgaagggtttatgtgcaaagtgaaaacaaattttgaaaaataagacaaatccattctcttcttcaattcagtctaatatgcattgtagtgtcttttaatcagtcttatcctctaagtcaacttcattttcctcttcgtgaatacccatagcaatatgtaagattttattgaagtttcctgtgataactgaggaatactttgctatgcctcactgcccaatagggtgggtcatcaattaggagaaatcccaaattataaaagccaacatatgccgtgacctacgtaggaaaagatgtatttgtgcatcttctttctgggtagttaaaaattactccctcttttctctagcattttgacatttcagactcaatgctctgatctctagggagtgtgattattcaaactaatgagaggacaagaagacacagttttagaatctactgctgctaaagcacattaaaaacaaatcctggtttttaatgtatgcatagtttcatatttaatgaatatgctttcattaaatagggaggtagatttgaaaaaaccgttataaagaaatgtgccttttggggaatgaatacttttgttcatgtctagcccactgggaattttgttttcaccttatactgagtcctttttctaatgtaaaaatatttcttccaagtttgatttctgtatcagggtaacattgagaacacacatatttctgtttgaggatttgtgacttcctatggaaacagtcttgcatctatgtatttacaaatgaaatttaaagtattcttaaagctttgccttaaatactgcttgcatactgatttacttaatgctaagcatggcaggggttataaatttaaatactataagacctggctgaatcccagatgtatcaataaattgttatagtagcttatggaaaatgctattaaagataaattttcatacattgtatttttagtcaagtaaaatatggatgaaaattaataaagtactgtcaagggaaaaaata

SEQ ID NO: 5148 - DNA, 1255 bp, Homo sapiens
gtttccggcggtgtggaagcggacctgaggagtcgcaattgtgaacaggctcagcgatatgaggcagcatcgacaatttatggaccgcacgcattatctgcttacattcagctcttcagaaaccttgctaaggctattgctacggacatggtagccaacctgagcagaggtccagaacctccctttttcaaacaattaatagttccattaattcctagtattgtggatagagcaccaaaaggcagaactttcggggatgtcctgcagccagcaaaacctgaatacagagtgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaatgtgaactagtgaactaccatgttgacttctataatcgtccctgtttggggacagatagtttactgctaatggggtggaggggtgtgtgtgtgtgtgtgtgtgtgtgtgtgtgtgtgtgtgtgtgtgtatgtgagagagagagagagagagagaggtttgtcccatatatcttgttccagcagccatatatcttgtggtctacagcctaaagcatgatttcccttgaagtcttggggttgtttaaaggagagtcccttcaatataaaacctctgaaatattagtgagaatggctcactaatgtgaacaatgtttaaattatttatttatatatagaattactgaatattagtactgggaaaatttatagaaatcatctagtcttacccttcatcttacatataagaaaaatggtcttttcttctaatcacatttacaaaatatgatataaaccttgaccatgaatgtatgagcctaattagagaaacagaaaatcagcatgtcagttttccttcattcaaaataacatagtctttctaagcagtcattctggagtt

SEQ ID NO: 5149 - DNA, 632 bp, Homo sapiens
gtggaagcggacctgaggagtcgcaattgtgaacaggttcggtgctgcggctggggctcagcgatatgaggcagcatcgacaatttatggaccgcacgcattatctgcttacattcagctcttcagaaaccttgctaaggctattgctacgtattgtggatagagcaccaaaaggcagaactttcggggatgtcctgcagccagcaaaacctgaatacagagtgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaa

SEQ ID NO: 5150 - DNA, 3715 bp, Homo sapiens
taattttcttcctttcttttttttcctgcgagacggtgggcgggggtatctccctaagttgcccaggctggtcttgaactcctgggctcaagcgatcctcccgcctcagcctcccaaagggctgggattacaggcatgagccaccgcttcctgccaaaagagggctttagggcacccccagaacctgagatctccctcatctgtcatctttaaagagaaggaagtcgactcccagtcgagccatagtccatttgtcccgggcacggtgactccggggtggccaggaccaaatgtgtctccttctggcttttgcaccgcaccaactaatccgcggcaggccgcacagctgccctggccttcgcggaggactaaggcgagggcggtgtacgctgctccggagtcccaccgcgggagttgaggcagcggattccgagggcagggtggggcggaatcgggagggatgcggacccggtggaacgcactgcgcagacggcgccggcgcccgcacacagctgttgactagtcttccagctctcccctggaagtcgtccaggcgccggtctcttttttctgcctttttgtttccctccccgcgagtcggcgcgacggtgaatttccgtttccggcggtgtggaagcggacctgaggagtcgcaattgtgaacaggttcggtgctgcggctggggctcagcgatatgaggcagcatcgacaatttatggaccgcacgcattatctgcttacattcagctcttcagaaaccttgctaaggctattgctacggacatggtagccaacctgagcagaggtccagaacctccctttttcaaacaattaatagttccattaattcctagtattgtggatagagcaccaaaaggcagaactttcggggatgtcctgcagccagcaaaacctgaatacagagtgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaatgtgaactagtgaactaccatgttgacttctataatcgtccctgtttggggacagatagtttactgctaatggggtggaggggtgtgtgtgtgtgtgtgtgtgtgtgtgtgtgtgtgtgtgtgtgtgtatgtgagagagagagagagagagagaggtttgtcccatatatcttgttccagcagccatatatcttgtggtctacagcctaaagcatgatttcccttgaagtcttggggttgtttaaaggagagtcccttcaatataaaacctctgaaatattagtgagaatggctcactaatgtgaacaatgtttaaattatttatttatatatagaattactgaatattagtactgggaaaatttatagaaatcatctagtcttacccttcatcttacatataagaaaaatggtcttttcttctaatcacatttacaaaatatgatataaaccttgaccatgaatgtatgagcctaattagagaaacagaaaatcagcatgtcagttttccttcattcaaaataacatagtctttctaagcagtcattctggagttaacatgcctagttcagagccgctgtggatgctcaaatcatttctggaattgccttcaggacacaattatgagaaagtcagacttccaatattttgatcatgccttgtgtcttcctaagtgtccttatcccactggattgtgtctcttactcccaagacttattccaaatgattttttgactcttttcattaatcaaattcaccccaaaccagaaagttttgccattagcgtagatattaaaaatattactggctgggaaagcactcctcaaagcagaggttctaaattaatttatctgttcttttaccatttgctcactcactcactcatggacccattcaatcatagaatatttaagatttatatgcccagaattataatagtgcctaggccttgataattagtgaatttgtacttggggtgaatgtgtaagtgtcaaaaggtaactattatgaaggagaaaataatcgatttaatatgtaaattctggggaggcatttaaaaaatcagtaatcttcaagttatatcttgtgtatcatctgtgttggatactctaatttggggggaaagaggctccagacagtttgctaaatactattttgaaagttatttttgggcattgtaaaataccttgcttcataccccaaagaataagatatgacaatctgacatcgattgtctgaaagtactaattgcatttaaaattctttaagttaactacaacctcccagactgcaaagcaaatttccaaaccccaggtcatacttttgtatgtatgtaaaagctttagcattttagggaaaaaaatcaatctgtatttcaaaaataaactttgaggtttgaaaataataacaatattcataatggtagtattaacatctattatgtataacttaatctcaacataatttattgaattagaatgaacctggaacactttttgatgaattggtatcctagaggctgtttccttgggccttaactgctggaggattaggtaatcagggattccaagtgttgtgatcttttttctgatgacgccacagtcttcagtgtaaaagttcagaagcctaaaagaacaagtgatcctgaaagtagctgattccagacaagaaaattatattagaactcatgatatggttttttaaagtatttgttattactcagaagggttcatgaatcagtttccactacctctattccttctattgaagctttcctcaaatctacttgtgattcctgatagctcactggcaactgtaccaaggtggccactgtatcatctactgatccttctgcacctagcactcttggctccagataacgcacagaaacctattttctcaccagctgtcatttcttctagggcatgcagttctatgttcacagttcatgtgtaaaaataaaaccaaattcctggattatcaatatcagttctttacctgtgcataaaagaatatcatgaagtaattgaacttatctgttgatataaaaacacagatccaattcgtgtctgtggatgctgcaaggactggctcactggagccaaaccatgtggcggaaactcctgaaattggtggaaaaagtggaatatggcagattgggtaggtaggagaacaattttggagattttgtttctcatgttaaagtgtctgcattttatttgctgtaccctgcctactctggttttaaggattttttgacttcttcgaaaagcactgaataatctctttgccgggtctagattttttgatgagtactgtgtaaaattgtcaatattcaatggattatttaataataaattaagaattacactcataaaa

SEQ ID NO: 5151 - DNA, 1630 bp, Homo sapiens
cgccgagctgggccaatcctcttggtggaggaagctcggctgattctcggctcacgcgggaggggagtaaagggtggcggtccgggcctggagttcagtgggtgcagcctgcttgcgagctgaggccagacaggggggcgcctacggacggataaggaggagcattccaggccgagacgccctcatcagcagagtcacaggagttttggaagtgagagaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggccaagagatgcacagtgatcggtggctctggattcctggggcagcacatggtggagcagttgctggcaagaggatatgctgtcaatgtatttgatatccagcaagggtttgataatccccaggtgcggttctttctgggtgacctctgcagccgacaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcagaaactcattttaaccagcagtgccagtgtcatctttgagggcgtcgatatcaagaatggaactgaagaccttccctatgccatgaaacccattgactactacacagagactaagatcttacaggagagggcagttctgggcgccaacgatcctgagaagaatttcttaaccacagccatccgccctcatggcattttcggcccaagggacccgcagttggtacccatcctcatcgaggcagccaggaacggcaagatgaagttcgtgattggaaatgggaagaacttggtggacttcacctttgtggagaacgtggtccatggacacatcctggcggcagagcagctctcccgagactcgacactgggtgggaaggcatttcacatcaccaatgatgagcccatccctttctggacattcctgtctcgcatcctgacaggcctcaattatgaggcccccaagtaccacatcccctactgggtggcctactacctggccctcctgctatccctgctggtgatggtgatcagtcctgtcatccagctgcagcccaccttcacacccatgcgggtcgcactggctggcacattccactactacagctgcgagagagccaaaaaggccatgggctaccagccactagtgaccatggatgatgctatggagaggaccgtgcagagctttcgccacctgcggagggtcaagtgagggacactggaggctgggctctctcgacacgttgctcagccagtcactccttcccctgtggattgatgaaataacatcctttgaatgagtttgctctgagcctgtgactccttctgctaggcagagagcgcaccctactctttccgtgacgatgagggcggcaaaaacagacatttcttccttcatggaactggatttggatttcttgaagcaggcagcttcatattataccgatttgttctctgtc

SEQ ID NO: 5152 - DNA, 1929 bp, Homo sapiens
cgccgagctgggccaatcctcttggtggaggaagctcggctgattctcggctcacgcgggaggggagtaaagggtggcggtccgggcctggagttcagtgggtgcagcctgcttgcgagctgaggccagacaggggggcgcctacggacggaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggccaagagatgcacagtgatcggtggctctggattcctggggcagcacatggtggagcagttgctggcaagaggatatgctgtcaatgtatttgatatccagcaagggtttgataatccccaggtgcggttctttctgggtgacctctgcagccgacaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcagaaactcattttaaccagcagtgccagtgtcatctttgagggcgtcgatatcaagaatggaactgaagaccttccctatgccatgaaacccattgactactacacagagactaagatcttacaggagagggcagttctgggcgccaacgatcctgagaagaatttcttaaccacagccatccgccctcatggcattttcggcccaagggacccgcagttggtacccatcctcatcgaggcagccaggaacggcaagatgaagttcgtgattggaaatgggaagaacttggtggacttcacctttgtggagaacgtggtccatggacacatcctggcggcagagcagctctcccgagactcgacactgggtgggaaggcatttcacatcaccaatgatgagcccatccctttctggacattcctgtctcgcatcctgacaggcctcaattatgaggcccccaagtaccacatcccctactgggtggcctactacctggccctcctgctatccctgctggtgatggtgatcagtcctgtcatccagctgcagcccaccttcacacccatgcgggtcgcactggctggcacattccactactacagctgcgagagagccaaaaaggccatgggctaccagccactagtgaccatggatgatgctatggagaggaccgtgcagagctttcgccacctgcggagggtcaagtgagggacactggaggctgggctctctcgacacgttgctcagccagtcactccttcccctgtggattgatgaaataacatcctttgaatgagtttgctctgagcctgtgactccttctgctaggcagagagcgcaccctactctttccgtgacgatgagggcggcaaaaacagacatttcttccttcatggaactggatttggatttcttgaagcaggcagcttcatattataccgatttgttctctgtctttttgtgtctctctgtttaccccctcccttgccccctcttctggtttatacatttcattccagtgtccttgtacataatcaaggaagctgtaggaagctacaacccatttgttagttctgatggagaaccatttccatgcagaccaatactagagtgaagcctctagactttgttcaagatactctatcttcaaaatatcccagaagaaaaacagaagctgttaacacacaggtgagactttacatatacatttcatactgacagtgagcttagagcaaaagctgaaagctgaaatgactgtaattcctccccagtctctgttgcttgttcaactccttacatgttccacattctctttcaggta

SEQ ID NO: 5153 - DNA, 1186 bp, Homo sapiens
gtctccgcctgcaggtgcagacatctggaggagagagtcggagagcagaaaccacttggctcccagacaattcccctacaggctttgggcctggaattgaggagaaagtgagctaagttggggtggggtgagtccaaagaagcacgggctgggccaagctaagctgctctgggctgggctgatccctccccactcaggggcgggaccccaggaggagggagaggacagagccactgcagaggaccagactgggaaaacaacgatatggcaggagccagtcttggggcccgcttctaccggcagatcaaaagacatccggggatcatcccgatgatcggcttaatctgcctgggcatgggcagcgctgcgctttacttgctgcgactcgcccttcgcagccccgacgtctgctgggacagaaagaacaacccggagccctggaaccgcctgagccccaatgaccaatacaagttccttgcagtttccactgactataagaagctgaagaaggaccggccagacttctaagccaggctgggctgccagtgccatgcaagccacagccagccagcccatccacttcttccactcctccccgcaggccccaaggcatcactccggccaccctgtcccgctactgcttacacaggccgggttcccacgcagaggggaggctgctccacccctactctcctcccttgctcccagcagcggaagcgcctctgacccttggcttgagtcccacgtgggggaggaggaggcaggcagcaccagcaggggtccaccaagagcccagaccagcccctctgccctcctacccgggcctcgaagggtgtggcacaggctacgtgttgagcgtggcctacgtgagccaacaagaagcaggggcctctgagtgccaagcgacgtggcgggctccacgttagcccaggctctgagagccagcccaggggcggcgctgctcagcttgggctggtccagggcctgcccaggctggggcacctttgcctcctgaggcgcagcgcactcctcccctgcccaagcctactgcctcccgctgccgccagtaccccctccagccccacacctgggcctccccctgccactcccctcccttgctcccctctgtccccagggatcaaacagaagcagccgtgggcaaaatacaatttcatttaacaaattg

SEQ ID NO: 5154 - DNA, 1177 bp, Homo sapiens
caggtgcagacatctggaggagagagtcggagagcagaaaccacttggctcccagacaattcccctacaggctttgggcctggaattgaggagaaagtgagctaagttggggtggggtgagtccaaagaagcacgggctgggccaagctaagctgctctgggctgggctgatccctccccactcaggggcgggaccccaggaggagggagaggacagagccactgcagaggaccagactgggaaaacaacgatatggcaggagccagtcttggggcccgcttctaccggcagatcaaaagacatccggggatcatcccgatgatcggcttaatctgcctgggcatgggcagcgctgcgctttacttgctgcgactcgcccttcgcagccccgacgtctgctgggacagaaagaacaacccggagccctggaaccgcctgagccccaatgaccaatacaagttccttgcagtttccactgactataagaagctgaagaaggaccggccagacttctaagccaggctgggctgccagtgccatgcaagccacagccagccagcccatccacttcttccactcctccccgcaggccccaaggcatcactccggccaccctgtcccgctactgcttacacaggccgggttcccacgcagaggggaggctgctccacccctactctcctcccttgctcccagcagcggaagcgcctctgacccttggcttgagtcccacgtgggggaggaggaggcaggcagcaccagcaggggtccaccaagagcccagaccagcccctctgccctcctacccgggcctcgaagggtgtggcacaggctacgtgttgagcgtggcctacgtgagccaacaagaagcaggggcctctgagtgccaagcgacgtggcgggctccacgttagcccaggctctgagagccagcccaggggcggcgctgctcagcttgggctggtccagggcctgcccaggctggggcacctttgcctcctgaggcgcagcgcactcctcccctgcccaagcctactgcctcccgctgccgccagtaccccctccagccccacacctgggcctccccctgccactcccctcccttgctcccctctgtccccagggatcaaacagaagcagccgtgggcaaaatacaatttcatttaacaaattgaa

SEQ ID NO: 5155 - DNA, 1366 bp, Homo sapiens
ggcgttcccgcaaggtcgctttgcagagcgggagcgcgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatggagaaattctggaataaatttttggagaataaatccccttggaggaaaatggtccatggggtatacaaaaagagtatctttgttttcactcatgtacttgtacctgtctggattattcattattacatgaagtatcatgtttctgaaaaaccatatggcatagttgaaaagaagtccagaatattccctggtgatacaattctggagactggagaagtaattccaccaatgaaagaatttcctgatcaacatcattaaagattatgtaaaaagttaaaaggcttatgagcctaagtttgttcctatattaccatatttactgaattttctggaaaagtaactttaataaagtttaatctcagaaattgtcatatctgttttcaagcattgtacaatttgagactgagtaatttaacaataagtaaaaagtggacatgctaaacaaatatgagagactacctactttttctggtcattcttgacttggaaaacggtatggaaaagtatttagttacatgtttgtttgtttttttcttacacagtacttacactaatttggtatcagggtatgcaacagtgaaatatcacaataaacaaatgtaagaacagcaattccatgcacttttgttttaaggaaatctttccggccaggcgcagtggctcatgcctgtaatcccagcactttgggaggccgaggcgggcagatcacgaagtcaggagatcgagaccatcatggctaacacagtgaaaccccgtccctactaaaaatacaaaaaaattagccgggcgtggtggcgggctcctgtagtcccagctactgcggaggctgaggcacgagattggtgtgaacccagaaggcggagcttgcagtaagccgagatagtgccactgagcctgggcgacagagcaagactccgtctcaaaaaaaaaaaaagctttccgaatcatttttgaagaatttagaaacttgattgaaaagcttattccaactatgatctgacactcaagactgtcagatttaggttgctgttaattttgtcatgagaatgtaaaatactaaaatctctaagtgaaaaatttgcatactagtgcttgttataaaggataatgcaaaaataaacttgggaactttgca

SEQ ID NO: 5156 - DNA, 753 bp, Homo sapiens
atggacatgctccaggaccttgagtccctgcagtttgagtatggggttccagaggaagatcgtatctggctgtatttgcagggccgttctcggggactgatgatcgaggcttgtgcccatgcaaccttcttctgcaaactattatataatttgagagcatcattaaataagaatcaaagttccagacatctctcaattggctcccttaattcagccactcctgaagagtttaaggtgggcatcattggaggtggccaccttgggaagcagctggctggcacactgctgcagcttggccccatccctgctgaaagcctgcggatctccactcggaggccagagactctgggtgagctccagaagctgggaatcaaatgcttttaccataacgctgatctggtgagttgggccgatgtgatattcctctgctgcttgccgtctcagctgcctaatatctgcgtagaaatttacaccagccttgagaaggccagcattgtgtacagctttgtagctgccatcccactacccaggctgaaactactgttgaaccacaccaatatcttgcggcctcagtatcagtatgatgaagattctgtcagcgtctggggggccaataagggagtcatagctgctctccaagatcctacgattcttcaagctacctgtccctacagtcctgctggtcacggctcaacatatttctggcattcttttgaaaattactttcctgttggcccattgctatcttattaa

SEQ ID NO: 5157 - DNA, 1857 bp, Homo sapiens
aaattcagaatctgggagtagagaggtgctgaagcccatcatcatgagtgcttgtgacctgggcacacacaccatcatacacacacctcctacatagacccctcttctaccgggacagggagccaaattgattagtgtctatcactgcaggaaatagtggcttggaaatggacatgctccaggaccttgagtccctgcagtttgagtatggggttccagaggaagatcgtatctggctgtatttgcagggccgttctcggggactgatgatcgaggcttgtgcccatgcaaccttcttctgcaaactattatataatttgagagcatcattaaataagaatcaaagttccagacatctctcaattggctcccttaattcagccactcctgaagagtttaaggtgggcatcattggaggtggccaccttgggaagcagctggctggcacactgctgcagcttggccccatccctgctgaaagcctgcggatctccactcggaggccagagactctgggtgagctccagaagctgggaatcaaatgcttttaccataacgctgatctggtgagttgggccgatgtgatattcctctgctgcttgccgtctcagctgcctaatatctgcgtagaaatttacaccagccttgagaaggccagcattgtgtacagctttgtagctgccatcccactacccaggctgaaactactgttgaaccacaccaatatcttgcggcctcagtatcagtatgatgaagattctgtcagcgtctggggggccaataagggagtcatagctgctctccaagatcctacgattcttcaagctacctgtccctacagtcctgctgggggaataatcctcaatatcaagtggttggagggagtgttctatgcggccctaaacatatgcacagcaagaaacatggcccactcccaagtgctgcagcttctgagtgaactctttctctccgtgcactttgaagactgtgggaaagacacagcatcttgcccaaagttgcaattaacagattttgtcagcaaagcctatggcaagaatttgtctcaggaaaggcctttcccctggtttgatctgactgctgtgcaactcaaggaaactccgtttagccagcatctctcaagtagtcctgttctccaagaccaccttacccatctatactgtgcttcatttggcatctccctaaccaaagaacagccagtcatttccacaggctttccatcccaataagagaactcaggaatcaggattttttcccactcacagattttccctataatagttgtgccctgattatcacaattgactgtgggagtcttgtggctgtattgtgtttgccacatgatagacatcaggaattataaaactgtactgatgactctttaaaatgtagaataaaacaagtggtcctatccatcaatatgtatctggctctcagaagcaactagtgaaactacacaacctaacttaagtaagctgctcccgcagaaaagtcttgttaatacaaattatttctcttctaaaattaaagaagttataatgttataagttttagacaattacatactgcagcttcttttccaataaatcaagtttcaatccatttgccagcagtaggtagctggaaaaagatacagtttgattttctcacaattttggacagagaagtgaaggtatggtaaaccatcttaattgaattatggcttgtatcatgcttattttgactatatatgactgttctggtactatcttatttacagctgttcccatttaaaccatttaaaaaactggtatttaatggctaaaactaattttgcaaaatatagatctatactgcaaa

SEQ ID NO: 5158 - DNA, 734 bp, Homo sapiens
ttccaggatcagaagtactgaggagcagagccaatcttctctgtttggaaatagtggcttggaaatggacatgctccaggaccttgagtccctgcagtttgagtatggggttccagaggaagatcgtatctggctgtatttgcagggccgttctcggggactgatgatcgaggcttgtgcccatgcaaccttcttctgcaaactattatataatttgagagcatcattaaataagaatcaaagttccagacatctctcaattggctcccttaattcagccactcctgaagagtttaaggtgggcatcattggaggtggccaccttgggaagcagctggctggcacactgctgcagcttggccccatccctgctgaaagcctgcggatctccactcggaggccagagactctgggtgagctccagaagctgggaatcaaatgcttttaccataacgctgatctggtgagttgggccgatgtgatattcctctgctgcttgccgtctcagctgcctaatatctgcgtagaaatttacaccagccttgagaaggccagcattgtgtacagctttgtagctgccatcccactacccaggctgaaactactgttgaaccacaccaatatcttgcggcctcagtatcagtatgatgaagattctgtcagcgtctggggggccaataagggagtcatagctgctctccaagatcctacgattcttcaagctacctgtccct

SEQ ID NO: 5159 - DNA, 1954 bp, Homo sapiens
gactttgaatggtccgttaatgtggttacaaaacgtgactcggttcatcgggagccctcctctctcctcttccttcctccatggatctgcctattcaggacagccatgattcttccaccagtcccaaaggcaaacaacccactactgcagagaagagtgccacaaaaaaggaagacaaggtcccggtcaagaaacagaagaccagaactgtgttctcttccacccagctgtgtgtactcaatgatagatttcagagacagaaatacctcagcctccagcagatgcaagaactttccaacatcctgaacctcagctacaaacaggtgaagacctggttccagaaccagagaatgaaatctaagaggtggcagaaaaacaactggctgaagaatagcaatggtgtgacgcagggatgcctggtgaacccgactgggaaccttccaatgtggagcaaccagacctggaacaattcaacctggagcaaccagacccagaacatccagtcctggagcaaccactcctggaacactcagacctggtgcacccaatcctggaacaatcaggcctggaacagtcccttctataactgtggagaggaatctctgcagtcctgcatgcagttccagccaaattctcctgccagtgacttggaggctgccttggaagctgctggggaaggccttaatgtaatacagcagaccactaggtattttaatactccacaaaccatggatttattcctaaactactccatgaacatgcaacctgaagacgtgtgaagatgagtgaaattgatgttactcagtttcagtctggacactggctgaatccttcctctcccctcctcccatccctcataggatttttcttgtatggaaactacgtgttctggtttccatgatgcctatccagtcaatctcatggagggtggggtatggttggagcctaatcagagaggtttctttcttttttcctattggatctttcctgagaaaagatattttaataaccttggctgctaaagacaacttgatagaagctgtctctggctatagataagtagatgtaatactagtttggatatctttagggtttagaatctaacctcaagaatgagaaataagctgggcgcggtggcttacatctgtaatcccagcactttgggagaccaaggcgggcggatcacgaggtcaggagatcgagaccatcctggctaacacggtgaaaacctgtctctactaaaaaatacaaaaaagttagctgggcatggtggtgggcgcctgtagtgccagctactcgggaggcggaggttgcagtgagccaagatcgcgccactgcactccagcctgggcgacagagtgagactctgtctcaaaaaaaaaaaaagaaaaagaaaaagaaaaggaaataaaagtacaaattggtgtgatgaagatatattcctattgtttgggattgggaggctttgtttatttttttaaaaactctattgaggctgggtgtggtggctcacacctgtaatggcagcactttgggaggccaaggtaggcagatcaccacaggttaggaattcaagaccagtctggccaacatggtgaaatcccgtctctactaaaatacaaaaattagctgggcatggtggcaggcgcctgtaatcccagctactcgggaggctgagcggagatggtgccacagcaatccagcctggatgacagagccagactccatgtcaaaataaaataaaaactctattgaggtgaagggtgaagctttaagttgttacatacttcactgatttcctcaaccctttttggctccgttttactatagcccgtattttgttggttatgactaatatttgtggaaagaggtcttgtgtttagtgcattataatggcatcagtactacttcggctggtttaagtactaatgaataaaacaaccatttttccttc

SEQ ID NO: 5160 - DNA, 1150 bp, Homo sapiens
tccccactgctcagcactaggccggcagaatctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtcaaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttg

SEQ ID NO: 5161 - DNA, 1150 bp, Homo sapiens; identical to SEQ ID NO: 5160

SEQ ID NO: 5162 - DNA, 1150 bp, Homo sapiens; identical to SEQ ID NO: 5160

SEQ ID NO: 5163 - DNA, 1150 bp, Homo sapiens; identical to SEQ ID NO: 5160

SEQ ID NO: 5164 - DNA, 1150 bp, Homo sapiens; identical to SEQ ID NO: 5160

SEQ ID NO: 5165 - DNA, 1150 bp, Homo sapiens; identical to SEQ ID NO: 5160

SEQ ID NO: 5166 - DNA, 1150 bp, Homo sapiens; identical to SEQ ID NO: 5160

SEQ ID NO: 5167 - DNA, 1150 bp, Homo sapiens; identical to SEQ ID NO: 5160

SEQ ID NO: 5168 - DNA, 5730 bp, Homo sapiens
atggagggaaagagacagcttgagaaaagggactttggaaaaaggctgtctctagacagcagtcttgtggaatacatggactccaataaatacattgagcatctgctgactcagcttgaggagcaacacaggagtctctggagggagaagttggcagtggcccgactacagcgagaagttgcccaaagaacaagtgagggggccatgcatgagaagctgatacatgaactggaagaggagagacacttacgtcttcaaagcgagaagcggttgcaggaggtgaccctagagtctgaacgcaacagaattcagatgcgtagcttgcagcagcagttctccaggatggaagaaacagtacgaaatctattgcagagtcaaggatctccagagcagaaaaaagaagaaactgttaatataatggtctatcaggaaaagctgtcagaggaagagagaaaacataaggaagctttggaagatcttcacatggtggttgatgaggattcgaggagtgaaagcagcagtacagatgagggaaaagaaaagaccaaattgctattagagagattgaaagctctagaggcagagaattcagcgttggctttggagaatgaaaatcaaagggaacaatatgagcgatgtcttgatgaggtagccaaccaagttgttcaagctctgcttactcaaaaggatctaagagaggaatgtgtgaagttgaaaacaagagtgtttgatttggaacagcagaatcgaacactaagcatcctattccaacagcgagtcagacccacttctgatctgctcctccagaaacttcactcacgtctcttggatctttcatctggagatttgctttcagaggtggaaagaaaccgaagtctgacacagtcacgaactgatgctgaggtgcacgaacaccaactaaatacaaaatcggccttgaaatgccctggcttgggggctgtcatccctggtcatctctgtcctcgaaacagctacagtagcagcagtgaactgtctctttcaagcacctgcagcgagtactccagtggctcctcctacacgtggcacgatgggaagaacctcaggaaaaggcaatcatcacaaaactgggataaaaggctaagtattgattcttcgctcccaagtggctttgctagtcctacaaatgaactacctccaactcgtatcaaggaaagccacattttggaagggctaagaaagctacagaagcgaaaagtgttacttgaacccccatcagtgataaccaaatggggttataaagattgcatgaactcgaatgaaggaatatattctcctggaattaaaagtagcagcctcaaggagtatcccccctgcaaaacagctgacctggggagcccctgcaaggaaccccacaagacatttgtttatgatctagattcccacgttgatgcggacgatgacccttccaccttagcattgctccaagcagttccaaaccagagctgcaggccacatggcagtaaattaacccacagtgtttccgacagtctgtttggctgggagacaaacagaaaacactttctggaaggcacatcctcagtttatcccaaggaaaggcctgaaaagctgacaagttgcgccagcagctgtcccttagagatgaagctgtgcccaagtgtgcagacgcctcaggtacagagggagaggggcccacagggccaaggccatggccgcatggctctcaacctccagctttcagacactgatgacaatgaaacgtttgatgagctgcacatagagagcagtgatgagaaaagtccttcagacgtgtcattggctgccgacaccgataagtccgtggagaacctggatgtccttgtggggtttggaaaatctctatgtgggtctcctgaagaggaggaaaaacaagtgcccatcccttcagagactaggccaaagacttttagtttcattaagcagcaaagagttgtaaaaaggacttcttcagaagaatgtgtgactgtgatatttgatgcggaagacggtgagcccattgaattcagctctcaccagactggggttgtcactgttaccagaaatgagatttccatcaattcaactcctgctggacccaaggcagaacatactgagcttttacctcagggaattgcttgtttacagccaagagctgctgcaagagactatactttctttaaaaggtctgaagaggacactgagaaaaacattccaaaagataatgtagataatgttcccagggtgtccactgaatctttcagctccaggacagtgacacaaaatcctcagcagcaaaagctggtcaaaccaacacacaatatatcatgccagagtaattccaggtcttcggcacccatgggcatctatcaaaagcaaaatctgacaaaaatacctcccaggggcaagtcttcacctcagaaatcaaaactaatggagcccgaagccaccacactactcccttcatctggcctggtgactcttgaaaaatcaccagccttagctcctgggaaactctcacgattcatgaagactgagagctcagggcccctctttgaattacgatcagatccacacattccaaaacattccgcccaacttccgcacagctccaggatgcccagcaggagggactgggtccagtgccccaagagtcagactccagggtcacggtcaaggcctgccattgagtctagtgacagtggagagccccccacgagggatgaacactgtggctctgggccggaggcaggggtgaaatccccttcccctccgccccctccaggcaggtccgtctccctgctggccaggcccagctatgactattcaccagcaccttcatccaccaagtccgaaaccagggtccccagtgaaacagcaaggaccccattcaaatccccgctgctgaaaggaatttctgctccagttatttcttctaatccggccacgacagaagtgcagaggaagaaaccttctgtggccttcaaaaagcctatcttcactcaccctatgccctccccagaagcagtcattcaaacccgatgccctgctcatgccccctccagctccttcaccgtaatggctctggggcctccaaaggtctctccgaagagaggtgtccccaaaacctctcctcgccaaacacttgggaccccacaaagggacataggattacagactcccaggatctctccttcaacccatgagccactggaaatgacgtcctccaaaagtgtatctccagggagaaaaggacaattgaatgatagcgcctccacaccccccaagccttccttcttaggggtaaatgagtcaccatcatctcaggtcagcagttcctcatcatcctcatcacccgccaaaagccataacagccctcatggttgtcaaagtgctcatgagaaaggactgaaaactcgccttccagtgggactcaaagtgctcatgaagtctccccagctgctcaggaaaagttccaccgtgccagggaaacatgaaaaagacagtttaaatgaagcctccaaaagttccgtggctgtgaacaagtctaagccagaggactccaagaatccagcaagcatggagatcacagcgggtgaaagaaatgtgaccctaccggattcacaagcacagggcagtttagctgatgggcttcccctggaaacagcactacaagagccattggaaagtagcatccctgggagtgatggaagggatggggtagataatagatccatgagaagatccctttcctccagcaaaccacacctaaaaccagctctgggtatgaatggcgccaaagcccgcagccacagcttcagtacacactcaggagacaagccttctacgccccccatcgaagggtcaggcaaagtccgcactcagatcattaccaataccgccgagagaggcaattctcttacccggcagaactcttccacggaaagctctcccaacaaggccccttctgctcccatgttggagagtctccccagtgttgggaggccctcggggcacccctcctccgggaagggctccctggggagctcaggcagcttcagcagtcagcatgggagcccaagtaagttgcctttgaggatccctccaaagtctgagggactcctcatcccacctggaaaggaagaccagcaggccttcacccagggagagtgccccagtgccaatgtggctgtacttggggaaccaggcagtgaccgccgcagttgcccacccaccccaacagactgccctgaagccctgcagagcccagggaggactcagcatccaagcacttttgaaacaagcagtacatccaagctagaaacttctggaaggcatccagatgcctctgcaaccgcgactgatgctgtgagttcagaagcccccctctcacccacaatcgaagaaaaggtcatgttgtgcattcaggaaaatgtggaaaagggccaagtgcaaacaaagcccacctctgtggaagcaaagcagaagcctgggccttcttttgccagctggtttggttttcggaagagtagacttccagctctgagtagcaggaaaatggacatctccaaaaccaaagtagaaaagaaagatgcaaaagtcttggggtttggaaacagacaactaaaatcagaaagaaaaaaagagaaaaagaagcctgaactacagtgtgagacagaaaatgagcttatcaaggacaccaagtcagcagataatccagatggcggtttacaaagcaaaaataatcggagaacaccacaagacatttacaaccaactgaagattgaaccaaggaatagacacagccctgttgcatgttcaacgaaagacaccttcatgacggaactcttgaacagagttgataagaaagcagctccacagacagaaagtggatcaagtaatgcttcctgcaggaatgtgttaaagggcagttctcagggctcctgtctcatcggcagctctatcagtactcaaggaaaccacaagaaaaacatgaaaatcaaagccgatatggaagtaccaaaagactccctggtaaaagaggcaaatgaaaacttgcaagaggatgaagacgatgcagttgcagattctgtatttcagagccacatcatagaatccaactgccagatgagaacattggacagtgggatcggaacctttccactcccagactcgggaaatcgctcgacaggacgctacctatgccagccagactccccagaggacgctgagcctctcctgcctctccagtcagccctttctgcagtttcttccatgagagcccaaacccttgaacgtgaagtgccttcctccacagacggccagcgccctgcagatagcgccattgttcattccacatccgaccccatcatgaccgccagagggatgaggcctcttcagagccgcctccccaaaccagcttcctcaggaaaagtcagttcccaaaagcagaatgaagcagagccaaggcctcagacatgctcatcattcggatatgctgaagacccaatggcaagccagccgcttccagactgggggagtgaagttgctgccaccgggacccaggacaaggcacccagaatgtgtacgtactctgccagcggtggcagtaatagtgacagtgacctggactatggagataatggttttggagctggaaggggacagttagtgaaagcactgaagagcgctgccccagaaattgagacaacttga

SEQ ID NO: 5169 - DNA, 388 bp, Homo sapiens
caggctttgcagagtttagagcatattctacccaactggccccagatggaaaatactgtcttgaaattggatggctttttaagtgtagctctccacagcctgctcaaagaaaaaaaaaaatgaccctggaaacagacgggggattcttataagtcacaaaagaaaataaataacttcatccatggagggaaagagacagcttgagaaaagggactttggaaaaaggctgtctctagacagcagtcttgtggaatacatggactccaataaatacattgagcatctgctgactcagcttgaggagcaacacaggagtctctggagggagaagttggcagtggcccgactacagcgagaagttgcccaaagaacaagtgagggggccatg

SEQ ID NO: 5170 - DNA, 1773 bp, Homo sapiens
atggagggaaagagacagcttgagaaaagggactttggaaaaaggctgtctctagacagcagtcttgtggaatacatggactccaataaatacattgagcatctgctgactcagcttgaggagcaacacaggagtctctggagggagaagttggcagtggcccgactacagcgagaagttgcccaaagaacaagtgagggggccatgcatgagaagctgatacatgaactggaagaggagagacacttacgtcttcaaagcgagaagcggttgcaggaggtgaccctagagtctgaacgcaacagaattcagatgcgtagcttgcagcagcagttctccaggatggaagaaacagtacgaaatctattgcagagtcaaggatctccagagcagaaaaaagaagaaactgttaatataatggtctatcaggaaaagctgtcagaggaagagagaaaacataaggaagctttggaagatcttcacatggtggttgatgaggattcgaggagtgaaagcagcagtacagatgagggaaaagaaaagaccaaattgctattagagagattgaaagctctagaggcagagaattcagcgttggctttggagaatgaaaatcaaagggaacaatatgagcgatgtcttgatgaggtagccaaccaagttgttcaagctctgcttactcaaaaggatctaagagaggaatgtgtgaagttgaaaacaagagtgtttgatttggaacagcagaatcgaacactaagcatcctattccaacagcgagtcagacccacttctgatctgctcctccagaaacttcactcacgtctcttggatctttcatctggagatttgctttcagaggtggaaagaaaccgaagtctgacacagtcacgaactgatgctgaggtgcacgaacaccaactaaatacaaaatcggccttgaaatgccctggcttgggggctgtcatccctggtcatctctgtcctcgaaacagctacagtagcagcagtgaactgtctctttcaagcacctgcagcgagtactccagtggctcctcctacacgtggcacgatgggaagaacctcaggaaaagggtaaaagaggcaaatgaaaacttgcaagaggatgaagacgatgcagttgcagattctgtatttcagagccacatcatagaatccaactgccagatgagaacattggacagtgggatcggaacctttccactcccagactcgggaaatcgctcgacaggacgctacctatgccagccagactccccagaggacgctgagcctctcctgcctctccagtcagccctttctgcagtttcttccatgagagcccaaacccttgaacgtgaagtgccttcctccacagacggccagcgccctgcagatagcgccattgttcattccacatccgaccccatcatgaccgccagagggatgaggcctcttcagagccgcctccccaaaccagcttcctcaggaaaagtcagttcccaaaagcagaatgaagcagagccaaggcctcagacatgctcatcattcggatatgctgaagacccaatggcaagccagccgcttccagactgggggagtgaagttgctgccaccgggacccaggacaaggcacccagaatgtgtacgtactctgccagcggtggcagtaatagtgacagtgacctggactatggagataatggttttggagctggaaggggacagttagtgaaagcactgaagagcgctgccccagaaattgagacaacttga

SEQ ID NO: 5171 - DNA, 2390 bp, Homo sapiens
gaagcaactacggagccgcagcccagggagcaagtctccgcaaacttgctccgcattcacggcaggacttcccagccgctgtggatgttcaggaaaaccgagtctgttctgttagcgtggcctttgaatgcttcaaaaataaacagaggataaccaaccgcgggaggaaatttttagctggagagagttgtagttcctgtgtctgtctccaggactgtgatatgtgttgactgaagagctaactacaagttcatcgtgaagaataaatgagataagctacctcaagtgcctgtaccaaaatagactcacaatacattgaccctggaaacagacgggggattcttataagtcacaaaagaaaataaataacttcatccatggagggaaagagacagcttgagaaaagggactttggaaaaaggctgtctctagacagcagtcttgtggaatacatggactccaataaatacattgagcatctgctgactcagcttgaggagcaacacaggagtctctggagggagaagttggcagtggcccgactacagcgagaagttgcccaaagaacaagtgagggggccatgcatgagaagctgatacatgaactggaagaggagagacacttacgtcttcaaagcgagaagcggttgcaggaggtgaccctagagtctgaacgcaacagaattcagatgcgtagcttgcagcagcagttctccaggatggaagaaacagtacgaaatctattgcagagtcaaggatctccagagcagaaaaaagaagaaactgttaatataatggtctatcaggaaaagctgtcagaggaagagagaaaacataaggaagctttggaagatcttcacatggtggttgatgaggattcgaggagtgaaagcagcagtacagatgagggaaaagaaaagaccaaattgctattagagagattgaaagctctagaggcagagaattcagcgttggctttggagaatgaaaatcaaagggaacaatatgagcgatgtcttgatgaggtagccaaccaagttgttcaagctctgcttactcaaaaggatctaagagaggaatgtgtgaagttgaaaacaagagtgtttgatttggaacagcagaatcgaacactaagcatcctattccaacagcgagtcagacccacttctgatctgctcctccagaaacttcactcacgtctcttggatctttcatctggagatttgctttcagaggtggaaagaaaccgaagtctgacacagtcacgaactgatgctgaggtgcacgaacaccaactaaatacaaaatcggccttgaaatgccctggcttgggggctgtcatccctggtcatctctgtcctcgaaacagctacagtagcagcagtgaactgtctctttcaagcacctgcagcgagtactccagtggctcctcctacacgtggcacgatgggaagaacctcaggaaaagggtaaaagaggcaaatgaaaacttgcaagaggatgaagacgatgcagttgcagattctgtatttcagagccacatcatagaatccaactgccagatgagaacattggacagtgggatcggaacctttccactcccagactcgggaaatcgctcgacaggacgctacctatgccagccagactccccagaggacgctgagcctctcctgcctctccagtcagccctttctgcagtttcttccatgagagcccaaacccttgaacgtgaagtgccttcctccacagacggccagcgccctgcagatagcgccattgttcattccacatccgaccccatcatgaccgccagagggatgaggcctcttcagagccgcctccccaaaccagcttcctcaggaaaagtcagttcccaaaagcagaatgaagcagagccaaggcctcagacatgctcatcattcggatatgctgaagacccaatggcaagccagccgcttccagactgggggagtgaagttgctgccaccgggacccaggacaaggcacccagaatgtgtacgtactctgccagcggtggcagtaatagtgacagtgacctggactatggagataatggttttggagctggaaggggacagttagtgaaagcactgaagagcgctgccccagaaattgagacaacttgaagaaacaaaagacgatcccgagaatagattatcgaaaatttccctagagtcattcaataaatttaacagcaatactgtgattttattagaaaaagagaagaactctctgaacaaggttgaaggacagaaggaagaaaaagaaaaaaatgaagagacatctttgagtagttcagataggcctggggtagacaacttggaatctttgagtgattctttatatgatagcttctcttcctgtgc

SEQ ID NO: 5172 - DNA, 7592 bp, Homo sapiens
gcaactacggagccgcagcccagggagcaagtctccgcaaacttgctccgcattcacggcaggacttcccagccgctgtggatgttcaggaaaaccgagtctgttctgttagcgtggcctttgaatgcttcaaaaataaacagaggataaccaaccgcgggaggaaatttttagctggagagagttgtagttcctgtgtctgtctccaggactgtgatatgtgttgactgaagagctaactacaagttcatcgtgaagaataaatgagataagctacctcaagtgcctgtaccaaaatagactcacaatacattgaccctggaaacagacgggggattcttataagtcacaaaagaaaataaataacttcatccatggagggaaagagacagcttgagaaaagggactttggaaaaaggctgtctctagacagcagtcttgtggaatacatggactccaataaatacattgagcatctgctgactcagcttgaggagcaacacaggagtctctggagggagaagttggcagtggcccgactacagcgagaagttgcccaaagaacaagtgagggggccatgcatgagaagctgatacatgaactggaagaggagagacacttacgtcttcaaagcgagaagcggttgcaggaggtgaccctagagtctgaacgcaacagaattcagatgcgtagcttgcagcagcagttctccaggatggaagaaacagtacgaaatctattgcagagtcaaggatctccagagcagaaaaaagaagaaactgttaatataatggtctatcaggaaaagctgtcagaggaagagagaaaacataaggaagctttggaagatcttcacatggtggttgatgaggattcgaggagtgaaagcagcagtacagatgagggaaaagaaaagaccaaattgctattagagagattgaaagctctagaggcagagaattcagcgttggctttggagaatgaaaatcaaagggaacaatatgagcgatgtcttgatgaggtagccaaccaagttgttcaagctctgcttactcaaaaggatctaagagaggaatgtgtgaagttgaaaacaagagtgtttgatttggaacagcagaatcgaacactaagcatcctattccaacagcgagtcagacccacttctgatctgctcctccagaaacttcactcacgtctcttggatctttcatctggagatttgctttcagaggtggaaagaaaccgaagtctgacacagtcacgaactgatgctgaggtgcacgaacaccaactaaatacaaaatcggccttgaaatgccctggcttgggggctgtcatccctggtcatctctgtcctcgaaacagctacagtagcagcagtgaactgtctctttcaagcacctgcagcgagtactccagtggctcctcctacacgtggcacgatgggaagaacctcaggaaaaggcaatcatcacaaaactgggataaaaggctaagtattgattcttcgctcccaagtggctttgctagtcctacaaatgaactacctccaactcgtatcaaggaaagccacattttggaagggctaagaaagctacagaagcgaaaagtgttacttgaacccccatcagtgataaccaaatggggttataaagattgcatgaactcgaatgaaggaatatattctcctggaattaaaagtagcagcctcaaggagtatcccccctgcaaaacagctgacctggggagcccctgcaaggaaccccacaagacatttgtttatgatctagattcccacgttgatgcggacgatgacccttccaccttagcattgctccaagcagttccaaaccagagctgcaggccacatggcagtaaattaacccacagtgtttccgacagtctgtttggctgggagacaaacagaaaacactttctggaaggcacatcctcagtttatcccaaggaaaggcctgaaaagctgacaagttgcgccagcagctgtcccttagagatgaagctgtgcccaagtgtgcagacgcctcaggtacagagggagaggggcccacagggccaaggccatggccgcatggctctcaacctccagctttcagacactgatgacaatgaaacgtttgatgagctgcacatagagagcagtgatgagaaaagtccttcagacgtgtcattggctgccgacaccgataagtccgtggagaacctggatgtccttgtggggtttggaaaatctctatgtgggtctcctgaagaggaggaaaaacaagtgcccatcccttcagagactaggccaaagacttttagtttcattaagcagcaaagagttgtaaaaaggacttcttcagaagaatgtgtgactgtgatatttgatgcggaagacggtgagcccattgaattcagctctcaccagactggggttgtcactgttaccagaaatgagatttccatcaattcaactcctgctggacccaaggcagaacatactgagcttttacctcagggaattgcttgtttacagccaagagctgctgcaagagactatactttctttaaaaggtctgaagaggacactgagaaaaacattccaaaagataatgtagataatgttcccagggtgtccactgaatctttcagctccaggacagtgacacaaaatcctcagcagcaaaagctggtcaaaccaacacacaatatatcatgccagagtaattccaggtcttcggcacccatgggcatctatcaaaagcaaaatctgacaaaaatacctcccaggggcaagtcttcacctcagaaatcaaaactaatggagcccgaagccaccacactactcccttcatctggcctggtgactcttgaaaaatcaccagccttagctcctgggaaactctcacgattcatgaagactgagagctcagggcccctctttgaattacgatcagatccacacattccaaaacattccgcccaacttccgcacagctccaggatgcccagcaggagggactgggtccagtgccccaagagtcagactccagggtcacggtcaaggcctgccattgagtctagtgacagtggagagccccccacgagggatgaacactgtggctctgggccggaggcaggggtgaaatccccttcccctccgccccctccaggcaggtccgtctccctgctggccaggcccagctatgactattcaccagcaccttcatccaccaagtccgaaaccagggtccccagtgaaacagcaaggaccccattcaaatccccgctgctgaaaggaatttctgctccagttatttcttctaatccggccacgacagaagtgcagaggaagaaaccttctgtggccttcaaaaagcctatcttcactcaccctatgccctccccagaagcagtcattcaaacccgatgccctgctcatgccccctccagctccttcaccgtaatggctctggggcctccaaaggtctctccgaagagaggtgtccccaaaacctctcctcgccaaacacttgggaccccacaaagggacataggattacagactcccaggatctctccttcaacccatgagccactggaaatgacgtcctccaaaagtgtatctccagggagaaaaggacaattgaatgatagcgcctccacaccccccaagccttccttcttaggggtaaatgagtcaccatcatctcaggtcagcagttcctcatcatcctcatcacccgccaaaagccataacagccctcatggttgtcaaagtgctcatgagaaaggactgaaaactcgccttccagtgggactcaaagtgctcatgaagtctccccagctgctcaggaaaagttccaccgtgccagggaaacatgaaaaagacagtttaaatgaagcctccaaaagttccgtggctgtgaacaagtctaagccagaggactccaagaatccagcaagcatggagatcacagcgggtgaaagaaatgtgaccctaccggattcacaagcacagggcagtttagctgatgggcttcccctggaaacagcactacaagagccattggaaagtagcatccctgggagtgatggaagggatggggtagataatagatccatgagaagatccctttcctccagcaaaccacacctaaaaccagctctgggtatgaatggcgccaaagcccgcagccacagcttcagtacacactcaggagacaagccttctacgccccccatcgaagggtcaggcaaagtccgcactcagatcattaccaataccgccgagagaggcaattctcttacccggcagaactcttccacggaaagctctcccaacaaggccccttctgctcccatgttggagagtctccccagtgttgggaggccctcggggcacccctcctccgggaagggctccctggggagctcaggcagcttcagcagtcagcatgggagcccaagtaagttgcctttgaggatccctccaaagtctgagggactcctcatcccacctggaaaggaagaccagcaggccttcacccagggagagtgccccagtgccaatgtggctgtacttggggaaccaggcagtgaccgccgcagttgcccacccaccccaacagactgccctgaagccctgcagagcccagggaggactcagcatccaagcacttttgaaacaagcagtacatccaagctagaaacttctggaaggcatccagatgcctctgcaaccgcgactgatgctgtgagttcagaagcccccctctcacccacaatcgaagaaaaggtcatgttgtgcattcaggaaaatgtggaaaagggccaagtgcaaacaaagcccacctctgtggaagcaaagcagaagcctgggccttcttttgccagctggtttggttttcggaagagtagacttccagctctgagtagcaggaaaatggacatctccaaaaccaaagtagaaaagaaagatgcaaaagtcttggggtttggaaacagacaactaaaatcagaaagaaaaaaagagaaaaagaagcctgaactacagtgtgagacagaaaatgagcttatcaaggacaccaagtcagcagataatccagatggcggtttacaaagcaaaaataatcggagaacaccacaagacatttacaaccaactgaagattgaaccaaggaatagacacagccctgttgcatgttcaacgaaagacaccttcatgacggaactcttgaacagagttgataagaaagcagctccacagacagaaagtggatcaagtaatgcttcctgcaggaatgtgttaaagggcagttctcagggctcctgtctcatcggcagctctatcagtactcaaggaaaccacaagaaaaacatgaaaatcaaagccgatatggaagtaccaaaagactccctggtaaaagaggcaaatgaaaacttgcaagaggatgaagacgatgcagttgcagattctgtatttcagagccacatcatagaatccaactgccagatgagaacattggacagtgggatcggaacctttccactcccagactcgggaaatcgctcgacaggacgctacctatgccagccagactccccagaggacgctgagcctctcctgcctctccagtcagccctttctgcagtttcttccatgagagcccaaacccttgaacgtgaagtgccttcctccacagacggccagcgccctgcagatagcgccattgttcattccacatccgaccccatcatgaccgccagagggatgaggcctcttcagagccgcctccccaaaccagcttcctcaggaaaagtcagttcccaaaagcagaatgaagcagagccaaggcctcagacatgctcatcattcggatatgctgaagacccaatggcaagccagccgcttccagactgggggagtgaagttgctgccaccgggacccaggacaaggcacccagaatgtgtacgtactctgccagcggtggcagtaatagtgacagtgacctggactatggagataatggttttggagctggaaggggacagttagtgaaagcactgaagagcgctgccccagaaattgagacaacttgaagaaacaaaagacgatcccgagaatagattatcgaaaatttccctagagtcattcaataaatttaacagcaatactgtgattttattagaaaaagagaagaactctctgaacaaggttgaaggacagaaggaagaaaaagaaaaaaatgaagagacatctttgagtagttcagataggcctggggtagacaacttggaatctttgagtgattctttatatgatagcttctcttcctgtgccagtcaaggttcaaatgatgtataaaggacatctcttcccttagtgagctgggactggagcgcttaagaaatgatgggtggggggtggggggtgcaccgcttgatagagataacaataaactattgcagtaccagagccttccttgtcaaattcacagcaggcaacccaccagagcttatttctctgacagggcaataaagatagactccatttattgtgtttcaagaggattaagcgtaaacacatctatgatacagaatccttaattttgcactttttttgaatatttgtacagaagttgtaaattttttggaagagaaattatatttgtagcaaaaaaagacagcaataaatggaatcagtgccatgctcttgaaataatgtactaagtcttagaagttgatgataatatatattttttaaaatcccaactgaagtttttgtgaagttcgttgtcctggtcctcaaattgtttgtgggtacactctgtaaacctacaacagggcctgccaaaaaatcggagggttcctcctcatctccatctcacaaatctcaatttgatggaaatgttcattttagtgtaatttcagattcgttgccagagattcaggtgatagtaataagtgtcattctgcttctgctgaaaaatgaaaagggtcctgaagtgtggacactgattgggagtgtgacattgtatcagaaatgaccgaattctattcccaataccagtttttccttccagacatttctttagattgtcttttacttagtgcttctctatgatcctgaatattatttgatttttatcttcttgctctttttattaaaatctgggcactctaaaaatgaaaacaaatttctatttgcaatgttcacttttaaaaataaaattaatggtgctacgaagaattctttttaatatccttttttttctacaaagactgtttatatgtaaggataaattctattttaaaggttatgtgtattttttctagatgtgaactatttataattacttatgtacaggagcttgtaaactaggcccaatagaaatatttttaggatctatatggctactttagcacataattgtttctttaaagagtattgtatgatcagtgttatttggttaatttgtgcaatttgttttattttatcttaaatgaaaattatgtaaaatgtccttgtctttcagactttaaaaaatctttttgtttcctttctgaataaaagttatatcacatttg

SEQ ID NO: 5173 - DNA, 1770 bp, Homo sapiens
atggagggaaagagacagcttgagaaaagggactttggaaaaaggctgtctctagacagcagtcttgtggaatacatggactccaataaatacattgagcatctgctgactcagcttgaggagcaacacaggagtctctggagggagaagttggcagtggcccgactacagcgagaagttgcccaaagaacaagtgagggggccatgcatgagaagctgatacatgaactggaagaggagagacacttacgtcttcaaagcgagaagcggttgcaggaggtgaccctagagtctgaacgcaacagaattcagatgcgtagcttgcagcagcagttctccaggatggaagaaacagtacgaaatctattgcagagtcaaggatctccagagcagaaaaaagaagaaactgttaatataatggtctatcaggaaaagctgtcagaggaagagagaaaacataaggaagctttggaagatcttcacatggtggttgatgaggattcgaggagtgaaagcagcagtacagatgagggaaaagaaaagaccaaattgctattagagagattgaaagctctagaggcagagaattcagcgttggctttggagaatgaaaatcaaagggaacaatatgagcgatgtcttgatgaggtagccaaccaagttgttcaagctctgcttactcaaaaggatctaagagaggaatgtgtgaagttgaaaacaagagtgtttgatttggaacagcagaatcgaacactaagcatcctattccaacagcgagtcagacccacttctgatctgctcctccagaaacttcactcacgtctcttggatctttcatctggagatttgctttcagaggtggaaagaaaccgaagtctgacacagtcacgaactgatgctgaggtgcacgaacaccaactaaatacaaaatcggccttgaaatgccctggcttgggggctgtcatccctggtcatctctgtcctcgaaacagctacagtagcagcagtgaactgtctctttcaagcacctgcagcgagtactccagtggctcctcctacacgtggcacgatgggaagaacctcaggaaaagggtaaaagaggcaaatgaaaacttgcaagaggatgaagacgatgcagttgcagattctgtatttcagagccacatcatagaatccaactgccagatgagaacattggacagtgggatcggaacctttccactcccagactcgggaaatcgctcgacaggacgctacctatgccagccagactccccagaggacgctgagcctctcctgcctctccagtcagccctttctgcagtttcttccatgagagcccaaacccttgaacgtgaagtgccttcctccacagacggccagcgccctgcagatagcgccattgttcattccacatccgaccccatcatgaccgccagagggatgaggcctcttcagagccgcctccccaaaccagcttcctcaggaaaagtcagttcccaaaagcagaatgaagcagagccaaggcctcagacatgctcatcattcggatatgctgaagacccaatggcaagccagccgcttccagactgggggagtgaagttgctgccaccgggacccaggacaaggcacccagaatgtgtacgtactctgccagcggtggcagtaatagtgacagtgacctggactatggagataatggttttggagctggaaggggacagttagtgaaagcactgaagagcgctgccccagaaatgcccataact

SEQ ID NO: 5174 - DNA, 658 bp, Homo sapiens
agaaagaggaaagtaagggctgactgaggctgtcagatcagagagctgaggctggaagtggctacagtggtcctgatgacccagctgaggtcactggttggctcttgcttcagtagaggaatacatggactccaataaatacattgagcatctgctgactcagcttgaggagcaacacaggagtctctggagggagaagttggcagtggcccgactacagcgagaagttgcccaaagaacaagtgagggggccatgcatgagaagctgatacatgaactggaagaggagagacacttacgtcttcaaagcgagaagcggttgcaggaggtgaccctagagtctgaacgcaacagaattcagatgcgtagcttgcagcagcagttctccaggatggaagaaacagtacgaaatctattgcagagtcaaggatctccagagcagaaaaaagaagaaactgttaatataatggtctatcaggaaaagctgtcagaggaagagagaaaacataaggaagctttggaagatcttcacatggtggttgatgaggattcgaggagtgaaagcagcagtacagatgagggaaaagaaaagaccaaattgctattagagagattgaaagctctagagagaaatggctggaattggcatcctgtttct

SEQ ID NO: 5175 - DNA, 4900 bp, Homo sapiens
ggaggcggctccggcacccccctttctctgccccccgcccccaagccgcggccatggacctggcggatccggcctgccctggcccagctcaacacctgatttcggcaaggtgaccgttctggatgctagagtgagtgtgcccacctgcgtaagggggcagagacagcctgccggggcttctcttccttgttcccagggccagatgtcagaggccatggaccagccagctgggggtcctggaaacccaaggccaggagagggtgatgatggcagcatggagccaggcacctgccaggagcttctgcaccgactgcgggagctggaggcagagaactcggcacttgcccaggccaacgaaaaccagcgggagacttatgagcgctgtctggacgaggttgccaaccatgtggtacaggcgttgctgaaccagaaggacctgcgagaggagtgcatcaagctgaagaagagagtgtttgacctggaacggcagaaccagatgctgagtgccctgtttcagcagaaactccagctcacgacaggctcgctccctcagatcccactcactccactccagccaccatcagagccaccagcctccccctccctgagctccactgagggaccggctgccccgctgcctctggggcactgtgctgggcagagagaggtatgttgggagcagcagctgaggccaggaggcccaggccccccagccgccccacccccagcgctggatgccctatccccgttccttcggaagaaggcccagattctggaggtgctgagagccctggaagagactgaccccttgcttctctgctcacctgccaccccctggcggcctccaggccaggggcctggctccccagagcccatcaacggcgagctgtgtggcccgcctcagcctgaaccctcaccctgggcgccctgcctgctgctaggccctggcaacctgggaggcctgctgcactgggagcgcctcttggggggtctgggaggggaagaggacactgggcggccctggggtcctagcaggggacctcctcaggcccagggcaccagctctggcccaaactgtgccccaggcagcagctcctcctcctcttctgatgaggcaggtgaccccaatgaggcacccagccccgacaccctgctcggtgccctggcccgcagacagttgaacctgggccagctccttgaggacacagagtcttacctacaggccttcctggccggggctgcaggcccactcaatggggaccacccaggtcctgggcagtcatcctccccagaccaggcgcccccacagctgtctaagtccaaaggcctccccaagtcagcttggggtgggggtaccccagaggcccacaggccaggcttcggtgctacctcagagggccaggggcccctccccttccttagcatgttcatgggtgctggggatgccccactgggctctcggcctggccacccccattcctcatctcaggtgaaaagcaagctccaaattggccccccttctcctggggaagctcagggaccccttctgccctctccagctaggggtctcaagtttctaaagctgcctccaacctcggagaagagccccagcccaggaggcccgcagctcagtccccagctcccccggaactcgcgaatcccctgtcggaacagtggctcagacggcagcccctccccactgttggcccgaaggggtctgggtggaggagagctgtccccagagggggcgcaaggcctgcccaccagcccttcaccctgctacacaaccccagactccacacagctcagacccccgcagtcagccttgtccaccacgctgtccccaggcccagtggtgtctccctgctatgagaacattctggacctttctcggagcacctttagggggccttccccagagccacctccatccccactgcaggtgcccacctacccacagctaactctggaggtaccacaggcccctgaggtcctcagaagccctggagtaccccccagtccttgcctcccagaatcgtacccctatgggagcccccaagagaagagtttggacaaggcaggctcggagtctccccatcccggccgcaggaccccaggcaactcatccaagaagcccagccaggggtcaggacggcgacctggggatcctggcagcacacctctgcgggacagactggcggccctggggaagctgaagacaggccccgagggggccctgggctcagagaagaatggggtgccagccaggcctggcaccgaaaagacccggggacctgggaagtcaggggagagtgctggagacatggtgccctccatccacaggccactggagcagctagaagccaagggggggatacggggggcagtggccttgggcacaaacagcctgaagcagcaggaacctggacttatgggggatcccggggcccgagtctactcctctcactccatgggggcccgggtggacctggagcctgtctcaccaaggagctgcctcaccaaagtggagctggccaagagccggctggcaggggccctgtgcccccaggtaccccgtacccctgccaaagtgccaacctcagccccaagcctgggcaagcccaataagagccctcacagcagccccaccaagctcccttccaagtcaccaaccaaggtggtgcctcgacctggggctccgctagtcaccaaggagtcccccaagcctgacaaagggaagggccctccctgggcagactgtggtagtaccacggcccagtccacacccctagtacctggccccactgacccaagtcagggccctgaggggctggccccacactcagccatcgaggagaaggtgatgaagggcattgaggagaacgtgctgcggctccagggccaggagcgagcccctggcgccgaggtcaagcaccgcaacaccagcagcatcgccagctggttcggccttaagaagagcaagctgccagcgctgaaccgccgcacagaggccaccaagaacaaggagggggctggcgggggctccccgctccggagggaagtcaagatggaagcccggaagctggaggccgagagcctcaacatctccaagctgatggccaaggcggaagacctgcgtcgggcactggaagaggagaaggcctacctaagcagccgggcccggccacggcctggtggcccagccccagggcccaacacggggctggggcaggtgcagggccagctggctggcatgtaccaaggtgcagacaccttcatgcagcagctgctaaacagggtggatggcaaggagctgccatccaagagctggcgggagcccaagcctgagtacggggatttccagccggtgtcttctgaccccaagagcccctggccagcctgtgggccccggaatggcctggtgggccctcttcagggctgcggaaaacctcctggaaagccgagcagcgagccagggaggcgggaagagatgccctcggaggacagcctggccgagccagtgcccacctcacacttcacagcctgtggctccttgactcgaaccttggacagtggcattgggaccttcccacccccagaccatggtagcagtgggacccccagcaagaatcttcctaagaccaagccaccgcggctggatcccccacctggggtacccccagctcggcccccaccccttaccaaagtcccccgccgcgcccacacactggagcgggaggtgccaggcatagaggagctgctggtgagtgggcggcaccccagcatgccagccttccctgcactgctacccgctgctccgggccaccggggccatgagacctgtcctgatgatccctgtgaagacccaggccccacccctcctgtccagctggccaagaactggaccttccccaatactagggcagccggcagctcctcggaccctctcatgtgcccaccccgacaactggaggggctgcccaggacccccatggccctgcccgtggaccggaagcgaagccaggagcccagccgcccgtcccctacgccccagggcccacctttcgggggtagccgcacccccagcacttcggacatggccgaggaaggcagagtggccagcgggggccccccagggctggagacctcggagtctctcagtgactcactctacgactcgctgtcctcttgtgggagtcagggctgaggggctgcgccacgccacggccccgctggagctggggaccacagactggaccggctctcttcatgcccagcccccggagacggggacccctccctgaagggaccaaggaggcaggtggataagaaggtgaaaagggggtccctggcacaccccaccacccactgcttcggcggatgagatgaccgtgctcagctcagggagagaccccgcccttggtcccttctctcacccagagtaaggctcttcctggaagggactgggggttaaaggccactgtgtcgcagccctccagtccctacttcaggctgagccatcttgtggtgctgggcttcctgcccaccagccgtgccatctctgcccaacccggctgctcctctgccccgaagccctcgcgaggccctcctggaggcccccgtgctggtggagtttgggggccagggggacaagttgccttctctctctgccctggtcctccctgctgtctggatggtgctgccctcctctgccccatgcctttggggtctgttcgtccgtcttttttgttgttgtttttatatattgaagcgcctggcccagcccccagcccccagccccgcactgcggttaatttatgtgttgtttaaaatgcggctgctctgcttcctgcctctgcttctgccgtatccctaataaaatgtggaggccccctccctg

SEQ ID NO: 5176 - DNA, 4834 bp, Homo sapiens
ggaggcggctccggcacccccctttctctgccccccgcccccaagccgcggccatggacctggcggatccggcctgccctggcccagctcaacacctgatttcggcaaggtgaccgttctggatgctagagtgagtgtgcccacctgcgtaagggggcagagacagcctgccggggcttctcttccttgttcccagggccagatgtcagaggccatggaccagccagctgggggtcctggaaacccaaggccaggagagggtgatgatggcagcatggagccaggcacctgccaggagcttctgcaccgactgcgggagctggaggcagagaactcggcacttgcccaggccaacgaaaaccagcgggagacttatgagcgctgtctggacgaggttgccaaccatgtggtacaggcgttgctgaaccagaaggacctgcgagaggagtgcatcaagctgaagaagagagtgtttgacctggaacggcagaaccagatgctgagtgccctgtttcagcagaaactccagctcacgacaggctcgctccctcagatcccactcactccactccagccaccatcagagccaccagcctccccctccctgagctccactgagggaccggctgccccgctgcctctggggcactgtgctgggcagagagaggtatgttgggagcagcagctgaggccaggaggcccaggccccccagccgccccacccccagcgctggatgccctatccccgttccttcggaagaaggcccagattctggaggtgctgagagccctggaagagactgaccccttgcttctctgctcacctgccaccccctggcggcctccaggccaggggcctggctccccagagcccatcaacggcgagctgtgtggcccgcctcagcctgaaccctcaccctgggcgccctgcctgctgctaggccctggcaacctgggaggcctgctgcactgggagcgcctcttggggggtctgggaggggaagaggacactgggcggccctggggtcctagcaggggacctcctcaggcccagggcaccagctctggcccaaactgtgccccaggcagcagctcctcctcctcttctgatgaggcaggtgaccccaatgaggcacccagccccgacaccctgctcggtgccctggcccgcagacagttgaacctgggccagctccttgaggacacagagtcttacctacaggccttcctggccggggctgcaggcccactcaatggggaccacccaggtcctgggcagtcatcctccccagaccaggcgcccccacagctgtctaagtccaaaggcctccccaagtcagcttggggtgggggtaccccagaggcccacaggccaggcttcggtgctacctcagagggccaggggcccctccccttccttagcatgttcatgggtgctggggatgccccactgggctctcggcctggccacccccattcctcatctcaggtgaaaagcaagctccaaattggccccccttctcctggggaagctcagggaccccttctgccctctccagctaggggtctcaagtttctaaagctgcctccaacctcggagaagagccccagcccaggaggcccgcagctcagtccccagctcccccggaactcgcgaatcccctgtcggaacagtggctcagacggcagcccctccccactgttggcccgaaggggtctgggtggaggagagctgtccccagagggggcgcaaggcctgcccaccagcccttcaccctgctacacaaccccagactccacacagctcagacccccgcagtcagccttgtccaccacgctgtccccaggcccagtggtgtctccctgctatgagaacattctggacctttctcggagcacctttagggggccttccccagagccacctccatccccactgcaggtgcccacctacccacagctaactctggaggtaccacaggcccctgaggtcctcagaagccctggagtaccccccagtccttgcctcccagaatcgtacccctatgggagcccccaagagaagagtttggacaaggcaggctcggagtctccccatcccggccgcaggaccccaggcaactcatccaagaagcccagccaggggtcaggacggcgacctggggatcctggcagcacacctctgcgggacagactggcggccctggggaagctgaagacaggccccgagggggccctgggctcagagaagaatggggtgccagccaggcctggcaccgaaaagacccggggacctgggaagtcaggggagagtgctggagacatggtgccctccatccacaggccactggagcagctagaagccaagggggggatacggggggcagtggccttgggcacaaacagcctgaagcagcaggaacctggacttatgggggatcccggggcccgagtctactcctctcactccatgggggcccgggtggacctggagcctgtctcaccaaggagctgcctcaccaaagtgccaacctcagccccaagcctgggcaagcccaataagagccctcacagcagccccaccaagctcccttccaagtcaccaaccaaggtggtgcctcgacctggggctccgctagtcaccaaggagtcccccaagcctgacaaagggaagggccctccctgggcagactgtggtagtaccacggcccagtccacacccctagtacctggccccactgacccaagtcagggccctgaggggctggccccacactcagccatcgaggagaaggtgatgaagggcattgaggagaacgtgctgcggctccagggccaggagcgagcccctggcgccgaggtcaagcaccgcaacaccagcagcatcgccagctggttcggccttaagaagagcaagctgccagcgctgaaccgccgcacagaggccaccaagaacaaggagggggctggcgggggctccccgctccggagggaagtcaagatggaagcccggaagctggaggccgagagcctcaacatctccaagctgatggccaaggcggaagacctgcgtcgggcactggaagaggagaaggcctacctaagcagccgggcccggccacggcctggtggcccagccccagggcccaacacggggctggggcaggtgcagggccagctggctggcatgtaccaaggtgcagacaccttcatgcagcagctgctaaacagggtggatggcaaggagctgccatccaagagctggcgggagcccaagcctgagtacggggatttccagccggtgtcttctgaccccaagagcccctggccagcctgtgggccccggaatggcctggtgggccctcttcagggctgcggaaaacctcctggaaagccgagcagcgagccagggaggcgggaagagatgccctcggaggacagcctggccgagccagtgcccacctcacacttcacagcctgtggctccttgactcgaaccttggacagtggcattgggaccttcccacccccagaccatggtagcagtgggacccccagcaagaatcttcctaagaccaagccaccgcggctggatcccccacctggggtacccccagctcggcccccaccccttaccaaagtcccccgccgcgcccacacactggagcgggaggtgccaggcatagaggagctgctggtgagtgggcggcaccccagcatgccagccttccctgcactgctacccgctgctccgggccaccggggccatgagacctgtcctgatgatccctgtgaagacccaggccccacccctcctgtccagctggccaagaactggaccttccccaatactagggcagccggcagctcctcggaccctctcatgtgcccaccccgacaactggaggggctgcccaggacccccatggccctgcccgtggaccggaagcgaagccaggagcccagccgcccgtcccctacgccccagggcccacctttcgggggtagccgcacccccagcacttcggacatggccgaggaaggcagagtggccagcgggggccccccagggctggagacctcggagtctctcagtgactcactctacgactcgctgtcctcttgtgggagtcagggctgaggggctgcgccacgccacggccccgctggagctggggaccacagactggaccggctctcttcatgcccagcccccggagacggggacccctccctgaagggaccaaggaggcaggtggataagaaggtgaaaagggggtccctggcacaccccaccacccactgcttcggcggatgagatgaccgtgctcagctcagggagagaccccgcccttggtcccttctctcacccagagtaaggctcttcctggaagggactgggggttaaaggccactgtgtcgcagccctccagtccctacttcaggctgagccatcttgtggtgctgggcttcctgcccaccagccgtgccatctctgcccaacccggctgctcctctgccccgaagccctcgcgaggccctcctggaggcccccgtgctggtggagtttgggggccagggggacaagttgccttctctctctgccctggtcctccctgctgtctggatggtgctgccctcctctgccccatgcctttggggtctgttcgtccgtcttttttgttgttgtttttatatattgaagcgcctggcccagcccccagcccccagccccgcactgcggttaatttatgtgttgtttaaaatgcggctgctctgcttcctgcctctgcttctgccgtatccctaataaaatgtggaggccccctccctg

SEQ ID NO: 5177 - DNA, 3278 bp, Homo sapiens
cggaggggctcctggctgcccgcacctgcacccgcgcgtcggcggcgccgaagccccgctccccgcctgcgcgtctgtctcgtccgcatctccgcggcctcctgctccacgacgtgaccatggccgggctgcaggagctgcgattccctgaggagaagccgctgctccggggccaggacgccaccgagctggagagctccgatgccttcctcttggctgcagacacagactggaaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcagagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggccattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattccagtgtggtgatgccatgcccatcatgggaggcttttggagaaacagaatgtttgggcaggggctgctggtgctgcttgggttttgggttgagggtgctaggagaggatggtctccacccatctttctatttccagtacacgtcacattattttaccggtgagatgagaatgtcacaaacattaaaagccttatgtgctca

SEQ ID NO: 5178 - DNA, 1375 bp, Homo sapiens
acagagccgaccatctcccactcgagctgcccccgccctctggacccgagtgactcaggcctttgtttgtccttcctggtagaggcgggttccctccctcggcaagatgccggagtgctgggatggggtgggggaaggcaacgctggagccgtgaagctggcagggctaggggaccccaggtggagcccagggcacctcctctcgccggggcatcaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcagagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtct

SEQ ID NO: 5179 - DNA, 3392 bp, Homo sapiens
aatctgagccgtctttctctgggggagaagtttcttgctgggagtggaggcgacgccaagtggcctgggaagtgggaagccagattggaccctactgactggggaccctcagccttggggctcctctggagaagtgatcagttgccctgctggaaactcacatccagggggcagtggctggagagcaagagcgaacggtcaggaagaggaggcctcctgctccacgacgtgaccatggccgggctgcaggagctgcgattccctgaggagaagccgctgctccggggccaggacgccaccgagctggagagctccgatgccttcctcttggctgcagacacagactggaaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcagagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggccattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattccagtgtggtgatgccatgcccatcatgggaggcttttggagaaacagaatgtttgggcaggggctgctggtgctgcttgggttttgggttgagggtgctaggagaggatggtctccacccatctttctatttccagtacacgtcacattattttaccggtgagatgagaatgtcacaaacattaaaagccttatgtgctc

SEQ ID NO: 5180 - DNA, 3332 bp, Homo sapiens
gctccgcgctctcctgccgctccgctccgggtctcccgcgctcctctccccggctcggccgagcgcgctgccccgacgccgccacccagagccgggccgcgccgggcgccgagatgaaggtgctgggacaccggctggagctgctcacaggcctcctgctccacgacgtgaccatggccgggctgcaggagctgcgattccctgaggagaagccgctgctccggggccaggacgccaccgagctggagagctccgatgccttcctcttggctgcagacacagactggaaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcagagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggccattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattccagtgtggtgatgccatgcccatcatgggaggcttttggagaaacagaatgtttgggcaggggctgctggtgctgcttgggttttgggttgagggtgctaggagaggatggtctccacccatctttctatttccagtacacgtcacattattttaccggtgagatgagaatgtcacaaacattaaaagccttatgtgctca

SEQ ID NO: 5181 - DNA, 5116 bp, Homo sapiens
gctgctcctgccgcttcgctccgcgctctcctgccgctccgctccgggtctcccgcgctcctctccccggctcggccgagcgcgctgccccgacgccgccacccagagccgggccgcgccgggcgccgagatgaaggtgctgggacaccggctggagctgctcacaggcctcctgctccacgacgtgaccatggccgggctgcaggagctgcgattccctgaggagaagccgctgctccggggccaggacgccaccgagctggagagctccgatgccttcctcttggctgcagacacagactggaaggcctcgggcgagctcgccacccagatccttgctgcccaggagaacagggcacggagcctgagatagacctagtgttctgctccccagagacccgagagccaagccccaaactggttgcctctgggaacgagggccgggtgggtctacaggaggtgggcatgtcaatgtcagcaagctgcctcctagccccgcttcctctccctggtggtctggagcccctggcagcagggtgagggtggggagggcagagctggtgtgtgcctgaccatacccctggccctgctatctgcccagggcccctggcccccggcccccaaactccattttcagcatgtggggaaaccccctgtatctgcgtgggcaaggtgggattttcatccctggtgggtggagaaggagcagccccttgaagcagggtgataacccaagttgccccagaaagcagcagctccccaggcctccacaaggttaagcgatggaaccttcctaatgggaaggctgggcgtgggggtctggtccccaagatgttgggcttggggccctctcgggccctccatactccccaaggtgtgggtcaagggctctagctgtctgggcagtgcccatgcaccctgccctgccccgcattggtaagctgtgcatgtctgtgacgaccctgtgtgtacctgacatgggtgagtctgtacgtgtggtctcggcttttgtattcggaggatcccgtgtgagctgcagctgttggcgtgtgcctatgtgctgggggcggatgcaggggctggggaccatcaaggatgatgtgtggctggggtgggaggagcagtgacagggctggggcaaggaggacttcagaagccaattggagccaggcttgtctcccagcagccaatatgggagctggggctcctggtaagcgagtggctgctcagaaaccctgcggggaggaggggctagctaggctgggccaggatccctgtataaatggcccaggagctgtgccccatcacagagccgaccatctcccactcgagctgcccccgccctctggacccgagtgactcaggcctttgtttgtccttcctggtagaggcgggttccctccctcggcaagatgccggagtgctgggatggggtgagtgagggcgctgcgggcatcaaggtgggccgggaggatggtgcatccttatgacccaccgcagggaggaagtgcccccctcaacccacatctggtggcagcccggccttcaaatagcctcaccctggggtcactgagacacggccagagtgctccaggttccctggtgatcctgtttgcaggagtggctgggggcagctgctagtcagagcccatagcaggggctggggggagcgtgtggttggggggtgggtgacatatctgcaggaaatggaacgtggaaggcactgtctgacttggctgcattgcccgtgtggacccgggcgctagtgcctgcatgtccctctgaccgtgtgccctctggtgtgcgcttggatggtgtctgccttggtgatgcctggggccatcaggccagggggcgggggtgtccttggtgagcccccgaggctgtgtgcccagtgtgcgtgccgggtctgtgcgtgcaggggctgccgtcccagtgggcggccgtctagcttgtttggatggctgcgccagtgtgatgggaaggacaggcggcctcttccttaggagccacctcacagttcccagggctctgctgcgccagccgggcagaggcaaggaggtctgggccacacaggaatgacagcctttcaggcaggggtccctgctggggaggaacgaggaggggttgcctgcctgccttattttgtaggtgggggaaggcaacgctggagccgtgaagctggcagggctaggggaccccaggtggagcccagggcacctcctctcgccggggcatcaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacattgcgtacttgaaggaccgaaggctgagtggaggagcagtgccctcagccagcatgacccgcctggcacgctcccgcactgcatccctcaccagtgccagctcggtggatggcagccgcccacaggcctgcacccactcagagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggccattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaag

SEQ ID NO: 5182 - DNA, 3265 bp, Homo sapiens
gtaagcgagtggctgctcagaaaccctgcggggaggaggggctagctaggctgggccaggatccctgtataaatggcccaggagctgtgccccatcacagagccgaccatctcccactcgagctgcccccgccctctggacccgagtgactcaggcctttgtttgtccttcctggtagaggcgggttccctccctcggcaagatgccggagtgctgggatggggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcagagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggccattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattccagtgtggtgatgccatgcccatcatgggaggcttttggagaaacagaatgtttgggcaggggctgctggtgctgcttgggttttgggttgagggtgctaggagaggatggtctccacccatctttctatttccagtacacgtcacattattttaccggtgagatgagaatgtcacaaacattaaaagccttatgtgctca

SEQ ID NO: 5183 - DNA, 3207 bp, Homo sapiens
acagagccgaccatctcccactcgagctgcccccgccctctggacccgagtgactcaggcctttgtttgtccttcctggtagaggcgggttccctccctcggcaagatgccggagtgctgggatggggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacattgcgtacttgaaggaccgaaggctgagtggaggagcagtgccctcagccagcatgacccgcctggcacgctcccgcactgcatccctcaccagtgccagctcggtggatggcagccgcccacaggcctgcacccactcagagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggccattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattccagtgtggtgatgccatgcccatcatgggaggcttttggagaaacagaatgtttgggcaggggctgctggtgctgcttgggttttgggttgagggtgctaggagaggatggtctccacccatctttctatttccagtacacgtcacattattttaccggtgagatgagaatgtcacaaacattaaaagccttatgtgctc

SEQ ID NO: 5184 - DNA, 656 bp, Homo sapiens
cgtgagtccggcgcgcagaggaggaggagaaagctgaccgcttaggccggggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctaatccggcggaggccgatcgcgacggctggtttgcatcgccagcttctatatattacggcctttttttttgctggatattatcttgtaaaacgtgaagactacctgtatgctgtgagggaccgtgaaatgtttggatatatgaaattacatccagaggattttcctgaagaagatgtctactgttgtggagctgaacgtcgggggtgagttccacaccaccaccctgggtaccctgaggaagtttccgggctcaaagctggcagagatgttctctagcttagccaaggcctccacggacgcggagggccgcttcttcatcgaccgccccagcacctatttcagacccatcctggactacctgcgcactgggcaagtgcccacacagcacatccctgaa

SEQ ID NO: 5185 - DNA, 3046 bp, Homo sapiens
atcacatggccggagagtcacaaaaacaacagctttggccaagaccgtgacttcagtaaagggaacccggggctctcgcagccagccctcctgcccatggaggacagtttccttcaatcttttgggaggctgagcctccagccccagcagcagcagcagcggcagcggccgccccggccgcccccgcgggggacacctcctcgccgccacagctttaggaaacacctctacctcctgcgaggcctcccgggctccgggaaaactacactggccagacaattgcagcatgactttcccagggccctgattttcagcacggatgattttttcttcagggaagatggtgcctatgagttcaatcctgacttcctggaggaagctcatgaatggaaccaaaaaagagcaagaaaagcaatgaggaatggcatatcccccattattattgataataccaacctccacgcctgggaaatgaagccctatgcagtcatggcacttgaaaataactatgaagttatattccgagaacctgacactcgctggaaattcaacgttcaagagttagcaagaagaaacattcatggtgtctcaagagaaaaaatccaccgaatgaaagaacggtatgaacacgatgttacttttcacagtgtgcttcatgcagaaaagccaagcagaatgaacagaaaccaggacaggaataatgcattgccttccaacaatgccagatactggaattcctacacagagtttccaaaccggagggcccacggtggatttacaaatgagagctcctatcacagaaggggcggttgtcaccatggatattagaggcctatcttacagccaggcagaattttcctaagtcagtttctacttcagtttttgttattttttgttgcattttagtcagagctccaattccagtgtaaatagctgaactcaaaagtttctgagcaaagtcattatattcactttcttcaccaaaatttgttaaagtgcttctatatgcatggtctgatgctgggaattctgcagatttgagtaaacagtctctttctctagggtaagaatttgaaaccaaaacttgagaacacacccaagaatatatttacataggttcatagatgaaataaagtgtttatattatatataagcttcagtaccatttgctctgaagtgatctatttattttttcaggaaattcatctccatcggtaaagttgggaaggtggagagaagtggtgggggggcattgctacttatcaaagtgccattgctactttgataatctatgtatctaaaaatgtgagatgtgcgactcttatgatactgattttcctttaatgttaatatgccagaaagcatacatctaagggaacattgtccttcaaagtagacactttgggaagttatttctttattttaatgatgtatcattgttaaaaatgctgtcaaatccttaatagctacaggagctactgagggaaatcagtgtcattatttaaagtcacgccttgtgtttttactactttattcagcaggattaaacctgaataacttttggctgttgtgctaatagtgtaaataaaataagcctgccttcataaaacactaacttttaaaaggaataaacgacttctaaaattatgcctattaacatgtgtaattagtcggcagctcaaatgtttgggagtgcaagaaattaggcaccccaggatataggtcatacagggatatataaaagccatgctcattacaaaatgagcagttgatgttttatgtggcattaagacaatcaagtcctcacaactctggaatgtcttcttatactgatgctgaatttatgaatccaaattaatttccaacaggttggaatcagatttaatgtgagatcatgatagacaagaccacagaggacgtatgctctatttcttgttggccaacagcttctttctaatgttctgtgaaaaattattttaagtgtcttatataatggtgcttttatggttattaaaaattgtaaatggtatcacatttatatggatttgtcattggatctttttttggttcaacaataaaaaaatttaattacctaaatgccaagaaactcaacaatataccagtttttctgtatcacaggcttatttaccagtcttttttttaataaataggaatcgtaaaggtaatgacaaaagcagccttataatttagttgcttatatatttgatctgtgtacatgagactgttttaacgttatctgacactactgaaacctgctcgacatctccatgactaccaacaccatgtgtaatgttttcttcactaacattttaaaaactggtatctcctttgagtaagtttggctgacaatagtaaatcccaatgaatctaaggtgttatcagctttgctaacttctgtatctccaagcacaacataaaataatctcctaatgatctacttaataatgctcccattttccaggcccaggtagtcctgggtatcttggttgatagggtggtggcataaccagctcaatatggatggcttgactcgtctgggctggtagaggggagaaatgtcagagagctcaaagtggaaattaccatcctttgatttcacatgagcggttcaaaggaccagattcaagccctcctgacttggctggctccctgctttagggtttttggctcacttgggttaagtgagtgaccactatggagaagtggctctgggttacataacttttctagagctctaaagaatagtttcctggcctatttaatgtctcttctttccctagctgacccctgaaatatttggtttgtaaaccataaaaattgattaaatgccatcaactttatcccctgtagaagtgatctgtttttcaactcccatggcttctgatttgtgtaactctttgaacacccaatattgacttgtattgtgttcgctgtttgcatcattcatagaactggcaaatgctctttatgggcaatagggtctcattaaatgattgctgaataaataacacaaatttttaccatt

SEQ ID NO: 5186 - DNA, 1897 bp, Homo sapiens
ccctaatgcatgaggctcctgaccaccataaagatagaactggggcttaaccctcatcacttctgaagctgatggaatgacaattgcagcatgactttcccagggccctgattttcagcacggatgattttttcttcagggaagatggtgcctatgagttcaatcctgacttcctggaggaagctcatgaatggaaccaaaaaagagcaagaaaagcaatgaggaatggcatatcccccattattattgataataccaacctccacgcctgggaaatgaagccctatgcagtcatggcacttgaaaataactatgaagttatattccgagaacctgacactcgctggaaattcaacgttcaagagttagcaagaagaaacattcatggtgtctcaagagaaaaaatccaccgaatgaaagaacggtatgaacacgatgttacttttcacagtgtgcttcatgcagaaaagccaagcagaatgaacagaaaccaggacaggaataatgcattgccttccaacaatgccagatactggaattcctacacagagtttccaaaccggagggcccacggtggatttacaaatgagagctcctatcacagaaggggcggttgtcaccatggatattagaggcctatcttacagccaggcagaattttcctaagtcagtttctacttcagtttttgttattttttgttgcattttagtcagagctccaattccagtgtaaatagctgaactcaaaagtttctgagcaaagtcattatattcactttcttcaccaaaatttgttaaagtgcttctatatgcatggtctgatgctgggaattctgcagatttgagtaaacagtctctttctctagggtaagaatttgaaaccaaaacttgagaacacacccaagaatatatttacataggttcatagatgaaataaagtgtttatattatatataagcttcagtaccatttgctctgaagtgatctatttattttttcaggaaattcatctccatcggtaaagttgggaaggtggagagaagtggtgggggggcattgctacttatcaaagtgccattgctactttgataatctatgtatctaaaaatgtgagatgtgcgactcttatgatactgattttcctttaatgttaatatgccagaaagcatacatctaagggaacattgtccttcaaagtagacactttgggaagttatttctttattttaatgatgtatcattgttaaaaatgctgtcaaatccttaatagctacaggagctactgagggaaatcagtgtcattatttaaagtcacgccttgtgtttttactactttattcagcaggattaaacctgaataacttttggctgttgtgctaatagtgtaaataaaataagcctgccttcataaaacactaacttttaaaaggaataaacgacttctaaaattatgcctattaacatgtgtaattagtcggcagctcaaatgtttgggagtgcaagaaattaggcaccccaggatataggtcatacagggatatataaaagccatgctcattacaaaatgagcagttgatgttttatgtggcattaagacaatcaagtcctcacaactctggaatgtcttcttatactgatgctgaatttatgaatccaaattaatttccaacaggttggaatcagatttaatgtgagatcatgatagacaagaccacagaggacgtatgctctatttcttgttggccaacagcttctttctaatgttctgtgaaaaattattttaagtgtcttatataatggtgcttttatggttattaaaaattgtaaatggtatcacatttatatggatttgtcattggatctttttttggttcaacaataaaaaaatttaattacc

SEQ ID NO: 5187 - DNA, 2040 bp, Homo sapiens
cgtgacttcagtaaagggaacccggggctctcgcagccagccctcctgcccatggaggacagtttccttcaatcttttgggaggctgagcctccagccccagcagcagcagcagcggcagcggccgccccggccgcccccgcgggggacacctcctcgccgccacagctttaggaaacacctctacctcctgcgaggcctcccgggctccgggaaaactacactggccagacaattgcagcatgactttcccagggccctgattttcagcacggatgattttttcttcagggaagatggtgcctatgagttcaatcctgacttcctggaggaagctcatgaatggaaccaaaaaagagcaagaaaagcaatgaggaatggcatatcccccattattattgataataccaacctccacgcctgggaaatgaagccctatgcagtcatggtatttcagaccgaacaaaagaatcttttcaggctggaaatggacatggtagttttcaggccagaaatgaagaaacattcatggtgtctcaagagaaaaaatccaccgaatgaaagaacggtatgaacacgatgttacttttcacagtgtgcttcatgcagaaaagccaagcagaatgaacagaaaccaggacaggaataatgcattgccttccaacaatgccagatactggaattcctacacagagtttccaaaccggagggcccacggtggatttacaaatgagagctcctatcacagaaggggcggttgtcaccatggatattagaggcctatcttacagccaggcagaattttcctaagtcagtttctacttcagtttttgttattttttgttgcattttagtcagagctccaattccagtgtaaatagctgaactcaaaagtttctgagcaaagtcattatattcactttcttcaccaaaatttgttaaagtgcttctatatgcatggtctgatgctgggaattctgcagatttgagtaaacagtctctttctctagggtaagaatttgaaaccaaaacttgagaacacacccaagaatatatttacataggttcatagatgaaataaagtgtttatattatatataagcttcagtaccatttgctctgaagtgatctatttattttttcaggaaattcatctccatcggtaaagttgggaaggtggagagaagtggtgggggggcattgctacttatcaaagtgccattgctactttgataatctatgtatctaaaaatgtgagatgtgcgactcttatgatactgattttcctttaatgttaatatgccagaaagcatacatctaagggaacattgtccttcaaagtagacactttgggaagttatttctttattttaatgatgtatcattgttaaaaatgctgtcaaatccttaatagctacaggagctactgagggaaatcagtgtcattatttaaagtcacgccttgtgtttttactactttattcagcaggattaaacctgaataacttttggctgttgtgctaatagtgtaaataaaataagcctgccttcataaaacactaacttttaaaaggaataaacgacttctaaaattatgcctattaacatgtgtaattagtcggcagctcaaatgtttgggagtgcaagaaattaggcaccccaggatataggtcatacagggatatataaaagccatgctcattacaaaatgagcagttgatgttttatgtggcattaagacaatcaagtcctcacaactctggaatgtcttcttatactgatgctgaatttatgaatccaaattaatttccaacaggttggaatcagatttaatgtgagatcatgatagacaagaccacagaggacgtatgctctatttcttgttggccaacagcttctttctaatgttctgtgaaaaattattttaagtgtcttatataatggtgcttttatggttattaaaaattgtaaatggtatcacatttatatggatttgtcattggatctttttttggttcaacaataaaaaaatttaattacc

SEQ ID NO: 5188 - DNA, 2825 bp, Homo sapiens
cggaggtgaggtttgttaccgcgattctgagaggtgggcttttagtccctccagacctcggctttagtgctgtctccgcttttctttcaccttcacagaggttcgtgtcttcctaaaagaaggttttattgggaggtaaaggtcaatgcgtaggggtagagtaagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagaggtggggaggctctcttggctcacataatcgtgtctgtgtcacaaataatcattaaattagctattttcagctaacacatttgttgttgcacttgaaaaagagttagtgagcctgtcttggagtttaagtagtttcaaataaaaaaaggctacagtgcctcacaaaggatgttcccagcaagttgtttaaattcccagcaagttgttaaagtgtaaataaaaatatatgaaattgtattttaaatgtttttatattctcttgttgtaatactcttggctgttatggaagcacctgagtaatagagtggtgggtaggagctaggatgtttttctacaatcgaattttaaactaatttatctattttatagacactattgaacagttttttaatagttcatatctaaatctaacttttcataaaactttacggtttttccttcactaccttaaatatgcaagaaatactgacttggtatagggtaccttagttttctctattcattagacaggtaaaattatatttcagctgattgatctgtgtgacaaaattatttcttagctataatcagcacatcacttagttcaaacaaaattccccagcaaatgttagatagtaggtatatcagtcacctggggagttttcttcataatatgcatattcatcttgtaatgcatacatagttatcatcctccttctcaacccatctccctaaccccacatgcttgccagttcttgaagggataaagtgattctaataatgttttacttctctctgttcaatttaatgtgatataattctagtataaaaatattttggacagttgcttaacatggtcataagaggatttgtactatagaatatcttctagtactaatttttctgtagagcaaattatatttctctcactggatagtttttagatgtgtttcttcatataaaattaaaaactgagatggaattc

SEQ ID NO: 5189 - DNA, 2526 bp, Homo sapiens
atcttgcgtacggagaggttcgtgtcttcctaaaagaaggttttattgggaggtaaaggtcaatgcgtaggggtagagtaagaattctgcttggtcagaatcgtgatggcattgtgttcagcactgatgactattttcaccatcaagatgggtacagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagagagaaagagttttgaagaaaactgggcataggctcagcaaaaccaaacagaagaggaacagaaaaagaaacaaaaagcagaacagtcagaatagaatcatggaggaaaactcattagaattcttaagtgatcttacaccgggagatcaggacccatctcagagtgaagaggaagacattgaaaagaccagaagagaatcagaatatcccttcattgatggtctacaaaatgaagtcggagattttgtgactggatataaagaaaaaagatggaaaaataaagatcctaaagacagtttccaaaacgttatgtctatagttgaattagacaacacaccaaagaattacctctctaaggaaggtgataacttgtttgtaagtttgttactgaggccaaatgaaatctccgttacttgtccaatactgactcaaaacctttcctgtgtaacaactgatgactgctctggcatgaaggtagaaaagcatattagaaataggcataccatagcattagacacccaggacctttctgcggaaacttcatgcttatttatgaagaagagagaaatagtagataaaaatctctcacatgaacccattctgtgccatcaacatggaatcagaatgtcagataaagttttaagagaggaacaagtgtatacaactaaaatcaatcactgggcttttttcacaaccaatttatctgatgaagatttacagctgggctctgacagacagccctattttggtagctggcctgcaggacctcataagtttatatgtgaacagagaccaaagaaagatagagcatgtaagttggctggtcctgacagcagggggcaatggattcaaatgatcttcacttcggtggcagcatcagaaccaggaaacaatccagaaatattgacagacaaactactgataggaaatgaagatttttcacctccacctgaaactatggattcattcatagaaacaaacctcttcagaagctgcttacctcaaccggatataccaaagaatgccttagaatcaacaaaaaataagaaaaggaggaagaaaaggattttcaatttggtaccaaattttgacttattaggacagagtcgtatcggtgtaaaagaaagggagaaatgtgacctgttaacaaaaaaccatggactaaaaattactttgggagaagaaaaagatagaatttcagaaaggaacagtgaagaggagaataaacaaaaacttatgacctttgatcatcatccattgtggttttaccttgatattatcaaagctacccctttaaatattgatggacagcgttattctcattgcctgtcatttaacagactaaggtgctctgcatctttatacaaaaattatattccttcttttgtgctacataatttatctagtatttggaagccatcttttacaaacaagaaactgtttttgactttcgaatctcagacaagagtaggtaataaactaaatgatgcagggtttatttctccagaaattttacatagtcatcctgatacttcgtgctctttgggagtcacttctgattttcactttttaaatgaaaggtttgatagaaagctgaaaagatgggaagaacctaaggaattaccagctgaggacagccaagacttaacaagcactgactaccgttcccttgagctaccattatcacaagggtttgcctttcaattagtaaagctttttggatctccaggcgttccaatggaatccttgttgcctgatgactatgtggttccccttgactggaagacactaaagatgatctacttgcaatggaagatgtcagtggagaaaagacagaagaagattggttgaaaaatgaaaattccttgaactttgagttctgctgtcttcatggtactgctgaagatcatgatcacggagaaaagtcagagtgctcagtgccaacccaagggattctttccagagacgtacccgttggataccaaaattagtttggataatctgttcaaccattcttgataagttatctgaataataaaaaaactcaacagaggaggt

SEQ ID NO: 5190 - DNA, 2482 bp, Homo sapiens
gaccgccatcttgcgtacggagatgtcttatggtgaaattgaagaattctgcttggtcagaatcgtgatggcattgtgttcagcactgatgactattttcaccatcaagatgggtacagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagagagaaagagttttgaagaaaactgggcataggctcagcaaaaccaaacagaagaggaacagaaaaagaaacaaaaagcagaacagtcagaatagaatcatggaggaaaactcattagaattcttaagtgatcttacaccgggagatcaggacccatctcagagtgaagaggaagacattgaaaagaccagaagagaatcagaatatcccttcattgatggtctacaaaatgaagtcggagattttgtgactggatataaagaaaaaagatggaaaaataaagatcctaaagacagtttccaaaacgttatgtctatagttgaattagacaacacaccaaagaattacctctctaaggaaggtgataacttgtttgtaagtttgttactgaggccaaatgaaatctccgttacttgtccaatactgactcaaaacctttcctgtgtaacaactgatgactgctctggcatgaaggtagaaaagcatattagaaataggcataccatagcattagacacccaggacctttctgcggaaacttcatgcttatttatgaagaagagagaaatagtagataaaaatctctcacatgaacccattctgtgccatcaacatggaatcagaatgtcagataaagttttaagagaggaacaagtgtatacaactaaaatcaatcactgggcttttttcacaaccaatttatctgatgaagatttacagctgggctctgacagacagccctattttggtagctggcctgcaggacctcataagtttatatgtgaacagagaccaaagaaagatagagcatgtaagttggctggtcctgacagcagggggcaatggattcaaatgatcttcacttcggtggcagcatcagaaccaggaaacaatccagaaatattgacagacaaactactgataggaaatgaagatttttcacctccacctgaaactatggattcattcatagaaacaaacctcttcagaagctgcttacctcaaccggatataccaaagaatgccttagaatcaacaaaaaataagaaaaggaggaagaaaaggattttcaatttggtaccaaattttgacttattaggacagagtcgtatcggtgtaaaagaaagggagaaatgtgacctgttaacaaaaaaccatggactaaaaattactttgggagaagaaaaagatagaatttcagaaaggaacagtgaagaggagaataaacaaaaacttatgacctttgatcatcatccattgtggttttaccttgatattatcaaagctacccctttaaatattgatggacagcgttattctcattgcctgtcatttaacagactaaggtgctctgcatctttatacaaaaattatattccttcttttgtgctacataatttatctagtatttggaagccatcttttacaaacaagaaactgtttttgactttcgaatctcagacaagagtaggtaataaactaaatgatgcagggtttatttctccagaaattttacatagtcatcctgatacttcgtgctctttgggagtcacttctgattttcactttttaaatgaaaggtttgatagaaagctgaaaagatgggaagaacctaaggaattaccagctgaggacagccaagacttaacaagcactgactaccgttcccttgagctaccattatcacaagggtttgcctttcaattagtaaagctttttggatctccaggcgttccaatggaatccttgttgcctgatgactatgtggttccccttgactggaagacactaaagatgatctacttgcaatggaagatgtcagtggagaaaagacagaagaagattggttgaaaaatgaaaattccttgaactttgagttctgctgtcttcatggtactgctgaagatcatgatcacggagaaaagtcagagtgctcagtgccaacccaagggattctttccagagacgtacccgttggataccaaaattagtttggataatctgttcaaccattcttgataagttatctgaataataaaaaaactcaacaga

SEQ ID NO: 5191 - DNA, 595 bp, Homo sapiens
aggcaagagtgctggagggcggcagcggcgaccggagcggtaggagcagcaatttatccgtgtgcagccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagattgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtactttgttcatcgggaaatctatccaggcagcaagatcacacactttgagaggttgcagcagaagactggaattcctttctcccagatgatcttctttgatgatgagaggcggaatattgtagacgtcagcaaactgggtgttacctgcattcacatccagaatggaatgaatcttcaaactctaagtcaaggg

SEQ ID NO: 5192 - DNA, 978 bp, Homo sapiens
tccagttgcggcttattgcatcacagtaattgctgtacgaaggtcagaatcgctacctattgtccaaagcagtcgtaagaagaggtcccaatcccccactctttccgccctaatggaggtctccagtttcggtaaaagtttcatttgatctgaatagtattaaaataaaatacctggatgaggaagatgaagaggtgctggaagcccaggaagcacacatcaaggctcccttgccagcagggtgctgccaataaaaggtagtcacgtggaatttggaatgtggaaaggaggtagaagtcatcctttcctcccctgtagcagcaggcgtgcaggctctggtggtcagctggactccatactcccccaccagtcaccagcctggggaccgtggggctgcaaggacctcagcagcggtgtcccaagtttcctgacttcttccatcctctggaaatcagctgtgtttgctgaggataatggcctcaagatccatctgtgttcctacaaaagagatgatcttgttcttttttatgattgcacatcttttgttctaacgtttggtccttcaccttggttcctgacacaaggattcctaaatcccttggaattttctgcatgataggagcgtcctttgttctcatgaggtgactcttggtgggctccttatttggggactggtcaccaaaaatacctaactatggttggaagcttagtgctttcagccccattccccatcctctggggtggggagcagagctggagctcgatcatgcctgcgtgacaaagcctccagaaaaatccttgaaagacaggacatggagagctgctgggttggcgaacacatccatgtgccgggaggatggtgcaccccaactccacaaggacccttccagacctcaccctgtgtatctcttcatctggctgttcatttgtatcctttaaaatatcctttgtaataaatcagcaatagtaagtaaacta

SEQ ID NO: 5193 - DNA, 5837 bp, Homo sapiens
gctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaaggcttcgtggactcgaccagagaagcaagagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttcttttacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcagtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcacctggcccgggacagctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttcaataaaaattgaaagaaaaaagcta

SEQ ID NO: 5194 - DNA, 4698 bp, Homo sapiens
cgggccagcgcaaggatctccgagttgcgagtgtgctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttaggaacttgaacacaaaaattaaatttgcttaaaagcccagttcctatgaaaaagatcagtgccccctttggaagaacctggcaggaccaccatggccacagctgctgagcaaccattctgtgtggaagagaaggttttgtgattggaaaaagctttacctccagacatgtcaccactcacagatacttttgtgccacttcataaggagtttgccccctttttaatggcagtaaaaagaatttgagagctctttctttaaatgctatttttaaaaaccatcatgctagatttacagagaagtttctgcatatctgctacttgttgcattttgggttcaaacctaaatatgatgtagcagaggaagaattctaagtaccttctaaagcttgtgtcagattgttaaaatcaccacacattcccctcattctaactctgtgctccttgtcctcccttcaataataattggctttgcttgcaattaagcatttaagtgcccatgttaaaagagccagaccgcactgattcacatgagcgttttgctgacatgatgggcaactgaagtcacccctgttgcccatgcactggaaaaaaagttgaatttgttggatattttctggggctgatgaacgttctgggatgtgctttcagtcctcgtattacggccagcaccttacactgtctctgtgaacggggccaagccatgatgtgccaacaagtgtcagctttgaaaggtgtttgtctcccaatcggggtgactcccctgctgcctggcagcatgtcgcagatcagcacagagtggggccgtggttcagcagtgacccacagaatggctttgagcatcagtctacaggacaggttggaagcatccactgtgaaccaggcattagtcccctacctggcctgtgtgtgctcagtagagaaggagagggacaggccactcccagactgcccagcccaggagggttaataaattggggccgagccaacctgtcagtgcttcctgaatgccccagcctctgtattggtgcgttggttcagtgacattttctaaactctcctgaaaatccagctgctcctccctgctgcttgggagttcacccaggagaggaaatgggtgtgttttgttaaggtcccttgtggagactcagggctgaatcctgcttggtaatatcagtgtgtgtgcttggggatggaccttctactgaataaaaactccctccctccccccattgtggtcacatatcattctacatatctcatctctgagcatctccatggaagcttgatttttgttctttttggtttctttatgtatttttttctgttgttattattttttaatgttcaaagactagcctttccctttgggattccaaatgatcccatgctgtggtctgaggggcaaagccacctatgttggcgctcgccattaatccccagcgctcagtttagaggctcacgtgcagacatcagaggctccatgctgcacagtagctcaggcagggtagtgcctctcaacccagccacaaaactctccccgctggagtcccagatggcgcttcacaccagggcagtggaggcaggcatggtttttgggcacagggcagagcataaggatcccaggtcagtgtgggagagctactggctcttaggatcaccttgggcagaagtcacacggcttcatcctaggagggcccagcttgggagtctgcctccccctgatcccaggaccacccacaggagaggggcagtgtccatctttctgaagggaccctttggagatctcgtcctaagtgtggagaggactgacgtggccctgtcatctcaacacatcccagggtcaggcaggcctcagctgaaacaatgtcagggtcctcaagggtcccatttagacagacccacggcttgtaacagtgcgctcctcaggaggcagcactagcgcatacccactccccacggacactgagttcctggtgacagctgcagccccagccccgccaggagtcctggagacagcagccctcagagaccctgcaggagtgagtgcaccccaccttgctcagccacaccccactcccctgtgccctgtagttgtgctgcccatgctccacacaccatggggcccctttgctcatttttggactatttatacagcaggtttggatcatgtttttctactaataagaatgctaacattgttgtgtagataatcagtgagggctttatgaagtttacacctttgcattattaaaggaaataacagttcatgtgaa

SEQ ID NO: 5195 - DNA, 2787 bp, Homo sapiens
caaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccatagccctcctccaccggcatctgctagctcgtctacccctgttccattgtctccaccagatacaacttggcctcttcctgcccttgcaaccacagaaccagctaaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttaggaacttgaacacaaaaattaaatttgcttaaaagcccagttcctatgaaaaagatcagtgccccctttggaagaacctggcaggaccaccatggccacagctgctgagcaaccattctgtgtggaagagaaggttttgtgattggaaaaagctttacctccagacatgtcaccactcacagatacttttgtgccacttcataaggagtttgccccctttttaatggcagtaaaaagaatttgagagctctttctttaaatgctatttttaaaaaccatcatgctagatttacagagaagtttctgcatatctgctacttgttgcattttgggttcaaacctaaatatgatgtagcagaggaagaattc

SEQ ID NO: 5196 - DNA, 6424 bp, Homo sapiens
gccccagctgccgcccgccggctcgcccgtgcagctgcgatgccccggagcgtcgaccccggtcctggtccctggcccgccgcgtaattagcctccgcgcgcccagagcgcgccgccgccaacgccgcgcccgacgcagcgatgggcaacacggtgcaccggaccctgccagacccgagcccaccggcgcgcctcctggccacccggccgtgctgcggccccggccccgagcgacgcccggtcctgggcgaggcgccgcgcttccacgcgcaggccaaaggcaagaacgtgcggctggacggccactcgcgccgggccacacggcgcaacagcttctgcaatggcgtcacgttcacgcagcggcccatccggctgtacgagcaggtgcggctgcgcctggtggccgtgcgccctggctggagcggcgcgctgcgcttcggcttcaccgcgcacgatccgtcgctcatgagcgcccaggacatccccaagtacgcctgcccggacctggtcacgcggccgggctactgggccaaggcactgcccgagaacctggcgctgcgcgacacggtgctggcctactgggccgaccgccacggccgcgtgttctacagcgtgaacgacggcgagccggtgctcttccactgcggcgtggccgtgggcggcccgctctgggcgctcattgatgtctacggcatcaccgacgaggtgcagcttctggagagcgccttcgctgacacgctgacgcccgcgcgcctcagccaggcccgcttcagcgcctgcctgccgcccagcagccacgacgcggccaacttcgacaacaacgagctcgagaacaaccaggtggtggccaagctgggccacctggcgctgggccgcgccccgggcccaccgccagccgacgccgcggccgccgccattccgtgcgggccccgtgagcgcccgcggcccgcgtcgtcgccggcgctactggaggccgacctgcgcttccacgcaacacgcgggcccgacgtgagcctgtcggccgaccgcaaagtggcctgcgcaccgcggcccgacggcggccgcacgctggtcttctccgagcgcccgctgcggcccggcgagagcctcttcgtggaggtgggccgtccggggctggcggcgcccggcgcgctggccttcggcatcacgtcgtgcgacccgggcgtgctacggcccaacgagctgcccgccgacccagacgcgctgctcgaccgcaaagagtactgggtggtggcgcgcgccgggcccgtgccgagcggcggcgacgcgctcagcttcacgctgcggcccggcggcgacgtgctcctgggcatcaacgggcgtccgcgcggccgcctgctgtgcgtcgacaccacgcaggcgctctgggccttcttcgccgtgcgcggcggcgtcgcgggccagctgcgtctcctcggtaccctgcagtccagccctgcgaccacgactccatcagggtccctcagcggctcccaggacgatagtgattcagatatgaccttcagtgtcaaccagtcctcctcggcatctgagtcatccctggtgacggcccccagctccccgctgagccccccggtgtcccccgtgttctccccaccggagccggcaggcatcaagaatggcgagtgcacggtgtgcttcgatggcgaggtggacacggtcatctacacgtgtggacacatgtgcctgtgccacagctgcggcctgcggctcaagcgacaggcccgggcctgctgccccatctgccggcggcccatcaaggacgtcattaagatctacaggccatagcctagcctgcccacgggccttggccggtgcaaggtcacctttctgaaggccccctgggctgggcaaccacatggctgccagggagtccacgggcagcggccatctctccagtggtgggcaaggtgtgacagtcgtggagcgaggcccacagggcctcagcccaggcaggggttgcttctggctccaaagtgctttgcccccaaaaggccgtcccaagagcaagctcaggaactgcctggcagatcaccctgtcccttggtgacctttcaactgggaaacagcgtcctctgtctgtgcaatgcttcttgctggggttgggttgagtgtgagagaaggggaggggagggagggagaacagagagaatgtgtgtgtgagagagagagagagagaatgaacgtgtagcgattttaccaggggtcccggctccgggaggagacgtgcaatccggagccccgacattggcatgactagaagttgttcactttctggggatgggacataagctggttttgaatgtatgaagctgaccctcacagaactccctggggtggtgtagaaaagagatgctcagattttctaaggggaggcaaaaataactcattgtttacagctccaaagcatgaactccttgaggggaaggtgggtgaagaacaattcacttcttcatttcttactgggtcttagagctgggtgtgatgggcaccgaggccaacccctctggattgtgtcatcttttcaccccttcacccccagactgtctaataatacacacatcataccttgtctccgtctctggaggcaagtctctgtaatgcccttccctatctccaaggagaagaccagcagtaagttctgtttttctgtgggagagaaagaatcctagaggcaggtgacccacctggagctggaaagcccactccacgatgcagacagctctctaccttcctgtggtggcccctgggcctggcattcccaggggacctgctggcaggaggaggaacgagggctttataactttggttataacttttggtctttgttctgattctcagtgtatcttcctccgctggttactaaagtgttcactgataagtatgttaactaatgatcgagacagtaacgaaaaatgctggcactgggattctctcccttcccagacctacctgctggtatttcctgggaccttgaccctgccccaccccctcagccgtgcccatctctgcagactcccagatcacatctgggctgatgggctggcccaggcctgtccctcccttcttgcccccagttctgggctccacctctgccctcttctgtgctgtcccattagggaagtcccttggcctgtctatttttcagttcccaattagaagtctagaacctgacaactccaggagttcttgggaggaccagtacaacgttctaaaaagcctgagacgccttacaaaaagcaagtatcatttggagtacaattcctaatctgttcatgtcctgctgaaggagggaaggagggagaggaaggcaggggagttgatgcattcatataacaaacactgctgggtgtctgggtgcccagagcaaagctgggccaggccttcaccagatcaagccccacagaccagctggtgcccatgcgctgctggtggtttggggcctcctgttcctcctctagctgggagtaatcacagttgtctgacctgattccaacttaaggtccccactctcttgccccatcaagaatccctgattatttacttttccctagaaaatctggggaaattcccacattttaattttgcagcagaatcttttgagcagcttttggaaccacagtgtttgccaagataagagtttgagaatccagcagccctgggtgcctggctgaatttggtttcctgcatgtgctgggtgtgggcggggccacgcacaggccctgcatgggaggactcctcaccccaggcctgtggtgctgcagacaaccgtctcctgtctacactgcgacccagccacaagctgtggggtctcagtggcctgggggaaagcagctccactctcctgcccttcctggctgcccctttgggttccagccggggtcacgtccagcctccactgggaaaccagtgactgaggcctggacccagaggtggaccaggcatctcctggccacctgtgacctgggaagaagcgagtcagtggcccgttcaacctgctctgcagctgctataaatagcctccctgtttccaagaggaggtaaggaagtgtttatcttctaaaaaccagacgtttcctgatgctctgagcgttactcagtgctacagaggagatgcacacgtccccactatgttctgtcttgagaaggggacaagagaaagaggaaaaggagccactgtactttattttgcacctacagcgtgccttggcactgggctagagaggcaccttcctgcgtgaatcctgtgcggcaggtcttattgccataataagtcacatcaaagacactgctggtcataaaacactgttttacataccatagggaaaaacgctgccaatcttaactaagatgctacaactgtacagttccttccaatcagagatgttcacgtgtgaaaaaaaaactgtgctacttacaatctatgaaagctggtgttatcccacttggcaggtaaggaaactgaggtcctgtgagtgaagtgacctcatgatcacacaacaggagatggcagggctgggattcaaacccgggagtgtctgctgccacatcccacactcccactgcctggctccaagtcccaggaagctcgagactgtgagttttctcccttgaaactcacctggagagagtccgggcacctgtgcctatgtggagggttccagccccagccaggcccctccgctgcccacaccctgggaggagaagcggcctcccttccaggctcatctgctcactgcccgcattctcctggcagagctgaggtctgagagatctggactccaacccaagggccctctcttgttattcaggggtgtccacagttaggaagggacctggggccttgtcccaccaccttcctaggccccgtgatcaccaccccctcaagcggggccccagccccctgagcaccccctcacgtgacccagccctcggctgttccaggctcactgcccatggtgtgctcttctgggccacagcagccagggctccagggcgaggacaggggacacctgaaaacaccccgttgttcatggtcttgtgcccattcattcggagactcctgaaaaactgggctgtttgcaaagcaaatccagctccttgtcctagcaggttctcagaacggggagtcccctgggatggagctgctcccctcacggcagcaccacgtttccagtccctcgatgccactaatcagcatggactgtgttcaggacacagggtgaacttttctctgacccccggtgctggtcctgtgccagcacgtagtagttactcagtagaggtttgctgagtaaaccagaaatcagattatgagtgttcaggggtttgataaaacagcaccacataacgcacacaaagatactccagaaacatttgctgagtacctagtacgtgtgaggtgctgtgaggatagagcagagaggactgtgccccagctgtgatgctggcagaggtgacactaagagggaaatgagatatttggggcagaatccactgggctctcttggccatccgctgccttgggtctgttgaggtgggtgcccaaaggctgccttcttgaccagaacctgctgtgcgcttcacagaacctcctcttcattggaaatgctgggcacattgcagtcagtgagctgctgccaaaacggcgttaagtagaacccccagaggccccgccggttggtgatcaccctcaggtcctgccagggagacacagtgaggaggttggctaattgctgctttcaggccctggaaatcagtcgccaaggcccaggagaaccccggtgagtccgtccagttgaggcagaggcaataacctcccattgctcggccctgcgcctgccccagtcctggcagggggcaccggctcaggaacatgcggcctcctggcatttctcggtatttaactgtctcgctgtcttatccgagtccctaatgaaacgacttgtgtgacaatctgtctgtgccttacgaaagtgtctgtgcactttttatcctttttaaaagcaacttttaaaagtggatggggaggggggctagcatacgtggtagggttctagaaatctgtggtcatcgctgaaatcctttttgcatcatgttttttgatgttggagtgatgaagtgtacatcccccaccccacacaccactacctgtgtacagaccttttaaaacatgtcttctttttctgattcaatactgtgacctctccgatacagtctaatccttggggatctgtaatcaaggttttaaaacctgggaagtgggttgggaagggtttgcactggtcttgagtgttgtgcttttctgtgttgtgtgttttgatttttgtctttttatctgttttatattgacataattttcctgtttaaaaaaatacaactttggcttgttaaaaaaaaaaaa

SEQ ID NO: 5197 - DNA, 5174 bp, Homo sapiens
atggcggcagggtcgggtgggagtgggggctctgggggaggccctggaccggggccgggcgggggtgggggccccagcgggagcggctcaggaccggggtccaacgggggtctgggcagcggcggggaactgcacccgcgcactgggcgcttggtgagcctgtcggcctgtgggcgtacggcgcggcggcagcagccgggccaggagtttaaccacgggctggtgttgagccgagaacccttgcgcgatggacgcgtcttcaccgtccgcatcgaccgcaaggtcaactcctggagcggctccattgagattggggtgacagcgctggaccccagtgtgctggactttccaagcagtgccacgggcctgaaggggggctcgtgggtagtgtcgggctgctctgtgctgagagatggacgctctgtgttggaggagtatggtcaggacctggaccagcttggtgaaggggaccgcgtgggcgtggagcgcacagttgctggggagcttcggctctgggtgaatgggcgggattgcggtgtggctgccacaggcctgccccctcgtgtctgggccgtcgtggacctttatggcaagtgcacccagatcaccgtgctaccccctgagccaggcttcagcccccctactcccatccccacacctcccctcgagcccttggcccccactgaagactctgccttggctgaacaggggacctctgcagatgaagccttcatggtgtccccagcgcaggcccggccggagacgtttcctaacagccttgagtcgcataatgactttgccaacatggagctgtctgaggtggtgagcaacaccatcctgtctgcctacaatggagggctcctgaatgtgaacctgagctccccaccggcaggggaaggcctgggatctagcggtgctgccacctcgcccattctcacttccaacgatgccctgctctttcatgaaaagtgcgggaccctcatcaaactcagcaacaataataagacggctgagcgccggcggcccctggatgaattcaacaatggggttgtcatgaccaatcgcccccttcgggacaatgagatgtttgagatccgtatcgacaagcttgttgataagtggtcaggctccattgagattggggtcaccacccacaaccccaacagtttggagtacccagccaccatgaccaacctccagtcaggcaccatcatgatgagcggctgtggaatcctgaccaatggcaagggcacccgccgggagtactgcgaattcagtctggatgagttgcaggagggtgaccacattggcctcacaaggaagtccaactctgccctacacttcttcattaatggtatcgatcagggagtggcaacccccttgacgcccccagtggtgtatggtgtggtggacttgtacgggatggcagtgaaggtgaccatcgtccacaataacaaccacagtgaccgtctccgccgaaacaacgccatcctgcgggcgctgtcccccgagggtgctctccgccgtgctgcccctgccgcccaggcagaacctgagcgcctgctcttccaccccaactgtgggcagaaggcagccatcacccacgagggacgcactgccctgaggccccatgccaccgatgacttcaatcacggcgtggtgctgagcagcagagccctgcgggatggagaggtgttccaggtgcgcatcgacaagatggtggacaaatgggctggctccattgaaattggtgtcaccacccacaaccctgcctacctccagttgccctccaccatgaccaacttgcgctctgggacctggatgatgactgggaatggggtgatgcacaatgggacgaccatcctggatgaatacgggcacaatctggaccgcctcaaggcaggggacacggtgggcgtggtacggcgggaggacgggactctccacttctttgtcaatgggatgactcagggccctgctgcctggaacgtgcccccgggcgtctatgctgtcgtcgatctctatggccaggcggcccaggccaccattgtggacgacgtggaggtggctccagttcctgaaccactccctgaggggaacaaccaggtgtctccaagctctccgtcctcaggggccgggggctctgacctgcgcttccatcagctgcacggcagtaacgcagtcatcactaacgggggccgcaccgccctccgccacaactgtcgcagcgagtttaatgacgccatcgtcatctccaaccgggccctgcgggatggagagctgtttgaaattgtcattcagaagatggtggaccgctggtcaggctccattgaggctggagtgactgctattcggcctgaagacctggaattccccaacaccatgacagacattgactatgacacatggatgctgagtggtacagccatcatgcaagacggtaacacgatgcgcaacaattatgggtgtgacctggatgcgctgggcacaggtgcacgcattggcatgatgcgaactgccaagggcgacctgcactacttcatcaacggccaggaccaaggcgctgcctgctcgggcctgcctccggaggtgtatgcggtagtcgatctctatggccagtgtgtccaagtgtccatcaccaatgccaccggccccatggacaacagcctggcgaccagcaacactgccaccgagaagtccttcccactgcactccccagtggctggcgtggctcaccgattccacagtacttgcggcaagaacgtcactctagaggaggatggcacgagggcagtgcgtgccgctggctatgctcatggccttgtcttcagtaccaaggagctgagggctgaggaagtctttgaggtgaaagtggaagagctagatgagaagtgggcaggttccctgcggctggggctgaccacactagcaccgggggagatgggacccggggcaggcggtggtggcccagggctgcctccttccctgccagagctccggacgaagaccacttggatggtatccagctgtgaagtgaggcgtgatgggcagctccagaggatgaactatggccggaacctagagaggctgggggtggggagccgtgtgggtgttcgtcggggggcagatgacacgatgcacatcctggtggatggagaggatatggggcctgcagccactggcattgccaagaacgtgtgggctgtgttggatctctacgggccagtccgcggtgtgtcaattgtcagttccacgagactggaggagtcagaaggcacccagcctccttcccccagttcagacaccggcagtgagggcgaggaggatgacgagggcgaggagcatggcctgggaggccagaatgaagtgggtattatacccaccaccctcgagttcctggagaaccatgggaagaatatccttttgtctaatgggaaccgtacggccacacgggtggccagctacaatcagggcatcgttgtcatcaaccaacctctggtgccccagctgctggtgcaggtgcggatagatttcctaaaccgacagtggacatcttcccttgtcctgggagtcatcacctgcgcgcctgagaggctcaacttccctgcttctgcctgtgccctcaaacgggcagcctggctgctgcggggccgtggggtcttccacaacggtctcaagatctgcgagaagtttgggcccaatctggacacgtgccctgaaggcaccatcctgggactgcggctggacagctctggggggctgcatcttcatgttaatggggtggaccagggggtagctgtgccagatgtgccccagccctgccatgcgcttgtggacctctatgggcagtgtgagcaggtgacaatcgtgaaccctgagccaggggctgccagtgggaaaagtgctggaacccaaggggacatggagaaagcagacatggtggacggtatcaaagagagtgtgtgctggggtccaccacctgccgctagtcctctaaagagctgcgagtaccatgccctttgctctcgcttccaagaactcctgctgcttcccgaagattatttcatgcctccgccaaagcgaagcctgtgctactgtgagtcttgccggaagctgcgaggagacgaggcccacaggcgcagaggggagcctccccgggaatatgcactgccctttggctggtgcaggttcaacctcagagtgaatccccgcctggaggctgggacactaaccaagaagtggcacatggcatatcacgggagcaatgttgccgctgtacggagagtgctggaccgaggggagctgggagcaggtactgcctccatcctgagctgccgtcctttgaagggagaacctggggtagggttcgaggagcctggcgagaactgtgcacctcctcgggaggagcagccccctcctgtgctgctttccccctcccttcaatatgctggggcggagaccctggcctccaaagtgcaattccgggaccccaaatcccagcggacgcaccaggctcaggtggcgttccaggtgtgtgtgcgccctggctcctacaccccgggacccccttccgctgcccttggagaacctcctgaccctcacttcagtccagccgaacttgagtgggtcactaaggagaagggggccacactcctctgtgccctgctggtacgggtggaatgaggggtgagacaccactactacaagcacagtcgggccgcgggcccatggactctgagtggcgactgcctccacctcattcccgtgactcgtggcatgcgcaggtgctggagcttggcagccgcgcaggagcatgtaggcaggctctcagatgtaggtggcaagtggcacagctccatgtccggaggcccagcactccgtctgatgggaggagtcgtgggagcccagctccaggccctggtacccctcttcatgcactgatttggggaacatgactcccttttactcccctaccccacatcacttaatttatttccgtttttgtttctggttactgtgaatcccagaggagtctctccctgtgcccacatgaagctgctttttccggggccaccgggcgggagtggggaagggtgggcgcacggaagatgggggcctctgtacagttgttactgactctgatttctaaggagccaataaacaccgtctcagag

SEQ ID NO: 5198 - DNA, 5185 bp, Homo sapiens
agcggagatggcggcagggtcgggtgggagtgggggctctgggggaggccctggaccggggccgggcgggggtgggggccccagcgggagcggctcaggaccggggtccaacgggggtctgggcagcggcggggaactgcacccgcgcactgggcgcttggtgagcctgtcggcctgtgggcgtacggcgcggcggcagcagccgggccaggagtttaaccacgggctggtgttgagccgagaacccttgcgcgatggacgcgtcttcaccgtccgcatcgaccgcaaggtcaactcctggagcggctccattgagattggggtgacagcgctggaccccagtgtgctggactttccaagcagtgccacgggcctgaaggggggctcgtgggtagtgtcgggctgctctgtgctgagagatggacgctctgtgttggaggagtatggtcaggacctggaccagcttggtgaaggggaccgcgtgggcgtggagcgcacagttgctggggagcttcggctctgggtgaatgggcgggattgcggtgtggctgccacaggcctgccccctcgtgtctgggccgtcgtggacctttatggcaagtgcacccagatcaccgtgctaccccctgagccaggcttcagcccccctactcccatccccacacctcccctcgagcccttggcccccactgaagactctgccttggctgaacaggggacctctgcagatgaagccttcatggtgtccccagcgcaggcccggccggagacgtttcctaacagccttgagtcgcataatgactttgccaacatggagctgtctgaggtggtgagcaacaccatcctgtctgcctacaatggagggctcctgaatgtgaacctgagctccccaccggcaggggaaggcctgggatctagcggtgctgccacctcgcccattctcacttccaacgatgccctgctctttcatgaaaagtgcgggaccctcatcaaactcagcaacaataataagacggctgagcgccggcggcccctggatgaattcaacaatggggttgtcatgaccaatcgcccccttcgggacaatgagatgtttgagatccgtatcgacaagcttgttgataagtggtcaggctccattgagattggggtcaccacccacaaccccaacagtttggagtacccagccaccatgaccaacctccagtcaggcaccatcatgatgagcggctgtggaatcctgaccaatggcaagggcacccgccgggagtactgcgaattcagtctggatgagttgcaggagggtgaccacattggcctcacaaggaagtccaactctgccctacacttcttcattaatggtatcgatcagggagtggcaacccccttgacgcccccagtggtgtatggtgtggtggacttgtacgggatggcagtgaaggtgaccatcgtccacaataacaaccacagtgaccgtctccgccgaaacaacgccatcctgcgggcgctgtcccccgagggtgctctccgccgtgctgcccctgccgcccaggcagaacctgagcgcctgctcttccaccccaactgtgggcagaaggcagccatcacccacgagggacgcactgccctgaggccccatgccaccgatgacttcaatcacggcgtggtgctgagcagcagagccctgcgggatggagaggtgttccaggtgcgcatcgacaagatggtggacaaatgggctggctccattgaaattggtgtcaccacccacaaccctgcctacctccagttgccctccaccatgaccaacttgcgctctgggacctggatgatgactgggaatggggtgatgcacaatgggacgaccatcctggatgaatacgggcacaatctggaccgcctcaaggcaggggacacggtgggcgtggtacggcgggaggacgggactctccacttctttgtcaatgggatgactcagggccctgctgcctggaacgtgcccccgggcgtctatgctgtcgtcgatctctatggccaggcggcccaggccaccattgtggacgacgtggaggtggctccagttcctgaaccactccctgaggggaacaaccaggtgtctccaagctctccgtcctcaggggccgggggctctgacctgcgcttccatcagctgcacggcagtaacgcagtcatcactaacgggggccgcaccgccctccgccacaactgtcgcagcgagtttaatgacgccatcgtcatctccaaccgggccctgcgggatggagagctgtttgaaattgtcattcagaagatggtggaccgctggtcaggctccattgaggctggagtgactgctattcggcctgaagacctggaattccccaacaccatgacagacattgactatgacacatggatgctgagtggtacagccatcatgcaagacggtaacacgatgcgcaacaattatgggtgtgacctggatgcgctgggcacaggtgcacgcattggcatgatgcgaactgccaagggcgacctgcactacttcatcaacggccaggaccaaggcgctgcctgctcgggcctgcctccgggtaaagaggtgtatgcggtagtcgatctctatggccagtgtgtccaagtgtccatcaccaatgccaccggccccatggacaacagcctggcgaccagcaacactgccaccgagaagtccttcccactgcactccccagtggctggcgtggctcaccgattccacagtacttgcggcaagaacgtcactctagaggaggatggcacgagggcagtgcgtgccgctggctatgctcatggccttgtcttcagtaccaaggagctgagggctgaggaagtctttgaggtgaaagtggaagagctagatgagaagtgggcaggttccctgcggctggggctgaccacactagcaccgggggagatgggacccggggcaggcggtggtggcccagggctgcctccttccctgccagagctccggacgaagaccacttggatggtatccagctgtgaagtgaggcgtgatgggcagctccagaggatgaactatggccggaacctagagaggctgggggtggggagccgtgtgggtgttcgtcggggggcagatgacacgatgcacatcctggtggatggagaggatatggggcctgcagccactggcattgccaagaacgtgtgggctgtgttggatctctacgggccagtccgcggtgtgtcaattgtcagttccacgagactggaggagtcagaaggcacccagcctccttcccccagttcagacaccggcagtgagggcgaggaggatgacgagggcgaggagcatggcctgggaggccagaatgaagtgggtattatacccaccaccctcgagttcctggagaaccatgggaagaatatccttttgtctaatgggaaccgtacggccacacgggtggccagctacaatcagggcatcgttgtcatcaaccaacctctggtgccccagctgctggtgcaggtgcggatagatttcctaaaccgacagtggacatcttcccttgtcctgggagtcatcacctgcgcgcctgagaggctcaacttccctgcttctgcctgtgccctcaaacgggcagcctggctgctgcggggccgtggggtcttccacaacggtctcaagatctgcgagaagtttgggcccaatctggacacgtgccctgaaggcaccatcctgggactgcggctggacagctctggggggctgcatcttcatgttaatggggtggaccagggggtagctgtgccagatgtgccccagccctgccatgcgcttgtggacctctatgggcagtgtgagcaggtgacaatcgtgaaccctgagccaggggctgccagtgggaaaagtgctggaacccaaggggacatggagaaagcagacatggtggacggtatcaaagagagtgtgtgctggggtccaccacctgccgctagtcctctaaagagctgcgagtaccatgccctttgctctcgcttccaagaactcctgctgcttcccgaagattatttcatgcctccgccaaagcgaagcctgtgctactgtgagtcttgccggaagctgcgaggagacgaggcccacaggcgcagaggggagcctccccgggaatatgcactgccctttggctggtgcaggttcaacctcagagtgaatccccgcctggaggctgggacactaaccaagaagtggcacatggcatatcacgggagcaatgttgccgctgtacggagagtgctggaccgaggggagctgggagcaggtactgcctccatcctgagctgccgtcctttgaagggagaacctggggtagggttcgaggagcctggcgagaactgtgcacctcctcgggaggagcagccccctcctgtgctgctttccccctcccttcaatatgctggggcggagaccctggcctccaaagtgcaattccgggaccccaaatcccagcggacgcaccaggctcaggtggcgttccaggtgtgtgtgcgccctggctcctacaccccgggacccccttccgctgcccttggagaacctcctgaccctcacttcagtccagccgaacttgagtgggtcactaaggagaagggggccacactcctctgtgccctgctggtacgggtggaatgaggggtgagacaccactactacaagcacagtcgggccgcgggcccatggactctgagtggcgactgcctccacctcattcccgtgactcgtggcatgcgcaggtgctggagcttggcagccgcgcaggagcatgtaggcaggctctcagatgtaggtggcaagtggcacagctccatgtccggaggcccagcactccgtctgatgggaggagtcgtgggagcccagctccaggccctggtacccctcttcatgcactgatttggggaacatgactcccttttactcccctaccccacatcacttaatttatttccgtttttgtttctggttactgtgaatcccagaggagtctctccctgtgcccacatgaagctgctttttccggggccaccgggcgggagtggggaagggtgggcgcacggaagatgggggcctctgtacagttgttactgactctgatttctaaggagccaataaacaccgtctcag

SEQ ID NO: 5199 - DNA, 5467 bp, Homo sapiens
atcagcgaattgcagggtcaagggctggtgctttgaaagagaggcggaggggagagagggattttcccgtccccgctgcgctctgtcctccattactccttttctcggcccgcggcccgaacccgctgtgcggtagaggcagccgggtccctttaaggcccagctgcgcctgtgccttgggctctcctgacacggcccatccggaccctgaggagccagcgggccgcaagcaagttgctgggcggcggtggagatagcggcggtgctgggaggggtaggtgagggtcgcgaggctgcctgagcttctgagtgagcctggtgattttgggaacgcgggacgggcgacctgcggcgccaggagcggggccgaggtacggcggcacggctgcagcctggatgggaagttcaagtttactgcgaagtccacccagcgttccggaggtgagggcgccgcgccaggccgggcgggaggcattctgaaggcaaatcctgtttagacccaggcaaaggttcctggtgacccaggctctcatgagcagattgtcccttatcattctcctgaggatgtctggagcttcagtgctgtgtgctcttggcctccacactgggggtgccaccaactcccactgtccagggcttctggtggactctccgaggcaccgatgtagaaacttacccattcagtgcaccaagagcagcttcacatggtgtgggccgacatgaagagctgccagatccaacagaaatgtgattgataacagtaaagccacactcctcaagtgcctgaaatacccctcattgtcttcttcaggtggcaagggctctggaacagccacataaagcccttgaagataaggatggtcaaacaaaataatatcatacctggagaaactcagatcttgctaagatttactggttgggaatccaaagttaatgccaagaagcagctgccagttgggatcaaatgtgagcctatggatcaagtccctgactccacctcttctgccacaaacgtcagcatggtggtatcagccggcccttggtccagcgagaaggcagagatgaacattctagaaatcaacgagaaattgcgcccccagttggcagagaacaaacagcagttcagaaacctcaaagagagatgttttctaactcaactggccggcttcctggccaaccgacagaagaaatacaagtatgaagagtgtaaagacctcataaaatttatgctgaggaatgagcgacagttcaaggaggagaagcttgcagagcagctcaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaaggctgaagagagcaaagtccctgaggactcactggaggaatgtgccatcacttgttcaaatagccacggcccttgtgactccatccagcctcacaagaacatcaaaatcacatttgaggaagacaaagtcaactcatctctggttgtagacagagaatcctctcatgatggatgtcaggatgctctaaacattctcccagtccctggccccacctcttctgccacaaacgtcagcatggtggtatcagccggccctttgtccagcgagaaggcagagatgaacattctagaaatcaatgagaaattgtgcccccagctggcagagaagaaacagcagttcagaagcctcaaagagaaatgttttgtaactcaagtggcctgcttcctggccaagcagcagaacaaatacaaatatgaagagtgcaaagacctcataaaatctatgctgaggaatgagcgacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacatagaaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcagtttatcttggactgactgactcatgccagccctacagaagtgccttttacgtattggagcaacagcgtattggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccgtgccccaggctcagcagggagctgctggaggtagtagagcctgaagtcttgcaggactcactggatgttattcaactccttccagttgtcttgaacagcctgactcctgccagccctacggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagcgtgctgatggaagtggaagtgcctgaagtcttacaggactcactggatagatattattcgactccatcaatgtactttgaactacctgactcattccagcactacagaagtgtgttttactcatttgaggaacagcacatcagctttgcccttgacatggacaataggttttttactttgacggtgagaagtctccacctggtcttccagatgggagtcatattcccacaataagcagcccttactaagccgagaggtgtcattcctgcaggcaggacctataggcacctgaagatttgaatgaaactatagttccatttggaagcccagacataggatgggtcagtgggcatggctctattcctattctcagagcatgccagtggcaacctgtgctcagtctgaagacaatggacccacgttaggtgtgacacgttcacataactgtgcagcacatgccgggagtgatcagtcggacattttaatttgaaccacgtatctctgggtagctacaaaattcctcagggatttcattttgcaggcatgtctctgagcttctatacctgctcaaggtcagtgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttgaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcataattaaattcagcctaaactttttgacgggaacactgcagagacaatgctgtgagtttccaacctcagcccatctgcgggcagagaaggtctagtttgtccaacaccattatgatatcaggactggttacttggttaaggaggggtctaggagatctgtcccttttagagacaccttacttataatgaagtacttgggaaagtggttttcaagagtataaatatcctgtattctaatgatcatcctctaaacattttatcatttattaatcctccctgcctgtgtctattattatattcatatctctacgctgcaaattttgggtctcaatttttactgtgcctttgtttttactagtgtctgctgttgcaaaaagaagaaaacattctttgcctgagttttaatttttgtccaaagttaattttaatctatacaattaaaaccttttgcctatcactctggacttttggattgttttttacattcagtgttataatatttgattatgctgattggttttggtgggtactgatgcgaattaataaaaacatttcatttcca

SEQ ID NO: 5200 - DNA, 3409 bp, Homo sapiens
attgataacagtaaagccacactcctcaagtgcctgaaatacccctcattgtcttcttcaggtggcaagggctctggaacagccacataaagcccttgaagataaggatggtcaaacaaaataatatcatacctggagaaactcagatcttgctaagatttactggttgggaatccaaagttaatgccaagaagcagctgccagttgggatcaaatgtgagcctatggatcaaggaatgtctggacacagtagacaaaggtttttcaacaggatgccttaggatacatgcttccaaaaacaaagtagccaaaaagaaaccagagtcacagaatatcagagccagaggaacatttggagacggttacctggcacgctggccacaatctacctcactcttatcagagtctgagcagtgctttcagctctgagttgaggcacctcgaaccttgtttttgtggtgaaggatcctaaagtgctgtggggagtgatcacatttttcacaacatccctgactccacctcttctgccacaaacgtcagcatggtggtatcagccggcccttggtccagcgagaaggcagagatgaacattctagaaatcaacgagaaattgcgcccccagttggcagagaacaaacagcagttcagaaacctcaaagagagatgttttctaactcaactggccggcttcctggccaaccgacacaagaaatacagcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaaggctgaagagagcaaagtccctgaggactcactggaggaatgtgccatcacttgttcaaatagccacggcccttgtgactccatccagcctcacaagaacatcaaaatcacatttgaggaagacaaagtcaactcatctctggttgtagacagagaatcctctcatgatggatgtcaggatgctctaaacattctcccagtccctggccccacctcttctgccacaaacgtcagcatggtggtatcagccggccctttgtccagcgagaaggcagagatgaacattctagaaatcaatgagaaattgtgcccccagctggcagagaagaaacagcagttcagaagcctcaaagagaaatgttttgtaactcaagtggcctgcttcctggccaagcagcagaacaaatacaaatatgaagagtgcaaagacctcataaaatctatgctgaggaatgagcgacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacatagaaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcagtttatcttggactgactgactcatgccagccctacagaagtgccttttacgtattggagcaacagcgtattggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccgtgccccaggctcagcagggagctgctggaggtagtagagcctgaagtcttgcaggactcactggatgttattcaactccttccagttgtcttgaacagcctgactcctgccagccctacggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagcgtgctgatggaagtggaagtgcctgaagtcttacaggactcactggatagatattattcgactccatcaatgtactttgaactacctgactcattccagcactacagaagtgtgttttactcatttgaggaacagcacatcagctttgcccttgacatggacaataggttttttactttgacggtgagaagtctccacctggtcttccagatgggagtcatattcccacaataagcagcccttactaagccgagaggtgtcattcctgcaggcaggacctataggcacctgaagatttgaatgaaactatagttccatttggaagcccagacataggatgggtcagtgggcatggctctattcctattctcagagcatgc

SEQ ID NO: 5201 - DNA, 2618 bp, Homo sapiens
ttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcagtttatcttggactgactgactcatgccagccctacagaagtgccttttacgtattggagcaacagcgtattggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccgtgccccaggctcagcagggagctgctggaggtagtagagcctgaagtcttgcaggactcactgtgttattcaactccttccagttgtcttgaacagcctgactcctgccagccctacggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagcgtgctgatggaagtggaagtgcctgaagtcttacaggactcactggatagatattattcgactccatcaatgtactttgaactacctgactcattccagcactacagaagtgtgttttactcatttgaggaacagcacatcagctttgcccttgacatggacaataggttttttactttgacggtgagaagtctccacctggtcttccagatgggagtcatattcccacaataagcagcccttactaagccgagaggtgtcattcctgcaggcaggacctataggcacctgaagatttgaatgaaactatagttccatttggaagcccagacataggatgggtcagtgggcatggctctattcctattctcagagcatgccagtggcaacctgtgctcagtctgaagacaatggacccacgttaggtgtgacacgttcacataactgtgcagcacatgccgggagtgatcagtcggacattttaatttgaaccacgtatctctgggtagctacaaaattcctcagggatttcattttgcaggcatgtctctgagcttctatacctgctcaaggtcagtgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttgaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaactttttgacgggaacactgcagagacaatgctgtgagtttccaacctcagcccatctgcgggcagagaaggtctagtttgtccaacaccattatgatatcaggactggttacttggttaaggaggggtctaggagatctgtcccttttagagacaccttacttataatgaagtacttgggaaagtggttttcaagagtataaatatcctgtattctaatgatcatcctctaaacattttatcatttattaatcctccctgcctgtgtctattattatattcatatctctacgctgcaaattttgggtctcaatttttactgtgcctttgtttttactagtgtctgctgttgcaaaaagaagaaaacattctttgcctgagttttaatttttgtccaaagttaattttaatctatacaattaaaaccttttgcctatc

SEQ ID NO: 5202 - DNA, 5560 bp, Homo sapiens
ccggaagtcagactatggggcggtgcggcagcgcgaagcctgcagtcctaaacgcggggtagctccgggcttccgagggggtgtgtctcccgcctctttaacctggcaggggcggttcaagtggccggggaaatcagcgaattgcagggtcaagggctggtgctttgaaagagaggcggaggggagagagggattttcccgtccccgctgcgctctgtcctccattactccttttctcggcccgcggcccgaacccgctgtgcggtagaggcagccgggtccctttaaggcccagctgcgcctgtgccttgggctctcctgacacggcccatccggaccctgaggagccagcgggccgcaagcaagttgctgggcggcggtggagatagcggcggtgctgggaggggtaggtgagggtcgcgaggctgcctgagcttctgagtgagcctggtgattttgggaacgcgggacgggcgacctgcggcgccaggagcggggccgaggtacggcggcacggctgcagcctggatgggaagttcaagtttactgcgaagtccacccagcgttccggaggtgagggcgccgcgccaggccgggcgggaggcattctgaaggcaaatcctgtttagacccaggcaaaggttcctggtgacccaggctctcatgagcagattgtcccttatcattctcctgaggatgtctggagcttcagtgctgtgtgctcttggcctccacactgggggtgccaccaactcccactgtccagggcttctggtggactctccgaggcaccgatgtagaaacttacccattcagtgcaccaagagcagcttcacatggtgtgggccgacatgaagagctgccagatccaacagaaatgtgattgataacagtaaagccacactcctcaagtgcctgaaatacccctcattgtcttcttcaggtggcaagggctctggaacagccacataaagcccttgaagataaggatggtcaaacaaaataatatcatacctggagaaactcagatcttgctaagatttactggttgggaatccaaagttaatgccaagaagcagctgccagttgggatcaaatgtgagcctatggatcaagacggttacctggcacgctggccacaatctacctcactcttatcagagtctgagcagtgctttcagctctgagttgaggcacctcgaaccttgtttttgtggtgaaggatcctaaagtgctgtggggagtgatcacatttttcacaacatccctgactccacctcttctgccacaaacgtcagcatggtggtatcagccggcccttggtccagcgagaaggcagagatgaacattctagaaatcaacgagaaattgcgcccccagttggcagagaacaaacagcagttcagaaacctcaaagagagatgttttctaactcaactggccggcttcctggccaaccgacacaagaaatacaagtatgaagagtgtaaagacctcataaaatttatgctgaggaatgagcgacagttcaaggaggagaagcttgcagagcagctcaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaaggctgaagagagcaaagtccctgaggactcactggaggaatgtgccatcacttgttcaaatagccacggcccttgtgactccatccagcctcacaagaacatcaaaatcacatttgaggaagacaaagtcaactcatctctggttgtagacagagaatcctctcatgatggatgtcaggatgctctaaacattctcccagtccctggccccacctcttctgccacaaacgtcagcatggtggtatcagccggccctttgtccagcgagaaggcagagatgaacattctagaaatcaatgagaaattgtgcccccagctggcagagaagaaacagcagttcagaagcctcaaagagaaatgttttgtaactcaagtggcctgcttcctggccaagcagcagaacaaatacaaatatgaagagtgcaaagacctcataaaatctatgctgaggaatgagcgacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacatagaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggacatcggtgggatcaagtgaaaaaggaggaccaagaggcaacaggtcccaggctcagcagggagctgctggatgagaaagagcctgaagtcttgcaggactcactggatagatgttattcaactccttcagtttatcttggactgactgactcatgccagccctacagaagtgccttttacgtattggagcaacagcgtattggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccgtgccccaggctcagcagggagctgctggaggtagtagagcctgaagtcttgcaggactcactggatgttattcaactccttccagttgtcttgaacagcctgactcctgccagccctacggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagcgtgctgatggaagtggaagtgcctgaagtcttacaggactcactggatagatattattcgactccatcaatgtactttgaactacctgactcattccagcactacagaagtgtgttttactcatttgaggaacagcacatcagctttgcccttgacatggacaataggttttttactttgacggtgagaagtctccacctggtcttccagatgggagtcatattcccacaataagcagcccttactaagccgagaggtgtcattcctgcaggcaggacctataggcacctgaagatttgaatgaaactatagttccatttggaagcccagacataggatgggtcagtgggcatggctctattcctattctcagagcatgccagtggcaacctgtgctcagtctgaagacaatggacccacgttaggtgtgacacgttcacataactgtgcagcacatgccgggagtgatcagtcggacattttaatttgaaccacgtatctctgggtagctacaaaattcctcagggatttcattttgcaggcatgtctctgagcttctatacctgctcaaggtcagtgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttgaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaactttttgacgggaacactgcagagacaatgctgtgagtttccaacctcagcccatctgcgggcagagaaggtctagtttgtccaacaccattatgatatcaggactggttacttggttaaggaggggtctaggagatctgtcccttttagagacaccttacttataatgaagtacttgggaaagtggttttcaagagtataaatatcctgtattctaatgatcatcctctaaacattttatcatttattaatcctccctgcctgtgtctattattatattcatatctctacgctgcaaattttgggtctcaatttttactgtgcctttgtttttactagtgtctgctgttgcaaaaagaagaaaacattctttgcctgagttttaatttttgtccaaagttaattttaatctatacaattaaaaccttttgcctatc

SEQ ID NO: 5203 - DNA, 592 bp, Homo sapiens
aaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacatagaaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaag

SEQ ID NO: 5204 - DNA, 10180 bp, Homo sapiens
gcacgggctggtctctgccctaatgcggcggctggcggcgagaggcgctgcaggggacgcgggggaagtggcggcgccggcagcggacagctcggacagcgcccagggccggagcccgagcccttggaggttgattgacttatgtgcaatttgggacgctggagtttaccttccctccgcagcctggaacagagcctcctctggtgttgcaaggaagaggctgaatgaggcagagaagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccaaccacccttataatgactcgtccttaagaaaccaccctgacatgtacagtgcccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctagctgatcaggccactccaactaaccgtttggctgccctgcccaaaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagattatcccagggctgcgcccactgaagttaaagtccgagtcatgaacagcacagccatcagccttcagtggaaccgcgtctactccgacacggtccagggccagctcagagagtaccgagcctactactggagggagagcagcttgctgaagaacctgtgggtgtctcagaagagacagcaagccagcttccctggtgaccgcctccgtggcgtggtgtcccgcctcttcccctacagtaactacaagctggagatggttgtggtcaatgggagaggtgatgggcctcgcagtgagaccaaggagttcaccaccccggaaggagtacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaaggtagtcctttagcagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggagaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacttctagagagaagaaaaaggctgggtttggacttcatgcctcctcactggtgaaacccaggatgtagatagagggccacacccaccctgtccagagtagagggcacctgtccacgtggccagggcccatgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaaggtattagcaatgcttgcatcattaataatcattcagttgaaggtcaagcccatagacacacactctctgctggtaagaaaccatagcccagaactgagccaataaggttgtttgaacctgagagtgtgtaatggtcatttgggccaagcctcagctagggctgctgcctggacgcctgaggggcagcttatcacagtgcaaggggacagggtaaacagcagggggtggggtgtgagcttggagggcccctcccctggatttcctccaacacctgcttggatactaggcccactgtccctgaagggaatgtcagggaagtgtgcctgtgagctgaattaaaggactggcctttccagaaaacgctttggatctgagcagagtagtcagtttctcagacactcattccatactgcaccgtacatgccagcgtacccattgcaccgaaagcaggcccttagggcaggaagggacgatgagcaagtctgccacaccacctggtgactgggaagggctgcttctctcgtaagggtcttggggagaagtaagcccgcagcctgcctctgcacctcgttccagtgtcctgccaggctctgtactgtcctttgtgtatgaagaaaatgctgttagccctctctcaggctgctgttctgtgggtgctgagagctgccccccatcaccacgccatcacacccctctgagcagaagcaaatctgaggctgaagaattaagttttccccaagcaaggaaggcaggtggtcagagagatcaaacgctgaggcgtggggattgcaggattcaggaggcagcccctttggggaagaggagggtgcattttccatggagcccatgtcagagtccactccagctcagcaggaaagtggaattgcccagtactgcctgccagctgggtctcccaagcaactaccccaagacataccaacagtgaagccaggacagcaccatgccatcggcgctccagtctgtctggctgggaggaaagtgctgggcatcttacagtaactctagaagttcctttgactaggctgcaatcccacctatatgctcagccctaagagctgtggtttcctgtgctctcatttgtccattcattcattcattcattcattcagcaaataatctgaaatccagtctgaactaaggcctgagctgtggataccatggcgcgtgagttagatgtggtccctgccctcatggggctgacagtcctaaaatcaagtgctaggacacagtggccattgagctgggagcattcttccctctaccgcttaagccactgatggctgcgagcttgaagagagggattctgagggagagcttggtccatctggtcaccaaggctgggcgggacagagcagtcaagaaccacggtgtggcttgagaaacagtcctgcttcctgagcctctttgctctgcctcttggggcaagctccttaacctgtctgtatttttatgcctctgtctcccattcagttcctccttgaatacctctttctacagagaggcacgggctcccctgaaggattgtcgaggccagggttcgggaagtacactgccatcggtcaggggacagctgcctcccaccttgcctgggtgatggtgaatgggactcatcttttcctgccttgcttttgaggagatggttgaatttaagctaacaggaaagccaaaccagcaccctcctttgtgctctgagaggttggagacatctggtccaccccattgcccctgcccctggcaagccctgaagtcgggagaggtgaccacaggtctgaaaatcagccagtgccaacattgcttgccctgcaaggtgcaactgagcccacatagcgcattcatagtttccctgaccacagccttgggaagacggtggaaacccgaggatgtgtgggtttcccagctaacggacaagctcccctgccacacccagtgcccacgcatgctcacatacatacagcagaccacaaccctgttgccaagcagtgcttccaagggatagcgatccagattccaacattgtcttggagagggttagtccacatccaagttgcgtgagataagatgcaaagggctctgtgtggatgaggaacgcaccttagaggagtgggaaaggccaccagggttgggccctgtttaggtaattcctgttggcagcacctagagagagcatctgagctgaaggagtgggaaactttgcccaagcaatggcacgggcagcgggctctttctggcgccctgtgctggagcagggccaagtcttagggcatcacaaacagcccatttgatggagggagcagggacatagcacatttttgtctgtctttgtgaggctgctttgctaactctctgaggagaggaagcctctcgggctttccgtcggctggggctagtgccagagaatcccttctcagtggccagcaggttcctgggaggccggcacaaggcaccgctccccactcatgacaccttggtgcagagtgacctcctgcccagtcaccactccggccagccccagccaaacacacaaaagcccatggttgcggttgcatctacaccgttagttggcaaaggatcctgcttgagctctgcgtggtggccaaggagtagcatggaggagggccctgattttaaaaaggaaaaatagagaggcctcaaaacaatgaaacaaagagcttgatatgtcaagaggagaccaaggccctgggaggcataggcaagccgggcagagtcagaccagtgccctcccttgaccatctcctagcattccttaacctagacaggggctaccccatgtgagtccaagccagactttgtggctgtccccagcctgcacagcccaagcccagggaagtgtcctttctttcccttccttactaataatgggccttcctgagacacattcagagaaggatcagagagaaaggagaaccatccaggagagccacaagcgtccaccaaacagtgtctcaggcctcacctgaagctgctgttcctcctatcagcacactagtattaaatgggtgttccataatgaggagaatggaaataggtacaaggcatctagcttaggacagaatcggatttcggcatgtgaaggaatcccagagctgatctcattgaaatgatctatcgtacagacaaggatatgcaaatccacagaagtgaagggatttttgctcaagatcacatagctggtaaactaaggtaaggttagggcttgaacttgggccttctgactccttgtccagtcagtgttctttcatctcaccacagctgcctcctttgaaacagaggtattaagatctgtccttctggttcaccctctcatacctctttactgcgtctcccacatcccccacatgcctcccaaaatgaaagacaaacaggattgtttctgagaccaagatcagtctgtctgtgatcagcctgtgtgtggttcacccagtcatgcaattaagggcagatctgggccagtggaataggatagctgattggtgtttgttactgtgaaccctagaccgtaccccgtagaatggtgtctcttgctttgtaacacatcgggccttcagtgtgctgtattcctcagaagtgagggcatctcggtccattctgcccatggccacagggtgcagagaggcagcagggcccatgcaagctgccaccctgggatttgctgggctggagttcaacagatgtaaagacttcagtgaagcaataaacacaaaactctgggagaagatatccagaattttgtacattactctgtttctttttcaaaaatgaggcagatcagatgcccctgagctgcccctttttttctgattcccaactgcaatgtcctcagtcagtgttgtccctctgcccggctccccagctctttgccaacctcttcacactccccttgagctgagcatcagtcgcctgtgacgtggccaccttctgtcctgctcccactcccgacccatgctggaccccggaggacctcctgccccgcccccaccacacacccatatcccccaccattccaatttgttctttcccgtggggaattttttttcccagcgtctccatcccttcctacatatccacacacacacaaattggtctgatcttttttccattggttaaacatttaactccatgccagaccttgttttaacccctctcacatcatgttctttccttttttgcgagttattttgcattaaccaactttgtcagtgacagatgcgtatctgagggtgtcacacacgaccttcagcagggaagacttctgggccatggagggccgtctaatacatggacttataaactgactgcatgagcaatgaaaaggccaaattattctgaattttttttgaatcactgtaaaaaaactgatttcttttgtatagagaacactaaacgtataataaaagttgttcaaaatgg

SEQ ID NO: 5205 - DNA, 10384 bp, Homo sapiens
gcacgggctggtctctgccctaatgcggcggctggcggcgagaggcgctgcaggggacgcgggggaagtggcggcgccggcagcggacagctcggacagcgcccagggccggagcccgagcccttggaggttgattgacttatgtgcaatttgggacgctggagtttaccttccctccgcagcctggaacagagcctcctctggtgttgcaaggaagaggctgaatgaggcagagaagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatcctaaccctcaacataggttgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccacccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctagctgatcaggccactccaactaaccgtttggctgccctgcccaaaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagattatcccagggctgcgcccactgaagttaaagtccgagtcatgaacagcacagccatcagccttcagtggaaccgcgtctactccgacacggtccagggccagctcagagagtaccgagcctactactggagggagagcagcttgctgaagaacctgtgggtgtctcagaagagacagcaagccagcttccctggtgaccgcctccgtggcgtggtgtcccgcctcttcccctacagtaactacaagctggagatggttgtggtcaatgggagaggtgatgggcctcgcagtgagaccaaggagttcaccaccccggaaggagtacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaaggtagcccagtcatgtctcctcccacattgcccccgactaccgtgggtgcgacgggcgctgtgagcagtaccgatgctactgccattgctgccaccaccgaagccacaacagtccccatcatcccaactgtcgcacctaccaccatcgccaccaccaccaccgtcgccacaactactacaaccactgctgccgccaccaccaccacggagagtcctcccaccaccacctccgggactaagatacacgaatccgcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggagaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacttctagagagaagaaaaaggctgggtttggacttcatgcctcctcactggtgaaacccaggatgtagatagagggccacacccaccctgtccagagtagagggcacctgtccacgtggccagggcccatgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaaggtattagcaatgcttgcatcattaataatcattcagttgaaggtcaagcccatagacacacactctctgctggtaagaaaccatagcccagaactgagccaataaggttgtttgaacctgagagtgtgtaatggtcatttgggccaagcctcagctagggctgctgcctggacgcctgaggggcagcttatcacagtgcaaggggacagggtaaacagcagggggtggggtgtgagcttggagggcccctcccctggatttcctccaacacctgcttggatactaggcccactgtccctgaagggaatgtcagggaagtgtgcctgtgagctgaattaaaggactggcctttccagaaaacgctttggatctgagcagagtagtcagtttctcagacactcattccatactgcaccgtacatgccagcgtacccattgcaccgaaagcaggcccttagggcaggaagggacgatgagcaagtctgccacaccacctggtgactgggaagggctgcttctctcgtaagggtcttggggagaagtaagcccgcagcctgcctctgcacctcgttccagtgtcctgccaggctctgtactgtcctttgtgtatgaagaaaatgctgttagccctctctcaggctgctgttctgtgggtgctgagagctgccccccatcaccacgccatcacacccctctgagcagaagcaaatctgaggctgaagaattaagttttccccaagcaaggaaggcaggtggtcagagagatcaaacgctgaggcgtggggattgcaggattcaggaggcagcccctttggggaagaggagggtgcattttccatggagcccatgtcagagtccactccagctcagcaggaaagtggaattgcccagtactgcctgccagctgggtctcccaagcaactaccccaagacataccaacagtgaagccaggacagcaccatgccatcggcgctccagtctgtctggctgggaggaaagtgctgggcatcttacagtaactctagaagttcctttgactaggctgcaatcccacctatatgctcagccctaagagctgtggtttcctgtgctctcatttgtccattcattcattcattcattcattcagcaaataatctgaaatccagtctgaactaaggcctgagctgtggataccatggcgcgtgagttagatgtggtccctgccctcatggggctgacagtcctaaaatcaagtgctaggacacagtggccattgagctgggagcattcttccctctaccgcttaagccactgatggctgcgagcttgaagagagggattctgagggagagcttggtccatctggtcaccaaggctgggcgggacagagcagtcaagaaccacggtgtggcttgagaaacagtcctgcttcctgagcctctttgctctgcctcttggggcaagctccttaacctgtctgtatttttatgcctctgtctcccattcagttcctccttgaatacctctttctacagagaggcacgggctcccctgaaggattgtcgaggccagggttcgggaagtacactgccatcggtcaggggacagctgcctcccaccttgcctgggtgatggtgaatgggactcatcttttcctgccttgcttttgaggagatggttgaatttaagctaacaggaaagccaaaccagcaccctcctttgtgctctgagaggttggagacatctggtccaccccattgcccctgcccctggcaagccctgaagtcgggagaggtgaccacaggtctgaaaatcagccagtgccaacattgcttgccctgcaaggtgcaactgagcccacatagcgcattcatagtttccctgaccacagccttgggaagacggtggaaacccgaggatgtgtgggtttcccagctaacggacaagctcccctgccacacccagtgcccacgcatgctcacatacatacagcagaccacaaccctgttgccaagcagtgcttccaagggatagcgatccagattccaacattgtcttggagagggttagtccacatccaagttgcgtgagataagatgcaaagggctctgtgtggatgaggaacgcaccttagaggagtgggaaaggccaccagggttgggccctgtttaggtaattcctgttggcagcacctagagagagcatctgagctgaaggagtgggaaactttgcccaagcaatggcacgggcagcgggctctttctggcgccctgtgctggagcagggccaagtcttagggcatcacaaacagcccatttgatggagggagcagggacatagcacatttttgtctgtctttgtgaggctgctttgctaactctctgaggagaggaagcctctcgggctttccgtcggctggggctagtgccagagaatcccttctcagtggccagcaggttcctgggaggccggcacaaggcaccgctccccactcatgacaccttggtgcagagtgacctcctgcccagtcaccactccggccagccccagccaaacacacaaaagcccatggttgcggttgcatctacaccgttagttggcaaaggatcctgcttgagctctgcgtggtggccaaggagtagcatggaggagggccctgattttaaaaaggaaaaatagagaggcctcaaaacaatgaaacaaagagcttgatatgtcaagaggagaccaaggccctgggaggcataggcaagccgggcagagtcagaccagtgccctcccttgaccatctcctagcattccttaacctagacaggggctaccccatgtgagtccaagccagactttgtggctgtccccagcctgcacagcccaagcccagggaagtgtcctttctttcccttccttactaataatgggccttcctgagacacattcagagaaggatcagagagaaaggagaaccatccaggagagccacaagcgtccaccaaacagtgtctcaggcctcacctgaagctgctgttcctcctatcagcacactagtattaaatgggtgttccataatgaggagaatggaaataggtacaaggcatctagcttaggacagaatcggatttcggcatgtgaaggaatcccagagctgatctcattgaaatgatctatcgtacagacaaggatatgcaaatccacagaagtgaagggatttttgctcaagatcacatagctggtaaactaaggtaaggttagggcttgaacttgggccttctgactccttgtccagtcagtgttctttcatctcaccacagctgcctcctttgaaacagaggtattaagatctgtccttctggttcaccctctcatacctctttactgcgtctcccacatcccccacatgcctcccaaaatgaaagacaaacaggattgtttctgagaccaagatcagtctgtctgtgatcagcctgtgtgtggttcacccagtcatgcaattaagggcagatctgggccagtggaataggatagctgattggtgtttgttactgtgaaccctagaccgtaccccgtagaatggtgtctcttgctttgtaacacatcgggccttcagtgtgctgtattcctcagaagtgagggcatctcggtccattctgcccatggccacagggtgcagagaggcagcagggcccatgcaagctgccaccctgggatttgctgggctggagttcaacagatgtaaagacttcagtgaagcaataaacacaaaactctgggagaagatatccagaattttgtacattactctgtttctttttcaaaaatgaggcagatcagatgcccctgagctgcccctttttttctgattcccaactgcaatgtcctcagtcagtgttgtccctctgcccggctccccagctctttgccaacctcttcacactccccttgagctgagcatcagtcgcctgtgacgtggccaccttctgtcctgctcccactcccgacccatgctggaccccggaggacctcctgccccgcccccaccacacacccatatcccccaccattccaatttgttctttcccgtggggaattttttttcccagcgtctccatcccttcctacatatccacacacacacaaattggtctgatcttttttccattggttaaacatttaactccatgccagaccttgttttaacccctctcacatcatgttctttccttttttgcgagttattttgcattaaccaactttgtcagtgacagatgcgtatctgagggtgtcacacacgaccttcagcagggaagacttctgggccatggagggccgtctaatacatggacttataaactgactgcatgagcaatgaaaaggccaaattattctgaattttttttgaatcactgtaaaaaaactgatttcttttgtatagagaacactaaacgtataataaaagttgttcaaaatgg

SEQ ID NO: 5206 - DNA, 10285 bp, Homo sapiens
gcacgggctggtctctgccctaatgcggcggctggcggcgagaggcgctgcaggggacgcgggggaagtggcggcgccggcagcggacagctcggacagcgcccagggccggagcccgagcccttggaggttgattgacttatgtgcaatttgggacgctggagtttaccttccctccgcagcctggaacagagcctcctctggtgttgcaaggaagaggctgaatgaggcagagaagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatcctaaccctcaacataggttgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccacccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctagctgatcaggccactccaactaaccgtttggctgccctgcccaaaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagattatcccagggctgcgcccactgaagttaaagtccgagtcatgaacagcacagccatcagccttcagtggaaccgcgtctactccgacacggtccagggccagctcagagagtaccgagcctactactggagggagagcagcttgctgaagaacctgtgggtgtctcagaagagacagcaagccagcttccctggtgaccgcctccgtggcgtggtgtcccgcctcttcccctacagtaactacaagctggagatggttgtggtcaatgggagaggtgatgggcctcgcagtgagaccaaggagttcaccaccccggaaggagtacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaaggcaaccatacgaaaaaaactgtcccagttaaggcccaggctcagcctatacagctgacagacctctatcccgggatgacatacacgttgcgggtttattcccgggacaacgagggcatcagcagtaccgtcatcacctttatgaccagtacagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggagaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacttctagagagaagaaaaaggctgggtttggacttcatgcctcctcactggtgaaacccaggatgtagatagagggccacacccaccctgtccagagtagagggcacctgtccacgtggccagggcccatgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaaggtattagcaatgcttgcatcattaataatcattcagttgaaggtcaagcccatagacacacactctctgctggtaagaaaccatagcccagaactgagccaataaggttgtttgaacctgagagtgtgtaatggtcatttgggccaagcctcagctagggctgctgcctggacgcctgaggggcagcttatcacagtgcaaggggacagggtaaacagcagggggtggggtgtgagcttggagggcccctcccctggatttcctccaacacctgcttggatactaggcccactgtccctgaagggaatgtcagggaagtgtgcctgtgagctgaattaaaggactggcctttccagaaaacgctttggatctgagcagagtagtcagtttctcagacactcattccatactgcaccgtacatgccagcgtacccattgcaccgaaagcaggcccttagggcaggaagggacgatgagcaagtctgccacaccacctggtgactgggaagggctgcttctctcgtaagggtcttggggagaagtaagcccgcagcctgcctctgcacctcgttccagtgtcctgccaggctctgtactgtcctttgtgtatgaagaaaatgctgttagccctctctcaggctgctgttctgtgggtgctgagagctgccccccatcaccacgccatcacacccctctgagcagaagcaaatctgaggctgaagaattaagttttccccaagcaaggaaggcaggtggtcagagagatcaaacgctgaggcgtggggattgcaggattcaggaggcagcccctttggggaagaggagggtgcattttccatggagcccatgtcagagtccactccagctcagcaggaaagtggaattgcccagtactgcctgccagctgggtctcccaagcaactaccccaagacataccaacagtgaagccaggacagcaccatgccatcggcgctccagtctgtctggctgggaggaaagtgctgggcatcttacagtaactctagaagttcctttgactaggctgcaatcccacctatatgctcagccctaagagctgtggtttcctgtgctctcatttgtccattcattcattcattcattcattcagcaaataatctgaaatccagtctgaactaaggcctgagctgtggataccatggcgcgtgagttagatgtggtccctgccctcatggggctgacagtcctaaaatcaagtgctaggacacagtggccattgagctgggagcattcttccctctaccgcttaagccactgatggctgcgagcttgaagagagggattctgagggagagcttggtccatctggtcaccaaggctgggcgggacagagcagtcaagaaccacggtgtggcttgagaaacagtcctgcttcctgagcctctttgctctgcctcttggggcaagctccttaacctgtctgtatttttatgcctctgtctcccattcagttcctccttgaatacctctttctacagagaggcacgggctcccctgaaggattgtcgaggccagggttcgggaagtacactgccatcggtcaggggacagctgcctcccaccttgcctgggtgatggtgaatgggactcatcttttcctgccttgcttttgaggagatggttgaatttaagctaacaggaaagccaaaccagcaccctcctttgtgctctgagaggttggagacatctggtccaccccattgcccctgcccctggcaagccctgaagtcgggagaggtgaccacaggtctgaaaatcagccagtgccaacattgcttgccctgcaaggtgcaactgagcccacatagcgcattcatagtttccctgaccacagccttgggaagacggtggaaacccgaggatgtgtgggtttcccagctaacggacaagctcccctgccacacccagtgcccacgcatgctcacatacatacagcagaccacaaccctgttgccaagcagtgcttccaagggatagcgatccagattccaacattgtcttggagagggttagtccacatccaagttgcgtgagataagatgcaaagggctctgtgtggatgaggaacgcaccttagaggagtgggaaaggccaccagggttgggccctgtttaggtaattcctgttggcagcacctagagagagcatctgagctgaaggagtgggaaactttgcccaagcaatggcacgggcagcgggctctttctggcgccctgtgctggagcagggccaagtcttagggcatcacaaacagcccatttgatggagggagcagggacatagcacatttttgtctgtctttgtgaggctgctttgctaactctctgaggagaggaagcctctcgggctttccgtcggctggggctagtgccagagaatcccttctcagtggccagcaggttcctgggaggccggcacaaggcaccgctccccactcatgacaccttggtgcagagtgacctcctgcccagtcaccactccggccagccccagccaaacacacaaaagcccatggttgcggttgcatctacaccgttagttggcaaaggatcctgcttgagctctgcgtggtggccaaggagtagcatggaggagggccctgattttaaaaaggaaaaatagagaggcctcaaaacaatgaaacaaagagcttgatatgtcaagaggagaccaaggccctgggaggcataggcaagccgggcagagtcagaccagtgccctcccttgaccatctcctagcattccttaacctagacaggggctaccccatgtgagtccaagccagactttgtggctgtccccagcctgcacagcccaagcccagggaagtgtcctttctttcccttccttactaataatgggccttcctgagacacattcagagaaggatcagagagaaaggagaaccatccaggagagccacaagcgtccaccaaacagtgtctcaggcctcacctgaagctgctgttcctcctatcagcacactagtattaaatgggtgttccataatgaggagaatggaaataggtacaaggcatctagcttaggacagaatcggatttcggcatgtgaaggaatcccagagctgatctcattgaaatgatctatcgtacagacaaggatatgcaaatccacagaagtgaagggatttttgctcaagatcacatagctggtaaactaaggtaaggttagggcttgaacttgggccttctgactccttgtccagtcagtgttctttcatctcaccacagctgcctcctttgaaacagaggtattaagatctgtccttctggttcaccctctcatacctctttactgcgtctcccacatcccccacatgcctcccaaaatgaaagacaaacaggattgtttctgagaccaagatcagtctgtctgtgatcagcctgtgtgtggttcacccagtcatgcaattaagggcagatctgggccagtggaataggatagctgattggtgtttgttactgtgaaccctagaccgtaccccgtagaatggtgtctcttgctttgtaacacatcgggccttcagtgtgctgtattcctcagaagtgagggcatctcggtccattctgcccatggccacagggtgcagagaggcagcagggcccatgcaagctgccaccctgggatttgctgggctggagttcaacagatgtaaagacttcagtgaagcaataaacacaaaactctgggagaagatatccagaattttgtacattactctgtttctttttcaaaaatgaggcagatcagatgcccctgagctgcccctttttttctgattcccaactgcaatgtcctcagtcagtgttgtccctctgcccggctccccagctctttgccaacctcttcacactccccttgagctgagcatcagtcgcctgtgacgtggccaccttctgtcctgctcccactcccgacccatgctggaccccggaggacctcctgccccgcccccaccacacacccatatcccccaccattccaatttgttctttcccgtggggaattttttttcccagcgtctccatcccttcctacatatccacacacacacaaattggtctgatcttttttccattggttaaacatttaactccatgccagaccttgttttaacccctctcacatcatgttctttccttttttgcgagttattttgcattaaccaactttgtcagtgacagatgcgtatctgagggtgtcacacacgaccttcagcagggaagacttctgggccatggagggccgtctaatacatggacttataaactgactgcatgagcaatgaaaaggccaaattattctgaattttttttgaatcactgtaaaaaaactgatttcttttgtatagagaacactaaacgtataataaaagttgttcaaaatgg

SEQ ID NO: 5207 - DNA, 10333 bp, Homo sapiens
gcacgggctggtctctgccctaatgcggcggctggcggcgagaggcgctgcaggggacgcgggggaagtggcggcgccggcagcggacagctcggacagcgcccagggccggagcccgagcccttggaggttgattgacttatgtgcaatttgggacgctggagtttaccttccctccgcagcctggaacagagcctcctctggtgttgcaaggaagaggctgaatgaggcagagaagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatccaagcattcagaatgagctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccacccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctagctgatcaggccactccaactaaccgtttggctgccctgcccaaaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagatttacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagctactccaaccgcagctcctcccacattgcccccgactaccgtgggtgcgacgggcgctgtgagcagtaccgatgctactgccattgctgccaccaccgaagccacaacagtccccatcatcccaactgtcgcacctaccaccatcgccaccaccaccaccgtcgccacaactactacaaccactgctgccgccaccaccaccacggagagtcctcccaccaccacctccgggactaagatacacgaatccgcccctgatgagcagtccatatggaacgtcacggtgctccccaacagtaaatgggccaacatcacctggaagcacaatttcgggcccggaactgactttgtggttgagtacatcgacagcaaccatacgaaaaaaactgtcccagttaaggcccaggctcagcctatacagctgacagacctctatcccgggatgacatacacgttgcgggtttattcccgggacaacgagggcatcagcagtaccgtcatcacctttatgaccagtacagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggagaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacttctagagagaagaaaaaggctgggtttggacttcatgcctcctcactggtgaaacccaggatgtagatagagggccacacccaccctgtccagagtagagggcacctgtccacgtggccagggcccatgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaaggtattagcaatgcttgcatcattaataatcattcagttgaaggtcaagcccatagacacacactctctgctggtaagaaaccatagcccagaactgagccaataaggttgtttgaacctgagagtgtgtaatggtcatttgggccaagcctcagctagggctgctgcctggacgcctgaggggcagcttatcacagtgcaaggggacagggtaaacagcagggggtggggtgtgagcttggagggcccctcccctggatttcctccaacacctgcttggatactaggcccactgtccctgaagggaatgtcagggaagtgtgcctgtgagctgaattaaaggactggcctttccagaaaacgctttggatctgagcagagtagtcagtttctcagacactcattccatactgcaccgtacatgccagcgtacccattgcaccgaaagcaggcccttagggcaggaagggacgatgagcaagtctgccacaccacctggtgactgggaagggctgcttctctcgtaagggtcttggggagaagtaagcccgcagcctgcctctgcacctcgttccagtgtcctgccaggctctgtactgtcctttgtgtatgaagaaaatgctgttagccctctctcaggctgctgttctgtgggtgctgagagctgccccccatcaccacgccatcacacccctctgagcagaagcaaatctgaggctgaagaattaagttttccccaagcaaggaaggcaggtggtcagagagatcaaacgctgaggcgtggggattgcaggattcaggaggcagcccctttggggaagaggagggtgcattttccatggagcccatgtcagagtccactccagctcagcaggaaagtggaattgcccagtactgcctgccagctgggtctcccaagcaactaccccaagacataccaacagtgaagccaggacagcaccatgccatcggcgctccagtctgtctggctgggaggaaagtgctgggcatcttacagtaactctagaagttcctttgactaggctgcaatcccacctatatgctcagccctaagagctgtggtttcctgtgctctcatttgtccattcattcattcattcattcattcagcaaataatctgaaatccagtctgaactaaggcctgagctgtggataccatggcgcgtgagttagatgtggtccctgccctcatggggctgacagtcctaaaatcaagtgctaggacacagtggccattgagctgggagcattcttccctctaccgcttaagccactgatggctgcgagcttgaagagagggattctgagggagagcttggtccatctggtcaccaaggctgggcgggacagagcagtcaagaaccacggtgtggcttgagaaacagtcctgcttcctgagcctctttgctctgcctcttggggcaagctccttaacctgtctgtatttttatgcctctgtctcccattcagttcctccttgaatacctctttctacagagaggcacgggctcccctgaaggattgtcgaggccagggttcgggaagtacactgccatcggtcaggggacagctgcctcccaccttgcctgggtgatggtgaatgggactcatcttttcctgccttgcttttgaggagatggttgaatttaagctaacaggaaagccaaaccagcaccctcctttgtgctctgagaggttggagacatctggtccaccccattgcccctgcccctggcaagccctgaagtcgggagaggtgaccacaggtctgaaaatcagccagtgccaacattgcttgccctgcaaggtgcaactgagcccacatagcgcattcatagtttccctgaccacagccttgggaagacggtggaaacccgaggatgtgtgggtttcccagctaacggacaagctcccctgccacacccagtgcccacgcatgctcacatacatacagcagaccacaaccctgttgccaagcagtgcttccaagggatagcgatccagattccaacattgtcttggagagggttagtccacatccaagttgcgtgagataagatgcaaagggctctgtgtggatgaggaacgcaccttagaggagtgggaaaggccaccagggttgggccctgtttaggtaattcctgttggcagcacctagagagagcatctgagctgaaggagtgggaaactttgcccaagcaatggcacgggcagcgggctctttctggcgccctgtgctggagcagggccaagtcttagggcatcacaaacagcccatttgatggagggagcagggacatagcacatttttgtctgtctttgtgaggctgctttgctaactctctgaggagaggaagcctctcgggctttccgtcggctggggctagtgccagagaatcccttctcagtggccagcaggttcctgggaggccggcacaaggcaccgctccccactcatgacaccttggtgcagagtgacctcctgcccagtcaccactccggccagccccagccaaacacacaaaagcccatggttgcggttgcatctacaccgttagttggcaaaggatcctgcttgagctctgcgtggtggccaaggagtagcatggaggagggccctgattttaaaaaggaaaaatagagaggcctcaaaacaatgaaacaaagagcttgatatgtcaagaggagaccaaggccctgggaggcataggcaagccgggcagagtcagaccagtgccctcccttgaccatctcctagcattccttaacctagacaggggctaccccatgtgagtccaagccagactttgtggctgtccccagcctgcacagcccaagcccagggaagtgtcctttctttcccttccttactaataatgggccttcctgagacacattcagagaaggatcagagagaaaggagaaccatccaggagagccacaagcgtccaccaaacagtgtctcaggcctcacctgaagctgctgttcctcctatcagcacactagtattaaatgggtgttccataatgaggagaatggaaataggtacaaggcatctagcttaggacagaatcggatttcggcatgtgaaggaatcccagagctgatctcattgaaatgatctatcgtacagacaaggatatgcaaatccacagaagtgaagggatttttgctcaagatcacatagctggtaaactaaggtaaggttagggcttgaacttgggccttctgactccttgtccagtcagtgttctttcatctcaccacagctgcctcctttgaaacagaggtattaagatctgtccttctggttcaccctctcatacctctttactgcgtctcccacatcccccacatgcctcccaaaatgaaagacaaacaggattgtttctgagaccaagatcagtctgtctgtgatcagcctgtgtgtggttcacccagtcatgcaattaagggcagatctgggccagtggaataggatagctgattggtgtttgttactgtgaaccctagaccgtaccccgtagaatggtgtctcttgctttgtaacacatcgggccttcagtgtgctgtattcctcagaagtgagggcatctcggtccattctgcccatggccacagggtgcagagaggcagcagggcccatgcaagctgccaccctgggatttgctgggctggagttcaacagatgtaaagacttcagtgaagcaataaacacaaaactctgggagaagatatccagaattttgtacattactctgtttctttttcaaaaatgaggcagatcagatgcccctgagctgcccctttttttctgattcccaactgcaatgtcctcagtcagtgttgtccctctgcccggctccccagctctttgccaacctcttcacactccccttgagctgagcatcagtcgcctgtgacgtggccaccttctgtcctgctcccactcccgacccatgctggaccccggaggacctcctgccccgcccccaccacacacccatatcccccaccattccaatttgttctttcccgtggggaattttttttcccagcgtctccatcccttcctacatatccacacacacacaaattggtctgatcttttttccattggttaaacatttaactccatgccagaccttgttttaacccctctcacatcatgttctttccttttttgcgagttattttgcattaaccaactttgtcagtgacagatgcgtatctgagggtgtcacacacgaccttcagcagggaagacttctgggccatggagggccgtctaatacatggacttataaactgactgcatgagcaatgaaaaggccaaattattctgaattttttttgaatcactgtaaaaaaactgatttcttttgtatagagaacactaaacgtataataaaagttgttcaaaatgg

SEQ ID NO: 5208 - DNA, 10120 bp, Homo sapiens
gcacgggctggtctctgccctaatgcggcggctggcggcgagaggcgctgcaggggacgcgggggaagtggcggcgccggcagcggacagctcggacagcgcccagggccggagcccgagcccttggaggttgattgacttatgtgcaatttgggacgctggagtttaccttccctccgcagcctggaacagagcctcctctggtgttgcaaggaagaggctgaatgaggcagagaagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccaaccacccttataatgactcgtccttaagaaaccaccctgacatgtacagtgcccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagattatcccagggctgcgcccactgaagttaaagtccgagtcatgaacagcacagccatcagccttcagtggaaccgcgtctactccgacacggtccagggccagctcagagagtaccgagcctactactggagggagagcagcttgctgaagaacctgtgggtgtctcagaagagacagcaagccagcttccctggtgaccgcctccgtggcgtggtgtcccgcctcttcccctacagtaactacaagctggagatggttgtggtcaatgggagaggtgatgggcctcgcagtgagaccaaggagttcaccaccccggaaggagtacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggagaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacttctagagagaagaaaaaggctgggtttggacttcatgcctcctcactggtgaaacccaggatgtagatagagggccacacccaccctgtccagagtagagggcacctgtccacgtggccagggcccatgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaaggtattagcaatgcttgcatcattaataatcattcagttgaaggtcaagcccatagacacacactctctgctggtaagaaaccatagcccagaactgagccaataaggttgtttgaacctgagagtgtgtaatggtcatttgggccaagcctcagctagggctgctgcctggacgcctgaggggcagcttatcacagtgcaaggggacagggtaaacagcagggggtggggtgtgagcttggagggcccctcccctggatttcctccaacacctgcttggatactaggcccactgtccctgaagggaatgtcagggaagtgtgcctgtgagctgaattaaaggactggcctttccagaaaacgctttggatctgagcagagtagtcagtttctcagacactcattccatactgcaccgtacatgccagcgtacccattgcaccgaaagcaggcccttagggcaggaagggacgatgagcaagtctgccacaccacctggtgactgggaagggctgcttctctcgtaagggtcttggggagaagtaagcccgcagcctgcctctgcacctcgttccagtgtcctgccaggctctgtactgtcctttgtgtatgaagaaaatgctgttagccctctctcaggctgctgttctgtgggtgctgagagctgccccccatcaccacgccatcacacccctctgagcagaagcaaatctgaggctgaagaattaagttttccccaagcaaggaaggcaggtggtcagagagatcaaacgctgaggcgtggggattgcaggattcaggaggcagcccctttggggaagaggagggtgcattttccatggagcccatgtcagagtccactccagctcagcaggaaagtggaattgcccagtactgcctgccagctgggtctcccaagcaactaccccaagacataccaacagtgaagccaggacagcaccatgccatcggcgctccagtctgtctggctgggaggaaagtgctgggcatcttacagtaactctagaagttcctttgactaggctgcaatcccacctatatgctcagccctaagagctgtggtttcctgtgctctcatttgtccattcattcattcattcattcattcagcaaataatctgaaatccagtctgaactaaggcctgagctgtggataccatggcgcgtgagttagatgtggtccctgccctcatggggctgacagtcctaaaatcaagtgctaggacacagtggccattgagctgggagcattcttccctctaccgcttaagccactgatggctgcgagcttgaagagagggattctgagggagagcttggtccatctggtcaccaaggctgggcgggacagagcagtcaagaaccacggtgtggcttgagaaacagtcctgcttcctgagcctctttgctctgcctcttggggcaagctccttaacctgtctgtatttttatgcctctgtctcccattcagttcctccttgaatacctctttctacagagaggcacgggctcccctgaaggattgtcgaggccagggttcgggaagtacactgccatcggtcaggggacagctgcctcccaccttgcctgggtgatggtgaatgggactcatcttttcctgccttgcttttgaggagatggttgaatttaagctaacaggaaagccaaaccagcaccctcctttgtgctctgagaggttggagacatctggtccaccccattgcccctgcccctggcaagccctgaagtcgggagaggtgaccacaggtctgaaaatcagccagtgccaacattgcttgccctgcaaggtgcaactgagcccacatagcgcattcatagtttccctgaccacagccttgggaagacggtggaaacccgaggatgtgtgggtttcccagctaacggacaagctcccctgccacacccagtgcccacgcatgctcacatacatacagcagaccacaaccctgttgccaagcagtgcttccaagggatagcgatccagattccaacattgtcttggagagggttagtccacatccaagttgcgtgagataagatgcaaagggctctgtgtggatgaggaacgcaccttagaggagtgggaaaggccaccagggttgggccctgtttaggtaattcctgttggcagcacctagagagagcatctgagctgaaggagtgggaaactttgcccaagcaatggcacgggcagcgggctctttctggcgccctgtgctggagcagggccaagtcttagggcatcacaaacagcccatttgatggagggagcagggacatagcacatttttgtctgtctttgtgaggctgctttgctaactctctgaggagaggaagcctctcgggctttccgtcggctggggctagtgccagagaatcccttctcagtggccagcaggttcctgggaggccggcacaaggcaccgctccccactcatgacaccttggtgcagagtgacctcctgcccagtcaccactccggccagccccagccaaacacacaaaagcccatggttgcggttgcatctacaccgttagttggcaaaggatcctgcttgagctctgcgtggtggccaaggagtagcatggaggagggccctgattttaaaaaggaaaaatagagaggcctcaaaacaatgaaacaaagagcttgatatgtcaagaggagaccaaggccctgggaggcataggcaagccgggcagagtcagaccagtgccctcccttgaccatctcctagcattccttaacctagacaggggctaccccatgtgagtccaagccagactttgtggctgtccccagcctgcacagcccaagcccagggaagtgtcctttctttcccttccttactaataatgggccttcctgagacacattcagagaaggatcagagagaaaggagaaccatccaggagagccacaagcgtccaccaaacagtgtctcaggcctcacctgaagctgctgttcctcctatcagcacactagtattaaatgggtgttccataatgaggagaatggaaataggtacaaggcatctagcttaggacagaatcggatttcggcatgtgaaggaatcccagagctgatctcattgaaatgatctatcgtacagacaaggatatgcaaatccacagaagtgaagggatttttgctcaagatcacatagctggtaaactaaggtaaggttagggcttgaacttgggccttctgactccttgtccagtcagtgttctttcatctcaccacagctgcctcctttgaaacagaggtattaagatctgtccttctggttcaccctctcatacctctttactgcgtctcccacatcccccacatgcctcccaaaatgaaagacaaacaggattgtttctgagaccaagatcagtctgtctgtgatcagcctgtgtgtggttcacccagtcatgcaattaagggcagatctgggccagtggaataggatagctgattggtgtttgttactgtgaaccctagaccgtaccccgtagaatggtgtctcttgctttgtaacacatcgggccttcagtgtgctgtattcctcagaagtgagggcatctcggtccattctgcccatggccacagggtgcagagaggcagcagggcccatgcaagctgccaccctgggatttgctgggctggagttcaacagatgtaaagacttcagtgaagcaataaacacaaaactctgggagaagatatccagaattttgtacattactctgtttctttttcaaaaatgaggcagatcagatgcccctgagctgcccctttttttctgattcccaactgcaatgtcctcagtcagtgttgtccctctgcccggctccccagctctttgccaacctcttcacactccccttgagctgagcatcagtcgcctgtgacgtggccaccttctgtcctgctcccactcccgacccatgctggaccccggaggacctcctgccccgcccccaccacacacccatatcccccaccattccaatttgttctttcccgtggggaattttttttcccagcgtctccatcccttcctacatatccacacacacacaaattggtctgatcttttttccattggttaaacatttaactccatgccagaccttgttttaacccctctcacatcatgttctttccttttttgcgagttattttgcattaaccaactttgtcagtgacagatgcgtatctgagggtgtcacacacgaccttcagcagggaagacttctgggccatggagggccgtctaatacatggacttataaactgactgcatgagcaatgaaaaggccaaattattctgaattttttttgaatcactgtaaaaaaactgatttcttttgtatagagaacactaaacgtataataaaagttgttcaaaatgg

SEQ ID NO: 5209 - DNA, 9826 bp, Homo sapiens
gcacgggctggtctctgccctaatgcggcggctggcggcgagaggcgctgcaggggacgcgggggaagtggcggcgccggcagcggacagctcggacagcgcccagggccggagcccgagcccttggaggttgattgacttatgtgcaatttgggacgctggagtttaccttccctccgcagcctggaacagagcctcctctggtgttgcaaggaagaggctgaatgaggcagagaagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatcctaaccctcaacataggttgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccacccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctagctgatcaggccactccaactaaccgtttggctgccctgcccaaaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagatttacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaaggtagcccagtcatgtcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggagaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacttctagagagaagaaaaaggctgggtttggacttcatgcctcctcactggtgaaacccaggatgtagatagagggccacacccaccctgtccagagtagagggcacctgtccacgtggccagggcccatgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaaggtattagcaatgcttgcatcattaataatcattcagttgaaggtcaagcccatagacacacactctctgctggtaagaaaccatagcccagaactgagccaataaggttgtttgaacctgagagtgtgtaatggtcatttgggccaagcctcagctagggctgctgcctggacgcctgaggggcagcttatcacagtgcaaggggacagggtaaacagcagggggtggggtgtgagcttggagggcccctcccctggatttcctccaacacctgcttggatactaggcccactgtccctgaagggaatgtcagggaagtgtgcctgtgagctgaattaaaggactggcctttccagaaaacgctttggatctgagcagagtagtcagtttctcagacactcattccatactgcaccgtacatgccagcgtacccattgcaccgaaagcaggcccttagggcaggaagggacgatgagcaagtctgccacaccacctggtgactgggaagggctgcttctctcgtaagggtcttggggagaagtaagcccgcagcctgcctctgcacctcgttccagtgtcctgccaggctctgtactgtcctttgtgtatgaagaaaatgctgttagccctctctcaggctgctgttctgtgggtgctgagagctgccccccatcaccacgccatcacacccctctgagcagaagcaaatctgaggctgaagaattaagttttccccaagcaaggaaggcaggtggtcagagagatcaaacgctgaggcgtggggattgcaggattcaggaggcagcccctttggggaagaggagggtgcattttccatggagcccatgtcagagtccactccagctcagcaggaaagtggaattgcccagtactgcctgccagctgggtctcccaagcaactaccccaagacataccaacagtgaagccaggacagcaccatgccatcggcgctccagtctgtctggctgggaggaaagtgctgggcatcttacagtaactctagaagttcctttgactaggctgcaatcccacctatatgctcagccctaagagctgtggtttcctgtgctctcatttgtccattcattcattcattcattcattcagcaaataatctgaaatccagtctgaactaaggcctgagctgtggataccatggcgcgtgagttagatgtggtccctgccctcatggggctgacagtcctaaaatcaagtgctaggacacagtggccattgagctgggagcattcttccctctaccgcttaagccactgatggctgcgagcttgaagagagggattctgagggagagcttggtccatctggtcaccaaggctgggcgggacagagcagtcaagaaccacggtgtggcttgagaaacagtcctgcttcctgagcctctttgctctgcctcttggggcaagctccttaacctgtctgtatttttatgcctctgtctcccattcagttcctccttgaatacctctttctacagagaggcacgggctcccctgaaggattgtcgaggccagggttcgggaagtacactgccatcggtcaggggacagctgcctcccaccttgcctgggtgatggtgaatgggactcatcttttcctgccttgcttttgaggagatggttgaatttaagctaacaggaaagccaaaccagcaccctcctttgtgctctgagaggttggagacatctggtccaccccattgcccctgcccctggcaagccctgaagtcgggagaggtgaccacaggtctgaaaatcagccagtgccaacattgcttgccctgcaaggtgcaactgagcccacatagcgcattcatagtttccctgaccacagccttgggaagacggtggaaacccgaggatgtgtgggtttcccagctaacggacaagctcccctgccacacccagtgcccacgcatgctcacatacatacagcagaccacaaccctgttgccaagcagtgcttccaagggatagcgatccagattccaacattgtcttggagagggttagtccacatccaagttgcgtgagataagatgcaaagggctctgtgtggatgaggaacgcaccttagaggagtgggaaaggccaccagggttgggccctgtttaggtaattcctgttggcagcacctagagagagcatctgagctgaaggagtgggaaactttgcccaagcaatggcacgggcagcgggctctttctggcgccctgtgctggagcagggccaagtcttagggcatcacaaacagcccatttgatggagggagcagggacatagcacatttttgtctgtctttgtgaggctgctttgctaactctctgaggagaggaagcctctcgggctttccgtcggctggggctagtgccagagaatcccttctcagtggccagcaggttcctgggaggccggcacaaggcaccgctccccactcatgacaccttggtgcagagtgacctcctgcccagtcaccactccggccagccccagccaaacacacaaaagcccatggttgcggttgcatctacaccgttagttggcaaaggatcctgcttgagctctgcgtggtggccaaggagtagcatggaggagggccctgattttaaaaaggaaaaatagagaggcctcaaaacaatgaaacaaagagcttgatatgtcaagaggagaccaaggccctgggaggcataggcaagccgggcagagtcagaccagtgccctcccttgaccatctcctagcattccttaacctagacaggggctaccccatgtgagtccaagccagactttgtggctgtccccagcctgcacagcccaagcccagggaagtgtcctttctttcccttccttactaataatgggccttcctgagacacattcagagaaggatcagagagaaaggagaaccatccaggagagccacaagcgtccaccaaacagtgtctcaggcctcacctgaagctgctgttcctcctatcagcacactagtattaaatgggtgttccataatgaggagaatggaaataggtacaaggcatctagcttaggacagaatcggatttcggcatgtgaaggaatcccagagctgatctcattgaaatgatctatcgtacagacaaggatatgcaaatccacagaagtgaagggatttttgctcaagatcacatagctggtaaactaaggtaaggttagggcttgaacttgggccttctgactccttgtccagtcagtgttctttcatctcaccacagctgcctcctttgaaacagaggtattaagatctgtccttctggttcaccctctcatacctctttactgcgtctcccacatcccccacatgcctcccaaaatgaaagacaaacaggattgtttctgagaccaagatcagtctgtctgtgatcagcctgtgtgtggttcacccagtcatgcaattaagggcagatctgggccagtggaataggatagctgattggtgtttgttactgtgaaccctagaccgtaccccgtagaatggtgtctcttgctttgtaacacatcgggccttcagtgtgctgtattcctcagaagtgagggcatctcggtccattctgcccatggccacagggtgcagagaggcagcagggcccatgcaagctgccaccctgggatttgctgggctggagttcaacagatgtaaagacttcagtgaagcaataaacacaaaactctgggagaagatatccagaattttgtacattactctgtttctttttcaaaaatgaggcagatcagatgcccctgagctgcccctttttttctgattcccaactgcaatgtcctcagtcagtgttgtccctctgcccggctccccagctctttgccaacctcttcacactccccttgagctgagcatcagtcgcctgtgacgtggccaccttctgtcctgctcccactcccgacccatgctggaccccggaggacctcctgccccgcccccaccacacacccatatcccccaccattccaatttgttctttcccgtggggaattttttttcccagcgtctccatcccttcctacatatccacacacacacaaattggtctgatcttttttccattggttaaacatttaactccatgccagaccttgttttaacccctctcacatcatgttctttccttttttgcgagttattttgcattaaccaactttgtcagtgacagatgcgtatctgagggtgtcacacacgaccttcagcagggaagacttctgggccatggagggccgtctaatacatggacttataaactgactgcatgagcaatgaaaaggccaaattattctgaattttttttgaatcactgtaaaaaaactgatttcttttgtatagagaacactaaacgtataataaaagttgttcaaaatgg

SEQ ID NO: 5210 - DNA, 10417 bp, Homo sapiens
gcacgggctggtctctgccctaatgcggcggctggcggcgagaggcgctgcaggggacgcgggggaagtggcggcgccggcagcggacagctcggacagcgcccagggccggagcccgagcccttggaggttgattgacttatgtgcaatttgggacgctggagtttaccttccctccgcagcctggaacagagcctcctctggtgttgcaaggaagaggctgaatgaggcagagaagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatcctaaccctcaacataggttgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccacccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctagctgatcaggccactccaactaaccgtttggctgccctgcccaaaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagattatcccagggctgcgcccactgaagttaaagtccgagtcatgaacagcacagccatcagccttcagtggaaccgcgtctactccgacacggtccagggccagctcagagagtaccgagcctactactggagggagagcagcttgctgaagaacctgtgggtgtctcagaagagacagcaagccagcttccctggtgaccgcctccgtggcgtggtgtcccgcctcttcccctacagtaactacaagctggagatggttgtggtcaatgggagaggtgatgggcctcgcagtgagaccaaggagttcaccaccccggaaggagtacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaaggtagcccagtcatgtcccctgatgagcagtccatatggaacgtcacggtgctccccaacagtaaatgggccaacatcacctggaagcacaatttcgggcccggaactgactttgtggttgagtacatcgacagcaaccatacgaaaaaaactgtcccagttaaggcccaggctcagcctatacagctgacagacctctatcccgggatgacatacacgttgcgggtttattcccgggacaacgagggcatcagcagtaccgtcatcacctttatgaccagtacagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggagaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacttctagagagaagaaaaaggctgggtttggacttcatgcctcctcactggtgaaacccaggatgtagatagagggccacacccaccctgtccagagtagagggcacctgtccacgtggccagggcccatgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaaggtattagcaatgcttgcatcattaataatcattcagttgaaggtcaagcccatagacacacactctctgctggtaagaaaccatagcccagaactgagccaataaggttgtttgaacctgagagtgtgtaatggtcatttgggccaagcctcagctagggctgctgcctggacgcctgaggggcagcttatcacagtgcaaggggacagggtaaacagcagggggtggggtgtgagcttggagggcccctcccctggatttcctccaacacctgcttggatactaggcccactgtccctgaagggaatgtcagggaagtgtgcctgtgagctgaattaaaggactggcctttccagaaaacgctttggatctgagcagagtagtcagtttctcagacactcattccatactgcaccgtacatgccagcgtacccattgcaccgaaagcaggcccttagggcaggaagggacgatgagcaagtctgccacaccacctggtgactgggaagggctgcttctctcgtaagggtcttggggagaagtaagcccgcagcctgcctctgcacctcgttccagtgtcctgccaggctctgtactgtcctttgtgtatgaagaaaatgctgttagccctctctcaggctgctgttctgtgggtgctgagagctgccccccatcaccacgccatcacacccctctgagcagaagcaaatctgaggctgaagaattaagttttccccaagcaaggaaggcaggtggtcagagagatcaaacgctgaggcgtggggattgcaggattcaggaggcagcccctttggggaagaggagggtgcattttccatggagcccatgtcagagtccactccagctcagcaggaaagtggaattgcccagtactgcctgccagctgggtctcccaagcaactaccccaagacataccaacagtgaagccaggacagcaccatgccatcggcgctccagtctgtctggctgggaggaaagtgctgggcatcttacagtaactctagaagttcctttgactaggctgcaatcccacctatatgctcagccctaagagctgtggtttcctgtgctctcatttgtccattcattcattcattcattcattcagcaaataatctgaaatccagtctgaactaaggcctgagctgtggataccatggcgcgtgagttagatgtggtccctgccctcatggggctgacagtcctaaaatcaagtgctaggacacagtggccattgagctgggagcattcttccctctaccgcttaagccactgatggctgcgagcttgaagagagggattctgagggagagcttggtccatctggtcaccaaggctgggcgggacagagcagtcaagaaccacggtgtggcttgagaaacagtcctgcttcctgagcctctttgctctgcctcttggggcaagctccttaacctgtctgtatttttatgcctctgtctcccattcagttcctccttgaatacctctttctacagagaggcacgggctcccctgaaggattgtcgaggccagggttcgggaagtacactgccatcggtcaggggacagctgcctcccaccttgcctgggtgatggtgaatgggactcatcttttcctgccttgcttttgaggagatggttgaatttaagctaacaggaaagccaaaccagcaccctcctttgtgctctgagaggttggagacatctggtccaccccattgcccctgcccctggcaagccctgaagtcgggagaggtgaccacaggtctgaaaatcagccagtgccaacattgcttgccctgcaaggtgcaactgagcccacatagcgcattcatagtttccctgaccacagccttgggaagacggtggaaacccgaggatgtgtgggtttcccagctaacggacaagctcccctgccacacccagtgcccacgcatgctcacatacatacagcagaccacaaccctgttgccaagcagtgcttccaagggatagcgatccagattccaacattgtcttggagagggttagtccacatccaagttgcgtgagataagatgcaaagggctctgtgtggatgaggaacgcaccttagaggagtgggaaaggccaccagggttgggccctgtttaggtaattcctgttggcagcacctagagagagcatctgagctgaaggagtgggaaactttgcccaagcaatggcacgggcagcgggctctttctggcgccctgtgctggagcagggccaagtcttagggcatcacaaacagcccatttgatggagggagcagggacatagcacatttttgtctgtctttgtgaggctgctttgctaactctctgaggagaggaagcctctcgggctttccgtcggctggggctagtgccagagaatcccttctcagtggccagcaggttcctgggaggccggcacaaggcaccgctccccactcatgacaccttggtgcagagtgacctcctgcccagtcaccactccggccagccccagccaaacacacaaaagcccatggttgcggttgcatctacaccgttagttggcaaaggatcctgcttgagctctgcgtggtggccaaggagtagcatggaggagggccctgattttaaaaaggaaaaatagagaggcctcaaaacaatgaaacaaagagcttgatatgtcaagaggagaccaaggccctgggaggcataggcaagccgggcagagtcagaccagtgccctcccttgaccatctcctagcattccttaacctagacaggggctaccccatgtgagtccaagccagactttgtggctgtccccagcctgcacagcccaagcccagggaagtgtcctttctttcccttccttactaataatgggccttcctgagacacattcagagaaggatcagagagaaaggagaaccatccaggagagccacaagcgtccaccaaacagtgtctcaggcctcacctgaagctgctgttcctcctatcagcacactagtattaaatgggtgttccataatgaggagaatggaaataggtacaaggcatctagcttaggacagaatcggatttcggcatgtgaaggaatcccagagctgatctcattgaaatgatctatcgtacagacaaggatatgcaaatccacagaagtgaagggatttttgctcaagatcacatagctggtaaactaaggtaaggttagggcttgaacttgggccttctgactccttgtccagtcagtgttctttcatctcaccacagctgcctcctttgaaacagaggtattaagatctgtccttctggttcaccctctcatacctctttactgcgtctcccacatcccccacatgcctcccaaaatgaaagacaaacaggattgtttctgagaccaagatcagtctgtctgtgatcagcctgtgtgtggttcacccagtcatgcaattaagggcagatctgggccagtggaataggatagctgattggtgtttgttactgtgaaccctagaccgtaccccgtagaatggtgtctcttgctttgtaacacatcgggccttcagtgtgctgtattcctcagaagtgagggcatctcggtccattctgcccatggccacagggtgcagagaggcagcagggcccatgcaagctgccaccctgggatttgctgggctggagttcaacagatgtaaagacttcagtgaagcaataaacacaaaactctgggagaagatatccagaattttgtacattactctgtttctttttcaaaaatgaggcagatcagatgcccctgagctgcccctttttttctgattcccaactgcaatgtcctcagtcagtgttgtccctctgcccggctccccagctctttgccaacctcttcacactccccttgagctgagcatcagtcgcctgtgacgtggccaccttctgtcctgctcccactcccgacccatgctggaccccggaggacctcctgccccgcccccaccacacacccatatcccccaccattccaatttgttctttcccgtggggaattttttttcccagcgtctccatcccttcctacatatccacacacacacaaattggtctgatcttttttccattggttaaacatttaactccatgccagaccttgttttaacccctctcacatcatgttctttccttttttgcgagttattttgcattaaccaactttgtcagtgacagatgcgtatctgagggtgtcacacacgaccttcagcagggaagacttctgggccatggagggccgtctaatacatggacttataaactgactgcatgagcaatgaaaaggccaaattattctgaattttttttgaatcactgtaaaaaaactgatttcttttgtatagagaacactaaacgtataataaaagttgttcaaaatgg

SEQ ID NO: 5211 - DNA, 10609 bp, Homo sapiens
gcacgggctggtctctgccctaatgcggcggctggcggcgagaggcgctgcaggggacgcgggggaagtggcggcgccggcagcggacagctcggacagcgcccagggccggagcccgagcccttggaggttgattgacttatgtgcaatttgggacgctggagtttaccttccctccgcagcctggaacagagcctcctctggtgttgcaaggaagaggctgaatgaggcagagaagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatctttctatagaaacaacagtgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccacccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagattatcccagggctgcgcccactgaagttaaagtccgagtcatgaacagcacagccatcagccttcagtggaaccgcgtctactccgacacggtccagggccagctcagagagtaccgagcctactactggagggagagcagcttgctgaagaacctgtgggtgtctcagaagagacagcaagccagcttccctggtgaccgcctccgtggcgtggtgtcccgcctcttcccctacagtaactacaagctggagatggttgtggtcaatgggagaggtgatgggcctcgcagtgagaccaaggagttcaccaccccggaaggagtacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaaggtaggtgcatggcagcagcccctggggtaaaaggtcccagcgtgggtgcgacgggcgctgtgagcagtaccgatgctactgccattgctgccaccaccgaagccacaacagtccccatcatcccaactgtcgcacctaccaccatcgccaccaccaccaccgtcgccacaactactacaaccactgctgccgccaccaccaccacggagagtcctcccaccaccacctccgggactaagatacacgaatccgcccctgatgagcagtccatatggaacgtcacggtgctccccaacagtaaatgggccaacatcacctggaagcacaatttcgggcccggaactgactttgtggttgagtacatcgacagcaaccatacgaaaaaaactgtcccagttaaggcccaggctcagcctatacagctgacagacctctatcccgggatgacatacacgttgcgggtttattcccgggacaacgagggcatcagcagtaccgtcatcacctttatgaccagtacagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggagaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacttctagagagaagaaaaaggctgggtttggacttcatgcctcctcactggtgaaacccaggatgtagatagagggccacacccaccctgtccagagtagagggcacctgtccacgtggccagggcccatgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaaggtattagcaatgcttgcatcattaataatcattcagttgaaggtcaagcccatagacacacactctctgctggtaagaaaccatagcccagaactgagccaataaggttgtttgaacctgagagtgtgtaatggtcatttgggccaagcctcagctagggctgctgcctggacgcctgaggggcagcttatcacagtgcaaggggacagggtaaacagcagggggtggggtgtgagcttggagggcccctcccctggatttcctccaacacctgcttggatactaggcccactgtccctgaagggaatgtcagggaagtgtgcctgtgagctgaattaaaggactggcctttccagaaaacgctttggatctgagcagagtagtcagtttctcagacactcattccatactgcaccgtacatgccagcgtacccattgcaccgaaagcaggcccttagggcaggaagggacgatgagcaagtctgccacaccacctggtgactgggaagggctgcttctctcgtaagggtcttggggagaagtaagcccgcagcctgcctctgcacctcgttccagtgtcctgccaggctctgtactgtcctttgtgtatgaagaaaatgctgttagccctctctcaggctgctgttctgtgggtgctgagagctgccccccatcaccacgccatcacacccctctgagcagaagcaaatctgaggctgaagaattaagttttccccaagcaaggaaggcaggtggtcagagagatcaaacgctgaggcgtggggattgcaggattcaggaggcagcccctttggggaagaggagggtgcattttccatggagcccatgtcagagtccactccagctcagcaggaaagtggaattgcccagtactgcctgccagctgggtctcccaagcaactaccccaagacataccaacagtgaagccaggacagcaccatgccatcggcgctccagtctgtctggctgggaggaaagtgctgggcatcttacagtaactctagaagttcctttgactaggctgcaatcccacctatatgctcagccctaagagctgtggtttcctgtgctctcatttgtccattcattcattcattcattcattcagcaaataatctgaaatccagtctgaactaaggcctgagctgtggataccatggcgcgtgagttagatgtggtccctgccctcatggggctgacagtcctaaaatcaagtgctaggacacagtggccattgagctgggagcattcttccctctaccgcttaagccactgatggctgcgagcttgaagagagggattctgagggagagcttggtccatctggtcaccaaggctgggcgggacagagcagtcaagaaccacggtgtggcttgagaaacagtcctgcttcctgagcctctttgctctgcctcttggggcaagctccttaacctgtctgtatttttatgcctctgtctcccattcagttcctccttgaatacctctttctacagagaggcacgggctcccctgaaggattgtcgaggccagggttcgggaagtacactgccatcggtcaggggacagctgcctcccaccttgcctgggtgatggtgaatgggactcatcttttcctgccttgcttttgaggagatggttgaatttaagctaacaggaaagccaaaccagcaccctcctttgtgctctgagaggttggagacatctggtccaccccattgcccctgcccctggcaagccctgaagtcgggagaggtgaccacaggtctgaaaatcagccagtgccaacattgcttgccctgcaaggtgcaactgagcccacatagcgcattcatagtttccctgaccacagccttgggaagacggtggaaacccgaggatgtgtgggtttcccagctaacggacaagctcccctgccacacccagtgcccacgcatgctcacatacatacagcagaccacaaccctgttgccaagcagtgcttccaagggatagcgatccagattccaacattgtcttggagagggttagtccacatccaagttgcgtgagataagatgcaaagggctctgtgtggatgaggaacgcaccttagaggagtgggaaaggccaccagggttgggccctgtttaggtaattcctgttggcagcacctagagagagcatctgagctgaaggagtgggaaactttgcccaagcaatggcacgggcagcgggctctttctggcgccctgtgctggagcagggccaagtcttagggcatcacaaacagcccatttgatggagggagcagggacatagcacatttttgtctgtctttgtgaggctgctttgctaactctctgaggagaggaagcctctcgggctttccgtcggctggggctagtgccagagaatcccttctcagtggccagcaggttcctgggaggccggcacaaggcaccgctccccactcatgacaccttggtgcagagtgacctcctgcccagtcaccactccggccagccccagccaaacacacaaaagcccatggttgcggttgcatctacaccgttagttggcaaaggatcctgcttgagctctgcgtggtggccaaggagtagcatggaggagggccctgattttaaaaaggaaaaatagagaggcctcaaaacaatgaaacaaagagcttgatatgtcaagaggagaccaaggccctgggaggcataggcaagccgggcagagtcagaccagtgccctcccttgaccatctcctagcattccttaacctagacaggggctaccccatgtgagtccaagccagactttgtggctgtccccagcctgcacagcccaagcccagggaagtgtcctttctttcccttccttactaataatgggccttcctgagacacattcagagaaggatcagagagaaaggagaaccatccaggagagccacaagcgtccaccaaacagtgtctcaggcctcacctgaagctgctgttcctcctatcagcacactagtattaaatgggtgttccataatgaggagaatggaaataggtacaaggcatctagcttaggacagaatcggatttcggcatgtgaaggaatcccagagctgatctcattgaaatgatctatcgtacagacaaggatatgcaaatccacagaagtgaagggatttttgctcaagatcacatagctggtaaactaaggtaaggttagggcttgaacttgggccttctgactccttgtccagtcagtgttctttcatctcaccacagctgcctcctttgaaacagaggtattaagatctgtccttctggttcaccctctcatacctctttactgcgtctcccacatcccccacatgcctcccaaaatgaaagacaaacaggattgtttctgagaccaagatcagtctgtctgtgatcagcctgtgtgtggttcacccagtcatgcaattaagggcagatctgggccagtggaataggatagctgattggtgtttgttactgtgaaccctagaccgtaccccgtagaatggtgtctcttgctttgtaacacatcgggccttcagtgtgctgtattcctcagaagtgagggcatctcggtccattctgcccatggccacagggtgcagagaggcagcagggcccatgcaagctgccaccctgggatttgctgggctggagttcaacagatgtaaagacttcagtgaagcaataaacacaaaactctgggagaagatatccagaattttgtacattactctgtttctttttcaaaaatgaggcagatcagatgcccctgagctgcccctttttttctgattcccaactgcaatgtcctcagtcagtgttgtccctctgcccggctccccagctctttgccaacctcttcacactccccttgagctgagcatcagtcgcctgtgacgtggccaccttctgtcctgctcccactcccgacccatgctggaccccggaggacctcctgccccgcccccaccacacacccatatcccccaccattccaatttgttctttcccgtggggaattttttttcccagcgtctccatcccttcctacatatccacacacacacaaattggtctgatcttttttccattggttaaacatttaactccatgccagaccttgttttaacccctctcacatcatgttctttccttttttgcgagttattttgcattaaccaactttgtcagtgacagatgcgtatctgagggtgtcacacacgaccttcagcagggaagacttctgggccatggagggccgtctaatacatggacttataaactgactgcatgagcaatgaaaaggccaaattattctgaattttttttgaatcactgtaaaaaaactgatttcttttgtatagagaacactaaacgtataataaaagttgttcaaaatgg

SEQ ID NO: 5212 - DNA, 10654 bp, Homo sapiens
gcacgggctggtctctgccctaatgcggcggctggcggcgagaggcgctgcaggggacgcgggggaagtggcggcgccggcagcggacagctcggacagcgcccagggccggagcccgagcccttggaggttgattgacttatgtgcaatttgggacgctggagtttaccttccctccgcagcctggaacagagcctcctctggtgttgcaaggaagaggctgaatgaggcagagaagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatcctaaccctcaacataggttgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccacccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctagctgatcaggccactccaactaaccgtttggctgccctgcccaaaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagattatcccagggctgcgcccactgaagttaaagtccgagtcatgaacagcacagccatcagccttcagtggaaccgcgtctactccgacacggtccagggccagctcagagagtaccgagcctactactggagggagagcagcttgctgaagaacctgtgggtgtctcagaagagacagcaagccagcttccctggtgaccgcctccgtggcgtggtgtcccgcctcttcccctacagtaactacaagctggagatggttgtggtcaatgggagaggtgatgggcctcgcagtgagaccaaggagttcaccaccccggaaggagtacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaaggtagcccagtcatgtctcctcccacattgcccccgactaccgtgggtgcgacgggcgctgtgagcagtaccgatgctactgccattgctgccaccaccgaagccacaacagtccccatcatcccaactgtcgcacctaccaccatcgccaccaccaccaccgtcgccacaactactacaaccactgctgccgccaccaccaccacggagagtcctcccaccaccacctccgggactaagatacacgaatccgcccctgatgagcagtccatatggaacgtcacggtgctccccaacagtaaatgggccaacatcacctggaagcacaatttcgggcccggaactgactttgtggttgagtacatcgacagcaaccatacgaaaaaaactgtcccagttaaggcccaggctcagcctatacagctgacagacctctatcccgggatgacatacacgttgcgggtttattcccgggacaacgagggcatcagcagtaccgtcatcacctttatgaccagtacagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggagaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacttctagagagaagaaaaaggctgggtttggacttcatgcctcctcactggtgaaacccaggatgtagatagagggccacacccaccctgtccagagtagagggcacctgtccacgtggccagggcccatgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaaggtattagcaatgcttgcatcattaataatcattcagttgaaggtcaagcccatagacacacactctctgctggtaagaaaccatagcccagaactgagccaataaggttgtttgaacctgagagtgtgtaatggtcatttgggccaagcctcagctagggctgctgcctggacgcctgaggggcagcttatcacagtgcaaggggacagggtaaacagcagggggtggggtgtgagcttggagggcccctcccctggatttcctccaacacctgcttggatactaggcccactgtccctgaagggaatgtcagggaagtgtgcctgtgagctgaattaaaggactggcctttccagaaaacgctttggatctgagcagagtagtcagtttctcagacactcattccatactgcaccgtacatgccagcgtacccattgcaccgaaagcaggcccttagggcaggaagggacgatgagcaagtctgccacaccacctggtgactgggaagggctgcttctctcgtaagggtcttggggagaagtaagcccgcagcctgcctctgcacctcgttccagtgtcctgccaggctctgtactgtcctttgtgtatgaagaaaatgctgttagccctctctcaggctgctgttctgtgggtgctgagagctgccccccatcaccacgccatcacacccctctgagcagaagcaaatctgaggctgaagaattaagttttccccaagcaaggaaggcaggtggtcagagagatcaaacgctgaggcgtggggattgcaggattcaggaggcagcccctttggggaagaggagggtgcattttccatggagcccatgtcagagtccactccagctcagcaggaaagtggaattgcccagtactgcctgccagctgggtctcccaagcaactaccccaagacataccaacagtgaagccaggacagcaccatgccatcggcgctccagtctgtctggctgggaggaaagtgctgggcatcttacagtaactctagaagttcctttgactaggctgcaatcccacctatatgctcagccctaagagctgtggtttcctgtgctctcatttgtccattcattcattcattcattcattcagcaaataatctgaaatccagtctgaactaaggcctgagctgtggataccatggcgcgtgagttagatgtggtccctgccctcatggggctgacagtcctaaaatcaagtgctaggacacagtggccattgagctgggagcattcttccctctaccgcttaagccactgatggctgcgagcttgaagagagggattctgagggagagcttggtccatctggtcaccaaggctgggcgggacagagcagtcaagaaccacggtgtggcttgagaaacagtcctgcttcctgagcctctttgctctgcctcttggggcaagctccttaacctgtctgtatttttatgcctctgtctcccattcagttcctccttgaatacctctttctacagagaggcacgggctcccctgaaggattgtcgaggccagggttcgggaagtacactgccatcggtcaggggacagctgcctcccaccttgcctgggtgatggtgaatgggactcatcttttcctgccttgcttttgaggagatggttgaatttaagctaacaggaaagccaaaccagcaccctcctttgtgctctgagaggttggagacatctggtccaccccattgcccctgcccctggcaagccctgaagtcgggagaggtgaccacaggtctgaaaatcagccagtgccaacattgcttgccctgcaaggtgcaactgagcccacatagcgcattcatagtttccctgaccacagccttgggaagacggtggaaacccgaggatgtgtgggtttcccagctaacggacaagctcccctgccacacccagtgcccacgcatgctcacatacatacagcagaccacaaccctgttgccaagcagtgcttccaagggatagcgatccagattccaacattgtcttggagagggttagtccacatccaagttgcgtgagataagatgcaaagggctctgtgtggatgaggaacgcaccttagaggagtgggaaaggccaccagggttgggccctgtttaggtaattcctgttggcagcacctagagagagcatctgagctgaaggagtgggaaactttgcccaagcaatggcacgggcagcgggctctttctggcgccctgtgctggagcagggccaagtcttagggcatcacaaacagcccatttgatggagggagcagggacatagcacatttttgtctgtctttgtgaggctgctttgctaactctctgaggagaggaagcctctcgggctttccgtcggctggggctagtgccagagaatcccttctcagtggccagcaggttcctgggaggccggcacaaggcaccgctccccactcatgacaccttggtgcagagtgacctcctgcccagtcaccactccggccagccccagccaaacacacaaaagcccatggttgcggttgcatctacaccgttagttggcaaaggatcctgcttgagctctgcgtggtggccaaggagtagcatggaggagggccctgattttaaaaaggaaaaatagagaggcctcaaaacaatgaaacaaagagcttgatatgtcaagaggagaccaaggccctgggaggcataggcaagccgggcagagtcagaccagtgccctcccttgaccatctcctagcattccttaacctagacaggggctaccccatgtgagtccaagccagactttgtggctgtccccagcctgcacagcccaagcccagggaagtgtcctttctttcccttccttactaataatgggccttcctgagacacattcagagaaggatcagagagaaaggagaaccatccaggagagccacaagcgtccaccaaacagtgtctcaggcctcacctgaagctgctgttcctcctatcagcacactagtattaaatgggtgttccataatgaggagaatggaaataggtacaaggcatctagcttaggacagaatcggatttcggcatgtgaaggaatcccagagctgatctcattgaaatgatctatcgtacagacaaggatatgcaaatccacagaagtgaagggatttttgctcaagatcacatagctggtaaactaaggtaaggttagggcttgaacttgggccttctgactccttgtccagtcagtgttctttcatctcaccacagctgcctcctttgaaacagaggtattaagatctgtccttctggttcaccctctcatacctctttactgcgtctcccacatcccccacatgcctcccaaaatgaaagacaaacaggattgtttctgagaccaagatcagtctgtctgtgatcagcctgtgtgtggttcacccagtcatgcaattaagggcagatctgggccagtggaataggatagctgattggtgtttgttactgtgaaccctagaccgtaccccgtagaatggtgtctcttgctttgtaacacatcgggccttcagtgtgctgtattcctcagaagtgagggcatctcggtccattctgcccatggccacagggtgcagagaggcagcagggcccatgcaagctgccaccctgggatttgctgggctggagttcaacagatgtaaagacttcagtgaagcaataaacacaaaactctgggagaagatatccagaattttgtacattactctgtttctttttcaaaaatgaggcagatcagatgcccctgagctgcccctttttttctgattcccaactgcaatgtcctcagtcagtgttgtccctctgcccggctccccagctctttgccaacctcttcacactccccttgagctgagcatcagtcgcctgtgacgtggccaccttctgtcctgctcccactcccgacccatgctggaccccggaggacctcctgccccgcccccaccacacacccatatcccccaccattccaatttgttctttcccgtggggaattttttttcccagcgtctccatcccttcctacatatccacacacacacaaattggtctgatcttttttccattggttaaacatttaactccatgccagaccttgttttaacccctctcacatcatgttctttccttttttgcgagttattttgcattaaccaactttgtcagtgacagatgcgtatctgagggtgtcacacacgaccttcagcagggaagacttctgggccatggagggccgtctaatacatggacttataaactgactgcatgagcaatgaaaaggccaaattattctgaattttttttgaatcactgtaaaaaaactgatttcttttgtatagagaacactaaacgtataataaaagttgttcaaaatgg

SEQ ID NO: 5213 - DNA, 10205 bp, Homo sapiens
gttgattgacttatgtgcaatttgggacgctggagtttaccttccctccgcagcctggaacagagcctcctctggtgttgcaaggaagaggctgaatgaggcagagaagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatccaagcattcagaatgagctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccacccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctagctgatcaggccactccaactaaccgtttggctgccctgcccaaaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagatttacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagctactccaaccgcagctcctcccacattgcccccgactaccgtgggtgcgacgggcgctgtgagcagtaccgatgctactgccattgctgccaccaccgaagccacaacagtccccatcatcccaactgtcgcacctaccaccatcgccaccaccaccaccgtcgccacaactactacaaccactgctgccgccaccaccaccacggagagtcctcccaccaccacctccgggactaagatacacgaatccgcccctgatgagcagtccatatggaacgtcacggtgctccccaacagtaaatgggccaacatcacctggaagcacaatttcgggcccggaactgactttgtggttgagtacatcgacagcaaccatacgaaaaaaactgtcccagttaaggcccaggctcagcctatacagctgacagacctctatcccgggatgacatacacgttgcgggtttattcccgggacaacgagggcatcagcagtaccgtcatcacctttatgaccagtacagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggagaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacttctagagagaagaaaaaggctgggtttggacttcatgcctcctcactggtgaaacccaggatgtagatagagggccacacccaccctgtccagagtagagggcacctgtccacgtggccagggcccatgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaaggtattagcaatgcttgcatcattaataatcattcagttgaaggtcaagcccatagacacacactctctgctggtaagaaaccatagcccagaactgagccaataaggttgtttgaacctgagagtgtgtaatggtcatttgggccaagcctcagctagggctgctgcctggacgcctgaggggcagcttatcacagtgcaaggggacagggtaaacagcagggggtggggtgtgagcttggagggcccctcccctggatttcctccaacacctgcttggatactaggcccactgtccctgaagggaatgtcagggaagtgtgcctgtgagctgaattaaaggactggcctttccagaaaacgctttggatctgagcagagtagtcagtttctcagacactcattccatactgcaccgtacatgccagcgtacccattgcaccgaaagcaggcccttagggcaggaagggacgatgagcaagtctgccacaccacctggtgactgggaagggctgcttctctcgtaagggtcttggggagaagtaagcccgcagcctgcctctgcacctcgttccagtgtcctgccaggctctgtactgtcctttgtgtatgaagaaaatgctgttagccctctctcaggctgctgttctgtgggtgctgagagctgccccccatcaccacgccatcacacccctctgagcagaagcaaatctgaggctgaagaattaagttttccccaagcaaggaaggcaggtggtcagagagatcaaacgctgaggcgtggggattgcaggattcaggaggcagcccctttggggaagaggagggtgcattttccatggagcccatgtcagagtccactccagctcagcaggaaagtggaattgcccagtactgcctgccagctgggtctcccaagcaactaccccaagacataccaacagtgaagccaggacagcaccatgccatcggcgctccagtctgtctggctgggaggaaagtgctgggcatcttacagtaactctagaagttcctttgactaggctgcaatcccacctatatgctcagccctaagagctgtggtttcctgtgctctcatttgtccattcattcattcattcattcattcagcaaataatctgaaatccagtctgaactaaggcctgagctgtggataccatggcgcgtgagttagatgtggtccctgccctcatggggctgacagtcctaaaatcaagtgctaggacacagtggccattgagctgggagcattcttccctctaccgcttaagccactgatggctgcgagcttgaagagagggattctgagggagagcttggtccatctggtcaccaaggctgggcgggacagagcagtcaagaaccacggtgtggcttgagaaacagtcctgcttcctgagcctctttgctctgcctcttggggcaagctccttaacctgtctgtatttttatgcctctgtctcccattcagttcctccttgaatacctctttctacagagaggcacgggctcccctgaaggattgtcgaggccagggttcgggaagtacactgccatcggtcaggggacagctgcctcccaccttgcctgggtgatggtgaatgggactcatcttttcctgccttgcttttgaggagatggttgaatttaagctaacaggaaagccaaaccagcaccctcctttgtgctctgagaggttggagacatctggtccaccccattgcccctgcccctggcaagccctgaagtcgggagaggtgaccacaggtctgaaaatcagccagtgccaacattgcttgccctgcaaggtgcaactgagcccacatagcgcattcatagtttccctgaccacagccttgggaagacggtggaaacccgaggatgtgtgggtttcccagctaacggacaagctcccctgccacacccagtgcccacgcatgctcacatacatacagcagaccacaaccctgttgccaagcagtgcttccaagggatagcgatccagattccaacattgtcttggagagggttagtccacatccaagttgcgtgagataagatgcaaagggctctgtgtggatgaggaacgcaccttagaggagtgggaaaggccaccagggttgggccctgtttaggtaattcctgttggcagcacctagagagagcatctgagctgaaggagtgggaaactttgcccaagcaatggcacgggcagcgggctctttctggcgccctgtgctggagcagggccaagtcttagggcatcacaaacagcccatttgatggagggagcagggacatagcacatttttgtctgtctttgtgaggctgctttgctaactctctgaggagaggaagcctctcgggctttccgtcggctggggctagtgccagagaatcccttctcagtggccagcaggttcctgggaggccggcacaaggcaccgctccccactcatgacaccttggtgcagagtgacctcctgcccagtcaccactccggccagccccagccaaacacacaaaagcccatggttgcggttgcatctacaccgttagttggcaaaggatcctgcttgagctctgcgtggtggccaaggagtagcatggaggagggccctgattttaaaaaggaaaaatagagaggcctcaaaacaatgaaacaaagagcttgatatgtcaagaggagaccaaggccctgggaggcataggcaagccgggcagagtcagaccagtgccctcccttgaccatctcctagcattccttaacctagacaggggctaccccatgtgagtccaagccagactttgtggctgtccccagcctgcacagcccaagcccagggaagtgtcctttctttcccttccttactaataatgggccttcctgagacacattcagagaaggatcagagagaaaggagaaccatccaggagagccacaagcgtccaccaaacagtgtctcaggcctcacctgaagctgctgttcctcctatcagcacactagtattaaatgggtgttccataatgaggagaatggaaataggtacaaggcatctagcttaggacagaatcggatttcggcatgtgaaggaatcccagagctgatctcattgaaatgatctatcgtacagacaaggatatgcaaatccacagaagtgaagggatttttgctcaagatcacatagctggtaaactaaggtaaggttagggcttgaacttgggccttctgactccttgtccagtcagtgttctttcatctcaccacagctgcctcctttgaaacagaggtattaagatctgtccttctggttcaccctctcatacctctttactgcgtctcccacatcccccacatgcctcccaaaatgaaagacaaacaggattgtttctgagaccaagatcagtctgtctgtgatcagcctgtgtgtggttcacccagtcatgcaattaagggcagatctgggccagtggaataggatagctgattggtgtttgttactgtgaaccctagaccgtaccccgtagaatggtgtctcttgctttgtaacacatcgggccttcagtgtgctgtattcctcagaagtgagggcatctcggtccattctgcccatggccacagggtgcagagaggcagcagggcccatgcaagctgccaccctgggatttgctgggctggagttcaacagatgtaaagacttcagtgaagcaataaacacaaaactctgggagaagatatccagaattttgtacattactctgtttctttttcaaaaatgaggcagatcagatgcccctgagctgcccctttttttctgattcccaactgcaatgtcctcagtcagtgttgtccctctgcccggctccccagctctttgccaacctcttcacactccccttgagctgagcatcagtcgcctgtgacgtggccaccttctgtcctgctcccactcccgacccatgctggaccccggaggacctcctgccccgcccccaccacacacccatatcccccaccattccaatttgttctttcccgtggggaattttttttcccagcgtctccatcccttcctacatatccacacacacacaaattggtctgatcttttttccattggttaaacatttaactccatgccagaccttgttttaacccctctcacatcatgttctttccttttttgcgagttattttgcattaaccaactttgtcagtgacagatgcgtatctgagggtgtcacacacgaccttcagcagggaagacttctgggccatggagggccgtctaatacatggacttataaactgactgcatgagcaatgaaaaggccaaattattctgaattttttttgaatcactgtaaaaaaactgatttcttttgtatagagaacactaaacgtataataaaagttgttcaaaatgga

SEQ ID NO: 5214 - DNA, 2462 bp, Homo sapiens
gaggcgctgcaggggacgcgggggaagtggcggcgccggcagcggacagctcggacagcgcccagggccggagcccgagcccttggaggttgattgacttatgtgcaatttgggacgctggagtttaccttccctccgcagcctggaacagagcctcctctggtgttgcaaggaagaggctgaatgaggcagagaagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatccaagcattcagaatgagctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccacccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctaggtaactgcccatgctcaccctggcactgaccagccccaccccctccccagcagccagagaagcagtggcccggggcagttccgagggcagtgcctgcagtcaagtggccgggtcaggcgtggtgatctcttcttgcctcgtgatgtcagggttagggagctgccagtttcagaacaagctgtgctggacaggttacctcctgagtggagtcattaacttccccacgtctcaactgaaaggggcctgagtgatatagagaaagtggagaggggtttctcgttgtgatcattttacctttcttacagctaactccaccactaagtcaattaaaacaatccatcctt

SEQ ID NO: 5215 - DNA, 5447 bp, Homo sapiens
ctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccaaccacccttataatgactcgtccttaagaaaccaccctgacatgtacagtgcccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagattatcccagggctgcgcccactgaagttaaagtccgagtcatgaacagcacagccatcagccttcagtggaaccgcgtctactccgacacggtccagggccagctcagagagtaccgagcctactactggagggagagcagcttgctgaagaacctgtgggtgtctcagaagagacagcaagccagcttccctggtgaccgcctccgtggcgtggtgtcccgcctcttcccctacagtaactacaagctggagatggttgtggtcaatgggagaggtgatgggcctcgcagtgagaccaaggagttcaccaccccggaaggagtacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagctactccaaccgcagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggagaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacttctagagagaagaaaaaggctgggtttggacttcatgcctcctcactggtgaaacccaggatgtagatagagggccacacccaccctgtccagagtagagggcacctgtccacgtggccagggcccatgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaa

SEQ ID NO: 5216 - DNA, 5330 bp, Homo sapiens
atcgaaattcctatggatctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccaaccacccttataatgactcgtccttaagaaaccaccctgacatgtacagtgcccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctagctgatcaggccactccaactaaccgtttggctgccctgcccaaaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagattatcccagggctgcgcccactgaagttaaagtccgagtcatgaacagcacagccatcagccttcagtggaaccgcgtctactccgacacggtccagggccagctcagagagtaccgagcctactactggagggagagcagcttgctgaagaacctgtgggtgtctcagaagagacagcaagccagcttccctggtgaccgcctccgtggcgtggtgtcccgcctcttcccctacagtaactacaagctggagatggttgtggtcaatgggagaggtgatgggcctcgcagtgagaccaaggagttcaccaccccggaaggagtacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagctactccaaccgcagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggagaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacttctagagagaagaaaaaggctgggtttggacttcatgcctcctcactggtgaaacccaggatgtagatagagggccacacccaccctgtccagagtagagggcacctgtccacgtggccagggcccatgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaa

SEQ ID NO: 5217 - DNA, 1105 bp, Homo sapiens
atgcggcggctggcggcgagaggcgctgcaggggacgcgggggaagtggcggcgccggcagcggacagctcggacagcgcccagggccggagcccgagcccttggagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatccaagcattcagaatgagctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccacccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtat

SEQ ID NO: 5218 - DNA, 573 bp, Homo sapiens
ttctagaagacaatgactggttgaccccacaccggccaggaagctgggtttctctccctgagtgtgggggaggccgaggtcctgaagcaggctgctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatccaagcattcagaatgagctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaa

SEQ ID NO: 5219 - DNA, 3974 bp, Homo sapiens
taaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccaaccacccttataatgactcgtccttaagaaaccaccctgacatgtacagtgcccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagattatcccagggctgcgcccactgaagttaaagtccgagtcatgaacagcacagccatcagccttcagtggaaccgcgtctactccgacacggtccagggccagctcagagagtaccgagcctactactggagggagagcagcttgctgaagaacctgtgggtgtctcagaagagacagcaagccagcttccctggtgaccgcctccgtggcgtggtgtcccgcctcttcccctacagtaactacaagctggagatggttgtggtcaatgggagaggtgatgggcctcgcagtgagaccaaggagttcaccaccccggaaggagtacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatg

SEQ ID NO: 5220 - DNA, 10135 bp, Homo sapiens
gcacgggctggtctctgccctaatgcggcggctggcggcgagaggcgctgcaggggacgcgggggaagtggcggcgccggcagcggacagctcggacagcgcccagggccggagcccgagcccttggaggttgattgacttatgtgcaatttgggacgctggagtttaccttccctccgcagcctggaacagagcctcctctggtgttgcaaggaagaggctgaatgaggcagagaagctgagtgctgtccaggaggcccagttaaagcggctcgaggtgacaagaccccgagtgctggggagcagggagcagggccaggtgccgaggatggccaggcagccaccgccgccctgggtccatgcagccttcctcctctgcctcctcagtcttggcggagccatcgaaattcctatggatctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccaaccacccttataatgactcgtccttaagaaaccaccctgacatgtacagtgcccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagattatcccagggctgcgcccactgaagttaaagtccgagtcatgaacagcacagccatcagccttcagtggaaccgcgtctactccgacacggtccagggccagctcagagagtaccgagcctactactggagggagagcagcttgctgaagaacctgtgggtgtctcagaagagacagcaagccagcttccctggtgaccgcctccgtggcgtggtgtcccgcctcttcccctacagtaactacaagctggagatggttgtggtcaatgggagaggtgatgggcctcgcagtgagaccaaggagttcaccaccccggaaggagtacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagctactccaaccgcagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagaaaagaaggatgttccccttggccctgaagaccccaaggaagaggatggctcatttgactatagtgatgaggacaacaagcccctgcagggcagtcagacatctctggacggcaccatcaagcagcaggagagtgacgacagcctggtggactatggcgagggtggcgagggtcagttcaatgaagacggctccttcatcggccagtacacggtcaaaaaggacaaggaggaaacagagggcaacgaaagctcagaggccacgtcacctgtcaatgctatctactctctggcctaacggagcccacccaggcacagccaccactttgcaagtgggaggaggggagaaggggagacaaaaccactgcagacctaccacgaagccaccaccaccttcagtaacaagggtacgatatgggggtctgccaagctgtgaggaccagtagccaccaagccacccacaagccccctcccaatgaccccccttcagccccgggtgccaccagtgtgggagagctggagccgtggctgagctcagctggagggagcctggccccttgcccggtctcgcagccaccccgagcgttccaccacactgtccgcccttggcctcggcacacgctcaccttttctgttggttacgggacttctcattgtcttaatttcgctttgtgcatcttcccctccagacccaatgtctctgttttcttttccttttgaaaaagagtccctggaaaagaaagaataagtggattctcccccaggagaatcctttttgcaaagataggcaaaaaggattgaatccataccagaacacgtagacaggctgtaatattcaaaccacctctgggccaatgcatttccaaaggatgcctttctcgccatatgcctcccctggcccccagcccctctgcctcggccttgtcagttgctgagctgggcttggctcctttctggaaaatgacagtatttttggcagggagaaggtgcgcaggcctccttgctgctctctggtttggttgggaggtgtgtttacctcttgctcctcattcctcccctgcccttttctctggaatatctaagatgtgagctgcattgactctgaagacgtttgaggaacaggagtgggcactgatagaaaggacttcaacgccagtgactgtgtacctccagcagaagaaaatcaggtgtctggtcttgggggcactgtgctcacttctagagagaagaaaaaggctgggtttggacttcatgcctcctcactggtgaaacccaggatgtagatagagggccacacccaccctgtccagagtagagggcacctgtccacgtggccagggcccatgctgccaccctcgaggagatggaaccctgtgatgcaaaagctttgctggtgtgtttggggcataaggcactgctccccttccatctctagcagatatcatcttctcagccaattctgtaggacactgaggctcttgtttgacatggtgtgtggatggggacttgccccaagactgagcaggtctgccctttcattggggtgtatacatatcaggggaccctgaggtggcaccgtactcagtgttgtgatgcccccacctagggaggactcaatgctctttgtatgccttatgcagcgctgatctgtccctggagttcccaggttcccagctccccccctgcaagccttgaagcctccagcaacgtctatctccaggagagcagggcagcctatgcaagtgttccggcaggaccagaagtggccactcaacacacgtcctcaccagtcaccccaaatggagacactcgcagacctgcagttctcagaccgaaggtgctgccttcatcctccccacctaatgcatttttgaaaccaaaggtacctagcctcagagacagagaaggagagggggagatcttgagtctaagaggaaccctttagctgtttctgcagctgaggtcagtttcaggagggtgaagctgatccccaggaatggatcagctgccatgggcacagcctccgatttgagcctctccggctgccagccagggggcctgggccagaccagggctctgtccttccgtgactttattaaagcaacatttgccacatgtttaagccgcaaaggtattagcaatgcttgcatcattaataatcattcagttgaaggtcaagcccatagacacacactctctgctggtaagaaaccatagcccagaactgagccaataaggttgtttgaacctgagagtgtgtaatggtcatttgggccaagcctcagctagggctgctgcctggacgcctgaggggcagcttatcacagtgcaaggggacagggtaaacagcagggggtggggtgtgagcttggagggcccctcccctggatttcctccaacacctgcttggatactaggcccactgtccctgaagggaatgtcagggaagtgtgcctgtgagctgaattaaaggactggcctttccagaaaacgctttggatctgagcagagtagtcagtttctcagacactcattccatactgcaccgtacatgccagcgtacccattgcaccgaaagcaggcccttagggcaggaagggacgatgagcaagtctgccacaccacctggtgactgggaagggctgcttctctcgtaagggtcttggggagaagtaagcccgcagcctgcctctgcacctcgttccagtgtcctgccaggctctgtactgtcctttgtgtatgaagaaaatgctgttagccctctctcaggctgctgttctgtgggtgctgagagctgccccccatcaccacgccatcacacccctctgagcagaagcaaatctgaggctgaagaattaagttttccccaagcaaggaaggcaggtggtcagagagatcaaacgctgaggcgtggggattgcaggattcaggaggcagcccctttggggaagaggagggtgcattttccatggagcccatgtcagagtccactccagctcagcaggaaagtggaattgcccagtactgcctgccagctgggtctcccaagcaactaccccaagacataccaacagtgaagccaggacagcaccatgccatcggcgctccagtctgtctggctgggaggaaagtgctgggcatcttacagtaactctagaagttcctttgactaggctgcaatcccacctatatgctcagccctaagagctgtggtttcctgtgctctcatttgtccattcattcattcattcattcattcagcaaataatctgaaatccagtctgaactaaggcctgagctgtggataccatggcgcgtgagttagatgtggtccctgccctcatggggctgacagtcctaaaatcaagtgctaggacacagtggccattgagctgggagcattcttccctctaccgcttaagccactgatggctgcgagcttgaagagagggattctgagggagagcttggtccatctggtcaccaaggctgggcgggacagagcagtcaagaaccacggtgtggcttgagaaacagtcctgcttcctgagcctctttgctctgcctcttggggcaagctccttaacctgtctgtatttttatgcctctgtctcccattcagttcctccttgaatacctctttctacagagaggcacgggctcccctgaaggattgtcgaggccagggttcgggaagtacactgccatcggtcaggggacagctgcctcccaccttgcctgggtgatggtgaatgggactcatcttttcctgccttgcttttgaggagatggttgaatttaagctaacaggaaagccaaaccagcaccctcctttgtgctctgagaggttggagacatctggtccaccccattgcccctgcccctggcaagccctgaagtcgggagaggtgaccacaggtctgaaaatcagccagtgccaacattgcttgccctgcaaggtgcaactgagcccacatagcgcattcatagtttccctgaccacagccttgggaagacggtggaaacccgaggatgtgtgggtttcccagctaacggacaagctcccctgccacacccagtgcccacgcatgctcacatacatacagcagaccacaaccctgttgccaagcagtgcttccaagggatagcgatccagattccaacattgtcttggagagggttagtccacatccaagttgcgtgagataagatgcaaagggctctgtgtggatgaggaacgcaccttagaggagtgggaaaggccaccagggttgggccctgtttaggtaattcctgttggcagcacctagagagagcatctgagctgaaggagtgggaaactttgcccaagcaatggcacgggcagcgggctctttctggcgccctgtgctggagcagggccaagtcttagggcatcacaaacagcccatttgatggagggagcagggacatagcacatttttgtctgtctttgtgaggctgctttgctaactctctgaggagaggaagcctctcgggctttccgtcggctggggctagtgccagagaatcccttctcagtggccagcaggttcctgggaggccggcacaaggcaccgctccccactcatgacaccttggtgcagagtgacctcctgcccagtcaccactccggccagccccagccaaacacacaaaagcccatggttgcggttgcatctacaccgttagttggcaaaggatcctgcttgagctctgcgtggtggccaaggagtagcatggaggagggccctgattttaaaaaggaaaaatagagaggcctcaaaacaatgaaacaaagagcttgatatgtcaagaggagaccaaggccctgggaggcataggcaagccgggcagagtcagaccagtgccctcccttgaccatctcctagcattccttaacctagacaggggctaccccatgtgagtccaagccagactttgtggctgtccccagcctgcacagcccaagcccagggaagtgtcctttctttcccttccttactaataatgggccttcctgagacacattcagagaaggatcagagagaaaggagaaccatccaggagagccacaagcgtccaccaaacagtgtctcaggcctcacctgaagctgctgttcctcctatcagcacactagtattaaatgggtgttccataatgaggagaatggaaataggtacaaggcatctagcttaggacagaatcggatttcggcatgtgaaggaatcccagagctgatctcattgaaatgatctatcgtacagacaaggatatgcaaatccacagaagtgaagggatttttgctcaagatcacatagctggtaaactaaggtaaggttagggcttgaacttgggccttctgactccttgtccagtcagtgttctttcatctcaccacagctgcctcctttgaaacagaggtattaagatctgtccttctggttcaccctctcatacctctttactgcgtctcccacatcccccacatgcctcccaaaatgaaagacaaacaggattgtttctgagaccaagatcagtctgtctgtgatcagcctgtgtgtggttcacccagtcatgcaattaagggcagatctgggccagtggaataggatagctgattggtgtttgttactgtgaaccctagaccgtaccccgtagaatggtgtctcttgctttgtaacacatcgggccttcagtgtgctgtattcctcagaagtgagggcatctcggtccattctgcccatggccacagggtgcagagaggcagcagggcccatgcaagctgccaccctgggatttgctgggctggagttcaacagatgtaaagacttcagtgaagcaataaacacaaaactctgggagaagatatccagaattttgtacattactctgtttctttttcaaaaatgaggcagatcagatgcccctgagctgcccctttttttctgattcccaactgcaatgtcctcagtcagtgttgtccctctgcccggctccccagctctttgccaacctcttcacactccccttgagctgagcatcagtcgcctgtgacgtggccaccttctgtcctgctcccactcccgacccatgctggaccccggaggacctcctgccccgcccccaccacacacccatatcccccaccattccaatttgttctttcccgtggggaattttttttcccagcgtctccatcccttcctacatatccacacacacacaaattggtctgatcttttttccattggttaaacatttaactccatgccagaccttgttttaacccctctcacatcatgttctttccttttttgcgagttattttgcattaaccaactttgtcagtgacagatgcgtatctgagggtgtcacacacgaccttcagcagggaagacttctgggccatggagggccgtctaatacatggacttataaactgactgcatgagcaatgaaaaggccaaattattctgaattttttttgaatcactgtaaaaaaactgatttcttttgtatagagaacactaaacgtataataaaagttgttcaaaatgg

SEQ ID NO: 5221 - DNA, 5784 bp, Homo sapiens
cggctccggctccggctccggctcccgcgcctgccccgctcggcccagcgcgcccgggctccgcgccccgaccccgccgccgcgcctgccgggggcctcgggcgcccccgccgcccgcctcacgctgaagttcctggccgtgctgctggccgcgggcatgctggcgttcctcggtgccgtcatctgcatcatcgccagcgtgcccctggcggccagcccggcgcgggcgctgcccggcggcgccgacaatgcttcggtcgcctcgggcgccgccgcgtccccgggcccgcagcggagcctgagcgcgctgcacggcgcgggcggttcagccgggccccccgcgctgcccggggcacccgcggccagcgcgcacccgctgccgcccgggcccctgttcagccgcttcctgtgcacgccgctggctgctgcctgcccgtcgggggcccagcagggggacgcggcgggcgctgcgccgggcgagcgcgaagagctgctgctgctgcagagcacggccgagcagctgcgccagacggcgctgcagcaggaggcgcgcatccgcgccgaccaggacaccatccgtgagctcaccggcaagctgggccgctgcgagagcggcctgccgcgcggcctccagggcgccgggccccgccgcgacaccatggccgacgggccctgggactcgcctgcgctcattctggagctggaggacgccgtgcgcgccctgcgggaccgcatcgaccgcctggagcaggagcttccagcccgtgtgaacctctcagctgccccagccccagtctctgctgtgcccaccggcctacactccaagatggaccagctggaggggcagctgctggcccaggtgctggcactggagaaggagcgtgtggccctcagccacagcagccgccggcagaggcaggaagtggaaaaggagttggacgtcctgcagggtcgtgtggctgagctggagcacgggtcctcagcctacagtcctccagatgccttcaagatcagcatccccatccgtaacaactacatgtacgcccgcgtgcggaaggctctgcccgagctctacgcattcaccgcctgcatgtggctgcggtccaggtccagcggcaccggccagggcacccccttctcctactcagtgcccgggcaggccaacgagattgtactgctagaggcgggccatgagcccatggagctgctgatcaacgacaaggtggcccagctgcccctgagcctgaaggacaatggctggcaccacatctgcatcgcctggaccacaagggatggcctatggtctgcctaccaggacggggagctgcagggctccggtgagaacctggctgcctggcaccccatcaagcctcatgggatccttatcttgggccaggagcaggataccctgggtggccggtttgatgccacccaggcctttgtcggtgacattgcccagtttaacctgtgggaccacgccctgacaccagcccaggtcctgggcattgccaactgcactgcgccactgctgggcaacgtccttccctgggaagacaagttggtggaggcctttgggggtgcaacaaaggctgccttcgatgtctgcaaggggagggccaaggcatgaggggccacctcatccagggcccctcccttgcctgccactttggggacttgaggggggtcatattccctcctcagcctgcccacgcactggccttccctcctgccccactcctggctgtgcctcccatttcccctcacctgtacccacacctccagaatgccctgccctgcgagtgtgtcccctgtccccacctgagtggggaggagcgtctcaagtgaacagtgggagcctgcccacctggcactgcactggagttgtctcttaccccaccctccctgcccatcaactgtatctgatttcactaattttgacagcacccccagtagggtaggattgtgtatgagggggaccccactatctcagtggtgggggtggccgcccgcccccttgtcccccatgcaacaggcccagtggcttccccttcagggccacaacaggctgtagaaggggatgacgaggacatcagaggttagacttaccctcctccctctttccaccagctgccagtcaagggcagtgggatctcgatggagcctccccccccccccacccatgcctccctcttcctcctctttcctcctctctttgtgtgtagcggtttgaatgttggttccatgcctggcccagccccacctcagtctccaggacattcctttcccagctccagcctggagggaaggggacaaagaccccaggaggccaaagggctgcagtcaccccttgtgctcacccatagtgatggccactggtatagtcatcgctctccctccatgccaaggacaggacttggaccgcttcagcctgggctgggagcagccctaaggtagaggcctcatggcccaggagaccccacctctggcagagccacattacctaccctgtgcatggtcctggggcagcaaggaagaagctcagagggtggggagaagcatgaagcagtgagcagagcactgggtgagagggagaagaccttggttcctagccagccctgctaatgtgctgtgtggccttctgtaagtccctgccctctctgggcctggccttcctcattcgtgagctgaggccctcgctttggtcatttgctctccagattgggtgtgagcttctctgtgattccaggtggatatgtggggaaagctctggtgaccctgggcttcgcaggggtagatcccaggactcggcagtggatgggatgcagccagtcatgggttagggtcagcagagactcagagtccagggcaaggttcaaggcagactaacctcatgcatggattgtaaaaaaccagctccctttggatcaacccagcctggcacccttgcctgtctgagagtgtctcaaagggctgatggcttcctggtccccttgagtcatcaccagcttccccaagagagtgtcagaatcttaagagctgagaggccgggcacggtggctcacgcctgtaatcccagcactttgggaggctgagacaggcagatcacttgaggtcaggagttcgaagtcagcctggccaacgtggtgaaaccccatcttcactaaaaatacaaaacttagctggttaggtggtgcatgcctgtagtcccagctactcgggaggccgaggcagaagaatctcttgaactgaggaggtggaggttgcagtgagccgagatcacgccattgcactccagcctgggcaacagagcaagactccatctcaaaaaaataataataatcttaaagatgagaaaagccaccccatctggcaccacagctgcatcttgcttgtgagaaatggggaagagttcagggaggacacgtgacctgcacaggatcacagagcatggggcagagccaggactagagctcagggcatctgactccctcttcagtgttcttccccctccatgttgcctgcccctgaagacctttgagttcagtctacacctaagcaggtagacatccgcgaggtcagatgctttccaacatgacacctgaacatcttcctttatgcaacacccaaacatcttggcatccccaccccaggaagtgcggggaggaggttatgatccctgggcgcttcggcagaatggagagctgaggtgtccctcccctgctagtcacctaccaggtgtctgagcagctgcatgctccctggctcaagtgggcactgtaccttttgcctgcctttttgttccctatctccactccctgaggccacttagcctgagacatgatgcaagagctgcaggccggggggctcagtgccatggaagctactccaagttgcattgcctcccgcgcccagatcctgctttccatttcgagaacataaatagattgcccagcccctccagtacaatcccactggaagaaaaggcaatggcgggcttcagccagacctgctgagacctaggttgccacggtaacagccaaagacatcaacccaagtgctgggtcaagtgtctcatcatactggcactgttgctggggtgacggcagaattcagaacttcaatttcagtgacgccaagcttgatgtgtttctgttattgttttgaagaaggtagctcttgtggaggacttgggagaaggatggggtcttaggaaggaggtgacagcacttgcatggtcacttgagcccacacacacgctcaaccccaagtcctttatgctttgtcacagtgaagatgagacctctgacgtccaagccttgttcctgtgctgcatcacccactcagccttccaaagggaacaggaacaaatttccccagcaccactgtttgggtcccgcttttcctatcttctgctgcccctgagcacatccaagcagacagggaaagaggagtcagacatggcccagtcacatcctgagctgctcctggctgataaccacgatggagcccgtgtttgtcctgccatctggcactgcactgagtgtggcacaggcaccgtcctgttgatctcacaacacagttctaagttaggacgttcttggctccgttagacaggtgaggaaactggggcacagagaggtgatgtcatctgcctggtgtcaatcagctagcaagtgatggagcccagatttcaaaccaaagggggttacgtccaggggctgagttcccactcacctgtgtagagtgccatctgggcaccattgctccagacgtgttccgacccctttcccagcccacagggcttgaagtgaaggaacagaggcagggggtgggccagccccagggccagggtccccttggtgaagccgtgccagggggctcagctgcttcagggaatgtgtccctcccaccatgggccagagcttcagcccttctttagctcagctagagttcacaggagagccaaaaaagaaaaggaagctgagcatctcccgagtcctgggcagggaaggggagggaaattgctgcttctccaactcttgcttggggccaagccctgcaccagttgcttcccagctgttatctgccagatcttcccatcttgtggcatgtggtgcccccaccaacatcccaaggggaccaatccccttgccaccactttgcatcacctgggaccacagatttggacaggaagggctctgagaagaggccaaagccctcattttacagatgaggaagctgaagcccggggaggggagcgaccctcaaggccacccagctggacacgggagacttgagcccagccttctgactgcattcagccctctctaggacgcagcagcctctccccagcactgagtcccccctcctttgtgtgtcccagcacccttggcctgagtaaacttggaaaggggctccctcccagagaagggactactctcttcacccctttattccagctgcctgccaccccagacccccacctcccaccctgacccccgacccctgggtggggaaggggctcacatgggcccaggctgagtgtgagtgagcatgtcaagttgtctgacactgtgacattagtgcaccctactgacaacccctccccagccttgcccctttctcctctccctgttttgtacataaattgacatgagctgcaacatgtgtgcgtgtgtgtgcgtgtgtgtgtgtgtgtatgtgtgtgtgatctgtgtcatggttttgttacctttttgtttttgtaaacttgaatgttcaaaataaacatgctgtttactctga

SEQ ID NO: 5222 - DNA, 3581 bp, Homo sapiens
gtctctgtctctcctcctccctcctcctgctccgggcggagcccggcatgggggggccggcgcccggcaggccagtggatccgggacccagggagggccgccccccgggcctggtggcactgagcagggccccccagcccccacctcctgccccacgagatgaacctcctctaccgaaaaaccaagctggagtggaggcagcacaaggaagaggaggccaagaggagctccagtaaggaggtggcccccgctggctcggctgggcccgcggccggccaggggcctggggtccgcgtgcgggacatcgcctcgctgcggcgctccctcaggatgggtttcatgacgatgcccgcctcccaggagcacaccccgcacccctgccgcagcgccatggccccacgctccctctcctgccactcggtgggcagcatggacagtgtcgggggtggccctggcggggccagtgggggcctcacagaggacagcagcacccgaagaccccctgccaagccccggagacaccccagcaccaagctcagcatggtggggcctgggtctggggcagagacgccccccagcaagaaagcaggctcacagaagccaaccccagagggccgagagtccagccggaaggttcctccgcagaagcccaggcgaagccctaacacccagctctctgtctccttcgatgagtcctgccccccaggcccctctcctcgaggggggaacctgcctcttcagcgcctcactagggggtcccgagtagctggggaccctgatgtgggtgcccaggaagagcctgtgtacattgagatggtgggggacgtctttaggggaggaggacgaagtggaggaggcctggctgggccccctcttgggggtgggggcccgacccctccagcgggcgccgactcggactctgaagagagtgaggccatctatgaagagatgaagtacccgctgccggaagaggctggggaaggccgggccaatggccctccaccattgacggcaacatccccgccacaacagcctcacgcccttccgccccatgcccaccgccgcccagcttcagccctcccgagccggagggacgggacgcccaccaagaccactccttgtgaaatccccccgcccttccccaacctccttcagcaccggcctccactcctggccttcccccaagccaagtctgcttcccgaacccctggcgatggggtctcaaggctacctgtcctctgccactccaaggagccagccggctccaccccagctccccaagtgcctgcacgggagcgggagacgcctcccccaccgcctccacctcctgctgccaacctgctgctgctgggaccatcgggccgggcccggagccactcgacaccgttgccaccccagggctctggccagccccggggggagcgggagctccccaactcccacagcatgatctgccctaaggcggcgggggcgccggcagccccccctgccccggccgccttgctccccggcccccccaaggacaaggccgtgtcttacaccatggtgtactcggcggtcaaggtgaccacgcactctgtcctgccagctggtccacccctgggtgctggggagccaaagacggagaaggagatctcggtcctccatgggatgctgtgtaccagctcaaggccccctgtgccagggaagaccagcccccacggtggggccatgggcgcagcagctggggtcctccaccaccgcggctgcctggcctccccccacagccttccggacccaactgtaggccccctgaccccgctgtggacctacccagccacagcagctgggctcaagagaccccctgcctatgagagcctcaaggctgggggggtgctgaataagggctgtggtgtgggggccccatcccccatggtcaagatccagctgcaggagcaagggaccgatgggggtgcttttgccagcatctcctgtgcccacgtcatcgccagcgcagggacaccagaggaggaagaagaggaggtgggcgccgcgacatttggggcaggctgggccctgcagaggaaggtcctctatggagggagaaaagcaaaggagttggacaaggtcgaggacggtgcccgggcctggaatggcagtgccgagggtccaggcaaggtggagcgtgaggacaggggccctgggacatcggggatcccagtgagaagccagggggcagagggactgctggccaggatccaccatggagaccgaggagggagccgcaccgcgctgcccattccctgccagaccttccccgcctgccaccgcaatggagacttcacgggaggctaccgcctggggcgctccgcctccacctccggagtccggcaggtcgtgctccacacaccccggccctgcagccagcccagggatgccctgagccagccccaccccgcgctgccgctgcctctgcccctgccgccccagccggcccgcgagcgtgacgggaagctgctggaggtgatcgagcgcaagcgctgcgtgtgcaaggagatcaaggcgcgccaccgcccggaccgaggcctctgcaagcaggagagcatgcccatcctccccagctggcggcggggacccgagccccgcaagtccggcaccccgccctgccgccggcagcacacggtcctctgggacaccgccatctgaggcgggcgggggggtaccggggcgcctggactggggagggggcgggcacgcctggctctcccgggagcctcgccttgagagacattgaaagactacgtgggagagtgccagggagaacccctgccctccaacctaccccccgggatggggagagtctgccaggcccattgggcttaggatgccaacagcgctgctgagaaacggaggaggaggagggtttgcttgaggttggggcgagagtcgctctggctgttcttcccgctgggcgttgtacacccctcctcctgaaccaagccagaggtcagcatggggaagggaggaaggaagggatgggaggaagaggggggtgggtgagctgaaagagagggactagagtgccagatggaggagctcttttctagagagccgggagttggggagggggtatttattttgttatttatttcagtctggagggcgattctgggcctttctgacctactcctgagctaggagtggagaatcagggccaagtttgcactctccccaatgccaatgcctaaaggccccgccgtccatgccaccccacagccaaggaggggtctgcatggggagtggaccgagagaagaaggggcccagggaagcagagggcccaagaccattcacagtatttacaatttgccagaatttggtagtcagtgtggcctgctctgaatcaggcatcttatttagttctggggtgagggtctagtgccagggatgggcaggatgatgggggaggaggagggaaattttagcgggtggagggggtgggcagggtatttatttaaattaaaaaacaaaacagaagagatgtcaggaacttttttttaattcctttcttttcagaataatatattaaaagactcatgatcct

SEQ ID NO: 5223 - DNA, 3584 bp, Homo sapiens
gtctctgtctctcctcctccctcctcctgctccgggcggagcccggcatgggggggccggcgcccggcaggccagtggatccgggacccagggagggccgccccccgggcctggtggcactgagcagggccccccagcccccacctcctgccccacgagatgaacctcctctaccgaaaaaccaagctggagtggaggcagcacaaggaagaggaggccaagaggagctccagtaaggaggtggcccccgctggctcggctgggcccgcggccggccaggggcctggggtccgcgtgcgggacatcgcctcgctgcggcgctccctcaggatgggtttcatgacgatgcccgcctcccaggagcacaccccgcacccctgccgcagcgccatggccccacgctccctctcctgccactcggtgggcagcatggacagtgtcgggggtggccctggcggggccagtgggggcctcacagaggacagcagcacccgaagaccccctgccaagccccggagacaccccagcaccaagctcagcatggtggggcctgggtctggggcagagacgccccccagcaagaaagcaggctcacagaagccaaccccagagggccgagagtccagccggaaggttcctccgcagaagcccaggcgaagccctaacacccagctctctgtctccttcgatgagtcctgccccccaggcccctctcctcgaggggggaacctgcctcttcagcgcctcactagggggtcccgagtagctggggaccctgatgtgggtgcccaggaagagcctgtgtacattgagatggtgggggacgtctttaggggaggaggacgaagtggaggaggcctggctgggccccctcttgggggtgggggcccgacccctccagcgggcgccgactcggactctgaagagagtgaggccatctatgaagagatgaagtacccgctgccggaagaggctggggaaggccgggccaatggccctccaccattgacggcaacatccccgccacaacagcctcacgcccttccgccccatgcccaccgccgcccagcttcagccctcccgagccggagggacgggacgcccaccaagaccactccttgtgaaatccccccgcccttccccaacctccttcagcaccggcctccactcctggccttcccccaagccaagtctgcttcccgaacccctggcgatggggtctcaaggctacctgtcctctgccactccaaggagccagccggctccaccccagctccccaagtgcctgcacgggagcgggagacgcctcccccaccgcctccacctcctgctgccaacctgctgctgctgggaccatcgggccgggcccggagccactcgacaccgttgccaccccagggctctggccagccccggggggagcgggagctccccaactcccacagcatgatctgccctaaggcggcgggggcgccggcagccccccctgccccggccgccttgctccccggcccccccaaggacaaggccgtgtcttacaccatggtgtactcggcggtcaaggtgaccacgcactctgtcctgccagctggtccacccctgggtgctggggagccaaagacggagaaggagatctcggtcctccatgggatgctgtgtaccagctcaaggccccctgtgccagggaagaccagcccccacggtggggccatgggcgcagcagctggggtcctccaccaccgcggctgcctggcctccccccacagccttccggacccaactgtaggccccctgaccccgctgtggacctacccagccacagcagctgggctcaagagaccccctgcctatgagagcctcaaggctgggggggtgctgaataagggctgtggtgtgggggccccatcccccatggtcaagatccagctgcaggagcaagggaccgatgggggtgcttttgccagcatctcctgtgcccacgtcatcgccagcgcagggacaccagaggaggaagaagaggaggtgggcgccgcgacatttggggcaggctgggccctgcagaggaaggtcctctatggagggagaaaagcaaaggagttggacacagaggtcgaggacggtgcccgggcctggaatggcagtgccgagggtccaggcaaggtggagcgtgaggacaggggccctgggacatcggggatcccagtgagaagccagggggcagagggactgctggccaggatccaccatggagaccgaggagggagccgcaccgcgctgcccattccctgccagaccttccccgcctgccaccgcaatggagacttcacgggaggctaccgcctggggcgctccgcctccacctccggagtccggcaggtcgtgctccacacaccccggccctgcagccagcccagggatgccctgagccagccccaccccgcgctgccgctgcctctgcccctgccgccccagccggcccgcgagcgtgacgggaagctgctggaggtgatcgagcgcaagcgctgcgtgtgcaaggagatcaaggcgcgccaccgcccggaccgaggcctctgcaagcaggagagcatgcccatcctccccagctggcggcggggacccgagccccgcaagtccggcaccccgccctgccgccggcagcacacggtcctctgggacaccgccatctgaggcgggcgggggggtaccggggcgcctggactggggagggggcgggcacgcctggctctcccgggagcctcgccttgagagacattgaaagactacgtgggagagtgccagggagaacccctgccctccaacctaccccccgggatggggagagtctgccaggcccattgggcttaggatgccaacagcgctgctgagaaacggaggaggaggagggtttgcttgaggttggggcgagagtcgctctggctgttcttcccgctgggcgttgtacacccctcctcctgaaccaagccagaggtcagcatggggaagggaggaaggaagggatgggaggaagaggggggtgggtgagctgaaagagagggactagagtgccagatggaggagctcttttctagagagccgggagttggggagggggtatttattttgttatttatttcagtctggagggcgattctgggcctttctgacctactcctgagctaggagtggagaatcagggccaagtttgcactctccccaatgccaatgcctaaaggccccgccgtccatgccaccccacagccaaggaggggtctgcatggggagtggaccgagagaagaaggggcccagggaagcagagggcccaagaccattcacagtatttacaatttgccagaatttggtagtcagtgtggcctgctctgaatcaggcatcttatttagttctggggtgagggtctagtgccagggatgggcaggatgatgggggaggaggagggaaattttagcgggtggagggggtgggcagggtatttatttaaattaaaaaacaaaacagaagagatgtcaggaacttttttttaattcctttcttttcagaataatatattaaaagactcatgatcct

SEQ ID NO: 5224 - DNA, 2777 bp, Homo sapiens
atgggtttcatgacgatgcccgcctcccaggagcacaccccgcacccctgccgcagcgccatggccccacgctccctctcctgccactcggtgggcagcatggacagtgtcgggggtggccctggcggggccagtgggggcctcacagaggacagcagcacccgaagaccccctgccaagccccggagacaccccagcaccaagctcagcatggtggggcctgggtctggggcagagacgccccccagcaagaaagcaggctcacagaagccaaccccagagggccgagagtccagccggaaggttcctccgcagaagcccaggcgaagccctaacacccagctctctgtctccttcgatgagtcctgccccccaggcccctctcctcgaggggggaacctgcctcttcagcgcctcactagggggtcccgagtagctggggaccctgatgtgggtgcccaggaagagcctgtgtacattgagatggtgggggacgtctttaggggaggaggacgaagtggaggaggcctggctgggccccctcttgggggtgggggcccgacccctccagcgggcgccgactcggactctgaagagagtgaggccatctatgaagagatgaagtacccgctgccggaagaggctggggaaggccgggccaatggccctccaccattgacggcaacatccccgccacaacagcctcacgcccttccgccccatgcccaccgccgcccagcttcagccctcccgagccggagggacgggacgcccaccaagaccactccttgtgaaatccccccgcccttccccaacctccttcagcaccggcctccactcctggccttcccccaagccaagtctgcttcccgaacccctggcgatggggtctcaaggctacctgtcctctgccactccaaggagccagccggctccaccccagctccccaagtgcctgcacgggagcgggagacgcctcccccaccgcctccacctcctgctgccaacctgctgctgctgggaccatcgggccgggcccggagccactcgacaccgttgccaccccagggctctggccagccccggggggagcgggagctccccaactcccacagcatgatctgccctaaggcggcgggggcgccggcagccccccctgccccggccgccttgctccccggcccccccaaggacaaggccgtgtcttacaccatggtgtactcggcggtcaaggtgaccacgcactctgtcctgccagctggtccacccctgggtgctggggagccaaagacggagaaggagatctcggtcctccatgggatgctgtgtaccagctcaaggccccctgtgccagggaagaccagcccccacggtggggccatgggcgcagcagctggggtcctccaccaccgcggctgcctggcctccccccacagccttccggacccaactgtaggccccctgaccccgctgtggacctacccagccacagcagctgggctcaagagaccccctgcctatgagagcctcaaggctgggggggtgctgaataagggctgtggtgtgggggccccatcccccatggtcaagatccagctgcaggagcaagggaccgatgggggtgcttttgccagcatctcctgtgcccacgtcatcgccagcgcagggacaccagaggaggaagaagaggaggtgggcgccgcgacatttggggcaggctgggccctgcagaggaaggtcctctatggagggagaaaagcaaaggagttggacacagaggtcgaggacggtgcccgggcctggaatggcagtgccgagggtccaggcaaggtggagcgtgaggacaggggccctgggacatcggggatcccagtgagaagccagggggcagagggactgctggccaggatccaccatggagaccgaggagggagccgcaccgcgctgcccattccctgccagaccttccccgcctgccaccgcaatggagacttcacgggaggctaccgcctggggcgctccgcctccacctccggagtccggcaggtcgtgctccacacaccccggccctgcagccagcccagggatgccctgagccagccccaccccgcgctgccgctgcctctgcccctgccgccccagccggcccgcgagcgtgacgggaagctgctggaggtgatcgagcgcaagcgctgcgtgtgcaaggagatcaaggcgcgccaccgcccggaccgaggcctctgcaagcaggagagcatgcccatcctccccagctggcggcggggacccgagccccgcaagtccggcaccccgccctgccgccggcagcacacggtcctctgggacaccgccatctgaggcgggcgggggggtaccggggcgcctggactggggagggggcgggcacgcctggctctcccgggagcctcgccttgagagacattgaaagactacgtgggagagtgccagggagaacccctgccctccaacctaccccccgggatggggagagtctgccaggcccattgggcttaggatgccaacagcgctgctgagaaacggaggaggaggagggtttgcttgaggttggggcgagagtcgctctggctgttcttcccgctgggcgttgtacacccctcctcctgaaccaagccagaggtcagcatggggaagggaggaaggaagggatgggaggaagaggggggtgggtgagctgaaagagagggactagagtgccagatggaggagctcttttctagagagccgggagttgggga

SEQ ID NO: 5225 - DNA, 4828 bp, Homo sapiens
aatttcttccctgctggacctggaaggagaggggctgtgtgttcatccccacccattagctatgccctcttttctccgaatgtcgatttaaggaagcaagcacctgtcttccgccactgcatcttcctagcaaactttaaaggccattttatctgataggaaggacatcgagaatgctctgatctagtgatgaagaatctgggagtcgacacttttcccatccagacacaatgcactttaattgaagaaacactgagctgaactacaagtctatttcttatggtgctggattactcctacagaactgccctgagatcaaccgtgagagagggctctgacagacacaagtcaccttctggttattgcacttagctctccctggggacttaaattttggcagtgttcctctttacatgatatcctccaagatgatgagttctaatcctgaggaagaccctttggacacatttctccagtacattgaggatatggggatgaaggcctatgatggcttggttattcagaatgcgtcagatattgctcgagagaatgatcgcttgagaaatgaaactaacctagcctatttgaaagagaagaatgaaaaacgccgaagacaagaagaagcaataaagcgcataggtggagaagtagggcgaggccacgaaggaagttacgtgggcaaacatttccgcatgggattcatgacaatgcctgctcctcaggacagacttccccatccttgctccagtggcttttctgtgagatcacagtccctgcactcggttgggggcacagacgatgacagcagctgtggctcacggagacaaccaccacccaaacccaagagggaccccagcaccaagctgagcacctcatcagagacagtcagcagcactgcagccagtaagagcgggaaaacccctgagaggactgaagcgtcagctaaaccaagaccccacagcgatgaatattccaagaagattcctcctcccaaaccgaagcgaaatccgaacactcagctgagcacatctttcgatgaaacgtacatcaaaaagcatgggccccggaggacgtcgctgccgcgggactcctccttgtcccagatgggcagccccgcgggagaccccgaggaagaggagcccgtgtacatcgagatggtggggaacattctcagagacttcaggaaggaggacgatgaccagagcgaggccgtctacgaggaaatgaagtaccctatctttgacgacttgggccaagacgccaaatgtgacttcgaccatcacagctgttcttcgcagtgtgctactcccacggtgcctgacttggacttcgccaaggcctcagtgccatgcccccccaaggggctgctttgcgacatccctccgcccttccccaacctgctttctcacagacccccgctgctggtatttccccccgcccccgtgcattgctcccccaactccgacgagtccccgcttacccctctggaggtcacgaagcttcccgtgctggaaaacgtgtcttacatgaaacagccagccggggcgtcgccctccacgctgccgtcccacgtccccggccatgcgaaactggagaaagagcaggccgcggccctgggacctgcctctgccacccctgcgctctcctcgtcgcccccacccccgtctacgctgtaccgaacccagtctccccatggctaccctaaaagtcactccacctctccctcccccgtcagcatggggaggtccctgactcccctgagcctcaaaaggcctcccccttacgacgctgtgcattcgggcagcctctcaaggagctctccttcagtgcctcactcgacccccagacccgtgtcgcaagatggggccaagatggtcaacgccgcggtgaacacctacggggcagccccgggtggctcccggtcccggacacccacgagcccgctggaggagctgaccagcctcttctcctccggccgcagcctgctgcgcaagtcgtccagtggccggcgctccaaagagcctgcagagaaatcaacagaggaactgaaagtccgaagccacagcacggagccattaccaaagttggacaacaaggaaagaggccaccatggggcgtcttcctccagagagcctgtcaaagctcaggaatgggatggaacaccagggacacctgtggtcaccagtcgactaggaagatgctctgtgagccccaccttgttagcgggaaaccacagttcagagcctaaagtaagctgcaaattaggccggtctgcgtcgacgtcaggtgtgcctcctccatcagtcactcccctcaggcaaagcagtgacctgcaacagagccaggtaccatcatcgttagccaatcgtgattgacttcctgtgatacaacttgccaaatgcttcccacctctgtctgtcctgttgctgtagacaactttcgcatttgcttttatttttctatgtgtgtatgggttaggggatgcgggggatgagttctggcagtctgtgttttcatttgaaaaagaatatctttcttccttgtgattggtggtgaaactttctttgctgtttgttaccaaatcgtttttgtctctggtttccatcattctgtaatataaatgtagtaaacttgtactatatgtattggcttagtggttcttttttaaattctttctctctttcatgttttgtgtacttttatactgtctctgaaaatttatcaatatttgataaatttatctactttgttttatgtagatttctttttaaatgttttgtccagaacactcgcacagatgttgtcaatgaatttgtacatatttcttagctcttatcctattatactgtaatatttctggtggttttatttttatttagcttggagcatgactgtaagacactgttgaatattgatgtccttataaatattcatatcccgattcatttggattgagtatggcagctagtctttcttctttcttaggctattgactggcctaagacaatttgactggccagacaaattgactggccagataatctagatatttaacaaaaactgcagattaataaggcaacctttaaatgaatgacttttctctcttataccaacaatatcagaaatgttctcagaaagggaatgtaagtgttcatgcatggtaaatgagatctcaattatcacttggagaaaagagacaagaaataaaggcataaactgaaatatcatttaatcctttacagcataatatgttgctctgatgttcgtttgggtacgtggttgtggatggggaattagtatggggaaaaatcactacacataaatgtcctatctttagctcacccaataggaattcaatacattgacttaatttgtgaggcttaattgtcgttactgttaagtattataggtgttaagtagggtggtgtcattctggaatgttttctctctgcttcctagcttcaatctttgcattcatgaaactcttctgaaatagcaacttataaaacactgatgatacctccaagggaactgcccattactgatgagaaaattacatattcatctattattttaaatgtcaggctattttaaaaacataactaagtagaataattgcgttttcttctaatgagagacattgtgcctcttagtgtttttgtctgacttaaatatgcaaaatagttgatttataaatatatgaggtatctgcaaatacaagaaatgagaggcttctctcaagggtatctcaagtaccatttagaatttcttgtgtcttaatttaaaatttaaatgcctttatataaatgttaaatgcctttataactaaatgtaccaactcaaacactttttggatataaaagaagtagaaacagtaagacactgaataaaataaataagataaactgccaacttagctaattaaagctattccaaaaatattgtacttaccaacatttaaagcttaaaaacattgggtactgaaagaagagaagtttagctaattggcagaggattgcactaatacaatcaagttttcaagtttatgacccttgctagtatattaccttcaatatctcagagatgttttgtattatttgttttgttttgcttttttcctagttgtctttatagctgtttcaccctaagccccttcaaactctcaatgaaagcaggttcttgggataaacttccagaatagagacaaggtataccctttgtgcctttgcattatcaactctttgttcacctgatgggaagttcttcgtttttcaaaatgtagcaagggagaaagcccaggacgcctttatatgctgttagtttccttacctgctgatagagattctgacacacagtcaaatcatacatgggctgtcagagctataaattagaaggctggcctctaggcttctcctctgtggcttatagccagttgtaatatacatgcattcctatactctagagatgaagtggtaagcatagctcatatgaacactgctctgaactcctctgacttagcattcaacttaagtcaagaaatacttattggctgggcgtggtggctcacgcctgtaatcccagcactctgggaggcagaggtgggtggatcacaaggtcaggagattgagaccatcctggctaacacggtgagaccccatctctactaaaaatacaaaaaattagccaggtgtggtggcgggcgcctgtagtcccagctacttgggaggctgaggcaggagaatgtggtgaacctgggaggtggagcttgcagtgagctgagatcgcaccactgcactccagcctgggtgacagagcgagactccatctc

SEQ ID NO: 5226 - DNA, 435 bp, Homo sapiens
atgatatcctccaagatgatgagttctaatcctgaggaagaccctttggacacatttctccagtacattgaggatatggggatgaaggcctatgatggcttggttattcagaatgcgtcagatattgctcgagagaatgatcgcttgagaaatgaaactaacctagcctatttgaaagagaagaatgaaaaacgccgaagacaagaagaagcaataaagcgaatcaacagaggaactgaaagtccgaagccacagcacggagccattaccaaagttggacaacaaggaaagaggccaccatggggcgtcttcctccagagagcctgtcaaagctcaggaatgggatggaacaccagggacacctgtggtcaccagtcgactaggaagatgctctgtgagccccaccttgttagcgggaaaccacagttcaggtaa

SEQ ID NO: 5227 - DNA, 1015 bp, Homo sapiens
gtacccactccctggcacttccactcctagagggaggaggctgagcaggcagagaatgggacgtgtcccctcagaggagcctcgagcccagttccagccagcggcccactcagtgaggtgctcaagtacccacgtcccccgccagctgccagggttccctctcctccctccgtccctccccccatctggggagcccagcggtactgagggggcggaacgaggcggggccaccgagcggttatagctgggcctgcaggggacccacggctcgcctccagcctcctgcgctccggtacctgggcgtcccaactccactgcgcgcccaaacccagccgagccggttcgtggcccgccccgccgggcggccgtcgacgcgagcgccctggcgtggcgcccaggggagcggggggctcccgcgagccggccgcggctggcactgctgctgcttctgctcctgctgccgctgccctccggcgcgtggtacaagcacgtggcgagtccccgctaccacacggtgggccgcgccgctggcctgctcatggggctgcgtcgctcaccctatctgtggcgccgcgcgctgcgcgcggccgccgggcccctggccagggacaccctctcccccgaacccgcagcccgcgaggctcctctcctgctgccctcgtgggttcaggagctgtgggagacgcgacgcaggagctcccaggcagggatccccgtccgtgcgccccggagcccgcgcgccccagagcctgcgctggaaccggagtccctggacttcagcggagctggccagagacttcggagagacgtctcccgcccagcggtggaccccgcagcaaaccgccttggcctgccctgcctggcccccggaccgttctgacagcgtcccccgcccgcccgtggcgcctccgcgcctgacccaggaggagtggccgcgcgcttccaggagccgctcatagaccccgcctgccgtccggtcaataaaatccgcctgactcctgcgcccccgcatgcg

SEQ ID NO: 5228 - DNA, 2258 bp, Homo sapiens
gattcctcccccggagagggcggggcggccgagcgccccgaggctagacgccgccgtccgagagacgagggggcgtgtaggcggtgacgccctgcaaagtggccggcgtgcttatcattaccgagcttccgcgggcctgcagagcctggcggactcagacttctctccggagcgggatgcggccctaccgcggcctcacacttctcgccggcttcccgagttctcgggggcggggcttgtgtttttacttccggatcccacagctatgacaccggaagccggaagcgtggtagggaagggcgaccgcgaaactgggactttctcggagcgccggggccctaccagcgttcacagtccgccgctcccacccttctcacgtctgacggactctgctgacagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggccgctcttcctcccaccggacaccgacccgcccgccgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcatt

SEQ ID NO: 5229 - DNA, 1639 bp, Homo sapiens
caccagccagcctctgggtctgtagcaaccgcccagcgttgaggcgcggctcatgcccccagtatcccggtccagctattccgaggacatcgtgggctctcggagaaggcgacgcagctcctcggggagcccaccatccccgcagagcagatgttcctcttgggatggctgttcccgctctcactcccgcggccgtgagggcctcaggcctccttggagtgagttggacgtgggcgctctttacccctttagtcgctctgggtcgcgagggcggctcccaagattccgcaactacgccttcgcgtcctcctggtcgacctcgtatagtggatatcgctaccatcgtcactgctatgcagaagaacggcagtcagcggaagactacgagaaggaagagagccatcggcagaggaggctgaaggagagagagaggattggggaattgggagcgcctgaagtgtgggggccgtctccaaagttccctcagctagattctgacgaacataccccagttgaggatgaagaagaggtaacgcatcagaaaagcagcagttcagattccaactcggaagaacataggaaaaagaagaccagtcgttcaagaaacaagaaaaaaagaaagaataagtcgtctaaaagaaagcataggaaatattctgatagtgacagtaactcagagtctgacacaaattctgactctgatgatgataaaaagagagttaaagccaagaagaaaaagaagaaaaagaaacacaaaacaaagaaaaagaagaataagaaaaccaaaaaagaatccagtgactcaagctgtaaagactcagaagaggacttgtcagaagctacctggatggagcagccaaatgtggcagatactatggatttaatagggccagaagcacctataatacatacctctcaagatgaaaaacctttgaagtatggccatgctttgcttcccggtgaaggtgcagctatggctgagtatgtaaaagctggaaagcgaatcccacgaagaggtgaaattgggttgacaagtgaagagatcggttcttttgaatgctcaggttatgtcatgagtggtagcaggcatcgcagaatggaggctgtacgactgcgtaaggagaaccagatctacagtgctgatgagaagagagctcttgcatcctttaaccaagaagagagacgaaagagagaaagtaagattttagccagtttccgagagatggtgcacaaaaagacaaaagagaaagatgacaagtaaggacttacttgttgcacagcaggaattttaacaacaaaaattttatgtgaccaaaagtgttaaaaggctttacagtgctactgtacttaccatattagtaagtccctcaggaaaaagcttcttttgagatatctttagcagcttattttttgttattttaactttaaaaagtaatatgtgcacatggttttaaaaatattcaaccattataggaggagagttagtaaaaagtgaatctttcactttagcccctgacacctttcccccaaaaatatatattttggtgtcttatatacagaatatacattctgtgcatatacaagagtatatgttgcagcataaagattaaaagctattaaagttttttttcgctcgtta

SEQ ID NO: 5230 - DNA, 2945 bp, Homo sapiens
cgccgcgccgcttcccccacctcgcaccagacctctgaaattgccctcggagactcggcctctcctataaggacgatcgtcctctcagctggagaacaaggccatgcctcagctcctacgccaggcggaagcgggagaggaaggccgacccccaagagcgccccttcagggggtccatccggccttgatctcagatgggggggtgtttgcggagggcggggcatcgcctcaacagctgggggctgcatcatggcaggaacgagtttccctgagccacggagctgcaggtcgcctcctctactaccctgctacccggttacctcttcgcctcttggtcgtcgagcagctccggctcggtcgccgccattaccacatcgcactccgcggcagccgccatcttaccgccgggaccagagagctgggtgggaggccggcggtgaagagcacttccggttggagcatagagcagctccgcggcgccgcgcccagaagggctccctcgggctcgtctaccagagagaggctccgcttggggccagagcggcctcccgcccccggatgtccacggtggtctccgcgccggggcgggagcccaggggctgtgccggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaagaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctggaggctgggatctgccgctccctccagccaccagggggcaggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggtgggcacacacccagcggcctgcagagtaagcttattacccacaactgtgcccgctttgtgcttctaaggtgcacacctagcctaggtgagacactgcagccaggcaaccaccgacacacgccccttctcaaagccagaggtgagtggggcaggtgcccggggctgggtgagtggaattaggacacacacaggcttgggcttcaagttcatttattgatgcattggttggacacaataaaaccacaattgttatcaaaaa

SEQ ID NO: 5231 - DNA, 11051 bp, Homo sapiens
agtttaattacgtccccgggaactgcgccgatttggacttttggcacttggacctatgctttaaaaagaaaaaagtgtcattggcgtggagtggggctagtggagggtgaggtgaatgcgccgtttggaaaccacaggacagtgaacgtttcgtctctcccagcgagactctcccgcgggcccggcggccgcatcgggagcccggcggaaacatggcggcgcccggaggccggggccgcagcctctccggcctgctccccgcgcagacctcgctagagtacgccctgctcgacgccgttacccagcaggagaaggacagcctggtctaccagtatctgcagaaggtggacggctgggagcaggacttgtcagtacccgagtttccggaaggattagaatggctgaacacagaagaacctatttctgtctacaaggatctatgtggaaaaatagtcgtccttgatttcttcacctactgctgcataaactgtattcacctattgcctgatctccatgcattagaacacacatactctgataaagatggtcttcttattattggtgttcactcggctaagtttccaaatgaaaaagtcctggataacattaagagtgctgttcttcgatacaacatcacccaccctatggttaatgatgcagatgccagcctttggcaagaactagaagtttcctgctggccaactctagtcatacttggacctcgtggaaacatgttgttttctttgattggagagggacacaaagataaattatttttatatacttcaattgctttaaagtattacaaagacagggggcagatcagagataataaaattggaataaaactctataaagattctttgccaccttcaccattgctatttcctggcaaagtaacagtagaccaagttactgatagattggtaatagcagacactggacatcatagaattttggtcgtttggaagaatggacaaattcaatatagcattggaggacccaaccctggaagaaaagatggaatattttcagaatcaacttttaattctccacagggtgtagccataatgaataatatcatatatgtggcagacactgaaaaccaccttataagaaagattgacctagaagctgagaaggtgagcactgtagctggtattggaattcaaggtacagataaagaaggtggagcaaaaggagaacaacaacccattagttccccttgggatgtagtttttggaacatcaggttcagaggtccaaagaggtgacattttatggatagccatggcagggactcatcagatatgggcactcctgctggactctggcaaactgccaaagaaaaatgagttaacaaaaggaacctgccttaggtttgctggaagtggaaatgaagagaatcgaaacaatgcctatcctcacaaggcaggttttgcccaaccttcaggcctttccttggcctctgaagatccctggagctgcttgtttgtagcagatagtgagagcagtacagtgagaaccgtttcactgaaagatggagcagtgaagcacctcgtaggaggagaaagagaccccatgaatttatttgcttttggtgatgttgatggagtaggaatcaatgcaaagcttcaacacccccttggagtaacatgggacaaaaaaaggaatttactttatgttgcagactcctacaatcacaagattaaagttgtggatccaaaaacaaaaaactgtacaacattagcaggaactggagacacaaataatgttaccagttccagttttacagagtcaacttttaatgaaccaggaggcttgtgtattggagagaatggagaattattatatgtagcagacaccaataatcatcaaattaaagtgatggatttagaaactaaaatggtatctgtgctccccatcttcagatctgaaaatgctgtggtagatggcccgttcctagtagaaaaacagaagacattacccaaactacctaaatctgctccaagcattaggctttcccccgtgactgcgtgtgctggccagactcttcagttcaaactcagattagacctcccatcaggatcaaagctaactgaaggagtatccagttgctggtttctaacagctgaaggcaatgaatggctacttcaaggacagatagcagctggagatatagagaacatttccagtcaaccaacaatttcactacaaattcctgatgattgcttatcacttgaagccattgtatctgtcagtgtgtttctttattactgtagtgcagacagcagtgcttgtatgatgaaggcaattttgttcagtcagcctttacaaataacggatacacagcaaggttgcatagctccagtagagctcaggtatgtattttagccagccagctagctagcaacccattgccaccacctactgtctcccatcctgactatcactgtaatttaaggaaagaaaacttcagttctgcctctggataccaagatgcccattgctcagttcagacaactgatattaaaataaagctatgctccttacttacttcttttattataaacaaattcctttgctttggctgatactagctgagtcattgatcatcattggtaccatgatattgtaatctatgctgctatttggcacaagactgaagttcacactacagtagagaatactataagataatttgcaataaatactgataataataataccagatattttaactaactttttctacctttattaatagcaatcagcacacttgaatgtgtaaatttcacagtaactttaggcagaacttaagctccaggccacatttgtataagaacaccaagtattcaaggcataaagtctgttgtaagccaaaaaaaagtcttttcatcactgtagaagcttaaggagtacatcagtggtaaatacgatctttattctcttctgtggttttctcagttgagatatttttaaaagagagttttgatctatttttattataaattatttgttatttaacataccattatgaatgccttaaaactttgtacagataaagttggacatagaatctctaaggactgactcctttaactgtttttgagtgactacattaccagataatgaatgagtccccagaaatattatgactttcaaggaaaaagggactttaggacacattacttagtgtctgtgataaataatttattgtgacagctaaatctgatggttacatatcttgttttggaaatgtacatttcacttgtaagcattaaatgcagatttgttgagtttaggttttgaggtttttttcgttcccatattcagaatttaaattatgatcatttattgtgatgtttttaaaaatcacttttaagccttaaaagtgaaattttcagtgtgaggtgctttcatgctattaatagatacagtatatcctaatatattagtcttcaaaatattaaggccgaaacagtgatttaatgatactattttttaatttttgttgttttttatccctaaaaaaagatattggaaaggttttttttctattgtcataatttataactacttaaaagcctaatcttgttttccttaagacctattcaacatgtttgtgatttaatcagcttacaagggtttaaaaacatcaggtgaaccatgtttatttattcagtaaatatttatagacaatatggcataatatgcttcccttccctgtaaaaacagtgctaaatttgaagtgtaatcttttttaaacatcattgtctatttttaattttgtttgaaatgtagtattagtttgttttattcataaggttagctgaatctctgaagtaaggatgtataaatcatgacattgatttaattagtcatctactgaagctacttttaaagagaaatatagatataaaattaaaaggaatcctgtttaaaattatatgtaattacctcataaaccttttctctccacaagcaatcaaaaaaatgaaatgttctgtaataaaagggtgtataacatactctcttttatgagaataggccttagttattttattttatttttgagacgtagtctggctctgtagcccaggctgggagggcagtggcgcgatcttggctcactgcaacctctacctcctgggttcaagagattttcctgcctcagcctcccaagtagctgggattacaggcgtacaccaccatgcccagctaatttttttgtgtttttagtagagacagggtttcaccatgtcagtcaggctggtcccaaactcctggcctcaggtgatccgcctgcctctgtctcccaaagtgctgggattacaggtgtgagccaccttgccctactggccttagttaatttttaatctcatttgacttattatgtttctcatttctagatggacaggatgagaatattttggcccaatcattttctgtttaaggacttaaacaatttcacactctaaatgaagtatatacaattttaatttactaatttagaaatatctgagtttatttttcaatataatatacaaacacagtgtttgttatacatgttcatgtacagtgaaaatgcaaaggcattttttagactctattccccttcatttgtctagacagttttaggttagccttagcttatacttttcttgactttcaaaatacagttttattgaacattcttattcttacccactgccagtctgcattgttttttacattaaaagtattatttatagtagactaatatgattttgaataaaatcacacttaagcaatatagataggttcctagaatttatgacgaggataaacctctcacataagaggaagcactagaaagtttatttttaaaacttgttgatccatattctataaggactaatgcatattttttatcttttgcttttcttgttggataaattattatgtccagtgatagtttaaaaagaacaagattttagtgtaagtcacctcacttgaaatgccagtaatgtggtattacacacattttatataatacctggaatctttgccctaaattattctgctggtttgtcgctatttttttcctctcctctttattatttcacaaatggtagaatttcttgatatgattcttgtaaagagtttagcttatcttgaacattctgtcttaagcaaatatttaacaagagaaaactttgtagtttaatcacccataagtgtaactttagcaaaattcaatgactatgaaaaataatttttttcttaactgttctaataatatttagttataatattatcaaaccttcagaaagttataaatcctaacagccagaaaaaaaaatttactatgtgtatatttatataggtgtgtgtatacacaaagattaagaattattcatgattcttttatggccaatatacttttgagcttgtataactgagataagttactctttgcttgtttttctgtagttggaaaatttaggaagttattaaaaatacatatctctataatgtaatagttttctgcctgcacaaagtttactattaatttatgtctaccagttaaaaatacgatagttagatttggcatcacgtttaaccacaatcatcaaaatctacttaaattctatagttaacagttacataagaatatatgcagagggaaaatgtcaatagttcttgtgaatgaaggaattatggatgtttttattttaattctactttgctgttttttttttcttttcagtgagcaatctgttatttttaaaatcacggtggggggaaacccataaagtttaaagagttaaagttaactgaatcgtaagcacttatataataactttttaaaagtcatttttattaccagagctcagaacattgtttggagtcctttgatctaccggttctcttaagtacgtgatttcgtgaagatagcaatggttatggcttttttgttctgttatttttattgtgtaacgtagtgtagtggttaagagcttggattttgcagtaacttggattctaatcctttaaaatggggctgatatacctgcctcatattcaatgaaatattgtgtgtacagcacttagtaattaatgaaactggtaattattagcttagttactgtaatgataatttgggaccataaacacatatcaccctacattttctttgcaactacaatttgtgaaggaaaatctcccactaactattggttatgttaatattcttcatagagttgggttcaagaagagaaatgttttataatgaagcatataactattttataaacaacattgtagttataaagaagcatgcctatagtgttattaaaaattttttgtacgactttctggagctacaagtaatgaacttgctttgagagggtccagacatactcatcctgaaccacattcctacaacatatgcccaacaacctgcaccagagtacttatatcttaaccaaaaagtttcacttcaatggtggtgcttcacaaaatcttcaaagtgctttcatgtgtattgcctcatttgagcttcaaataaccttataaatcgggcaggtagatgttagtttacagaggaggagacagctttggaatagtggtgacgtatctgaagaatagaaaaccggaatagtgctcgatgcctgaagtggtgcctggcgccagcagatgttcacttctgtcaaacaaggggaagtagtggtggagcctttattcaggcacgggtctcctcattcctaactccaagatgcagagggaaaacgaactgctcaattaagagttcttccatggacactttcttaagccttcacataaaataacaagaataatagatatttattgagtagatatttattgagttctttctattttccagcactcatctattaagtgcttttatgtattaactcatttaatccacacaacaaccttatgtgagaaataccatttttccttatttgattggtgaagaagcacacagagagggtaagcataatcaaatacaccagcataaccaaaatcacacatttagcgagtggcagggcctggatgggagtctgttcaactctctgctgtattgcctcttaaagtaggttttcttaaaacataaatctttcataactttatatatttatagtaacttaatccaaagaaccccaaaagtactagcaatgattgtttctgcaatttaaataaatccatttaattatacaactttgcattatatactgttattcagaccttggaacagtctataattgtttgtcaaaagattttatgtactactttttcttaatttcagatattatccagagtttttcttggcagatggatgtattaaaaaaatagctttccagtgttagttctcaacagtgctgtttcaaaagttgttttaaaagttctaacggttggtcttcaaaacgtaattaagaccttatcataaagagccttttgcacaggactatctcaaaccctaagaagctattcatatttaagaaaattttgttgtattaaatattagtccaagtgagctctggaaatacagtcttctgctttcttgtttcataaataacactggtatgcagacccctccccatgactcaaatattaatatatgcaattctgttacagtaaagttttcaccatggtcaacctattccagcattaggtactttttgttgttgttgttttgttttttttttttttttttgagatggagtctcactctgtcacccaggctggagtgcaagggtacaatctcagctcactgcaggctccacctaccgggttcaagtgatcctcctgcctcagcctcccaagtagctggcgctcaccactactggtgcccaccacaatgcccggctaatttttgtacttttagtagaaacagggtttctgttggccaggttggtctcgaactcctgacctcatgtgatgcgcctgccttggcctcccaaagtgctgggattacaggcgtgagccaccgtacccagcctagcattaggtactttgttttgttttgttttgtttttgttttttttgagatggagttttgctcttgttgcccaggctggagtgccatggcaacacagcctccacttcctgtgttcaagcaattctcctgcctcagcctcctgagtagctgggattacaggcgtctgccaccacgcttagctgattttttgtatttttagtggagatggggtttcgccatgcttgccaggctggtctcgaactcctgacctcaggtgatctgcctgccttggccttccaaagtgctgggattacaggcgtgagccgctgcgcccagcgcactaaatactattaaaaggaattaagcaaaatgctacgtaccaatgattatgattcatgatcacctaaacacagaatgcagacttaacttttcattcttagtgtgctaattaagtagtagtatggtgcagtaaggaattttgttaattttgttataaactccctctcctgaaatccgtaaggaaatgtgataataagaaagtgataatagtgtcatattttaaaagtagaatccactgttaagcaccaagattaccttttcttccccctgtggcacagtttatttaaatgaagtattagcaataatcatgtcactattttgtcctgaataattaagagtttgcttttttcccatgtctttgcaataggataatataaagaatagtattaaaagtcagaggctttactaatctacctatatgtattccatggctaacaaaccctggcccctttacatatgagctctggaggttcgcctggctgcctcaggcttgcagaaggctgccccaatcacagagcctgggtaaggtggaacaggaggcagccccactcggcttttctgattgcatcccacctgtttctgagtgtgttggtttggtttaattcttttcaagggttggagttggaaagtgaaaaccctagacacttgctgtggaatgtttgcctggttgtattggtgtgtccctcttcttcactggcatgtcgctttcaagtgtaccaaaggacattttgttctgttgaaagccacaggaccaaaaggaaaatattgcaactatttgcaaacatacttccctacctgtacaagcagccatatactaaaaagcactaaacaagcacaaatgaacactaaatagccttataccaaaaagcattcttgtaactgtcagggcatggtatgaattccttcctctttaagcagcaacttaccacaggcttggtggctttaagtaatatagcattaagcaaatggtcagttattttttaatgttgaaaacttccaagtgtgaataatacggacatagtttactaccttttgcttttaatatacctggttatctatttccatttgaaataaaatgaaaggagacctcaaactgatgctgagaagtagacaaaatcagctctcagacttaactctccccaattaaaatagtttttttttcccttcccatttttttgtttttaagagatagggtcttgctgtgttgcccaggctagagtgcagcagtgacatgatcatagctcactgcagcctggaactcctgggctcaggatccttctgcttcggcctcctgagtagctaagaccacaggtgtgtgccaccacacctggctaatttttttaaaattttttgtagagatggggacttgctatgttgcccagactggtctcgaactcctggcctcaagccaccaacctctcaaattgctagaattacaagcatgagccaccacacctggcctgttattccttctttatctaatgtgtgctaagcttgtgaaaaatatatgttgaggtaaatagggcaaaacattagttgataaattatgctaattaatgggaaaaatagacatgttcctctctgaacatttagaaggactctgccctacaactatcttctgtttttagaatttgtagtcactgttcttagtgccactggaaatatattcattctttgagcatgtacagggtgggctccctgttgtatttattacacttttcaaaatgccagcaagtttttgtttgtatagagttggaatgtattgttcgtgcatgcctgtgatattcatcatcaaaatatacctgtaaaaaataaactactgcttcctctccacagcttaggcctccctcttactaaaaacaatagtagtttctgtagaagtttcagtgagaaattatggttatataaataacagatatggcagaacaattttgttgtagtatttttttccgtagcatttcttaataatagctcagtttttaaaggaggggaacaataccccatgagttcaaattaattttctctactttgaggtataccttcctaattatattttacataggctgttttttttaagtttaaattctcactgttaagttgcattgagagacaattagaaatgttgtaattgtcatatctttacatgtggattatgaacaaatgaaagtttgctgtgtgattgcagttttaaattataacatttcataaatatgtcaattttagaaactcaaactctttcccatcttttgtatggataaagtttatggtttcatttctgagaatagagttggtctgctgtgctaacttcatgtttcttattccaaaggcttgattatatttttttctccagtgattaaaaatgcagcgaaaatccaatctacaagttcatatattggtatttctagacatagtctagttctaaaagaatgtacttggtgtgcatttttaagtgtttcatgtagacagattaatatatttttgtacaacattgtatttctacatttatttcaagactgtacttttcagtgactttttcaagtgcatgtgttaacagaagattgtttggaacgagagtgcagtggcttctttactagcaaagagaagtgtaatacaagtgatcatagaaggtgagaatgtgtttatactgtatatggaaacctaatgcctcttttctaaagctttgtacatttttttcgtgaaatagattaaatattttctctctaaaa

SEQ ID NO: 5232 - DNA, 2097 bp, Homo sapiens
acttcctccagttctagtttccaacaacagaggctgcagccacccagccccgaagcagggcccagcgagacagggcccagtggggccttattctctctcttgcagccccaagcgtgacccagctgcagagaagctgagacggtgattcggactgactggactctggcctccaggtgtctgcacctcacactggacccacctggagactccacgggctcccggcagctccggctgcttgggtggatccgggtgcccgcaggggctgtgggagggccccggggcctgcactgctcccccgatggcctgctcttcctcacggccggggctgcaccctgtgtccacgtgctagatctggagggacgccccatctgcctcctgccctgccgcactccggggagcggggccttcgttccagaggacgtggctgtgacagcgtcagggcttgtggtggtcagcgatcccatccatggggctgtccatgcactccagcacacagcccgggaccccgggggccactgggtgacagtgggcaccttcctgtctccccgagggctggctgtggatgccctcaaccgcctcctggtgacggactacttgcctggggctgtgcacagcttctcgttgggtcctgcttgggagcccctggccccagcctccatgctgggtctggagggcccctgctgggtgggcccagggcctgatgggggccttgctgtgagtgaggagtttggggatgtgaggctgtttggcagtgcccgccaacccctgggctccctggggggctggacggggcacactttcggctgcccagcgggcatctgctccaactcagagggcaatgttattgtggcagacgagcagaggcgccaggtgaccctgtttccccgggctgggccacccatctgcctggtgtcagaggggcttgggcagcccttgggagtggcctgtgcaccccagggccagctcctggtggctgatgccaaggacaactccatcaaggtgtaccagggcctcaaggagctggcctgacctgaggctgggttggagcagccctcctgtgcctgaggccagctcccaggcccttggatcaccgcgggaggaaccctcaggatgggtggagcctccaggctatgggcattgcctgcctgatgccagcaccacctgggctgggccctgggcttggctcgagttctcctgctggtgaggctccggatctcaggagcagccctgagtctgcttcccaggctgcccctgccaggcctgcagcctccccagccagggctgctctctgctgtccccattcagtgccctggcccctgcattcatgccccccacaccccctcaggccctgtgcctggactttggggctggcagctgaagccttgagatcctgggccagctgccggcacacagctaggcagactctcccaccaggtgcccctgcccaggcctcctaatcgggggcagacaggcagggagggtgtggctgggctgggctgggcggggcggcctggggcaggggtgtggcccctaaatgtccccaacctcagagggacctagagtcctgagcctccagtagcttctctgggcctggcagaggtaagggggaggcaaccctggagtgtctggaggcccatggctggctgaaccctggatgccttttcttccgcgtccccatgaatgaaagctgtctgggccttcattctgcagacagggacaaacagctccatgctgtttgtcctcccagtgcagccgtgctgggagggtctgggggagcttcctacaaggagagactcctgctgctttggaaaactgagaaaaaataggggtctaaccctctcctcccattttacaagtggggaaatgaggcgtgaaaggagaggcgtctgggttactccgtgggtctggggtccagggaagggcctgtatgggggagggagctgggaggggacggtgtctggctctacccctgtggggtggggaggtggggctcccctgtatcacaggacatcccccctgagaggtccctcatatgtctgggtcctgtgggtgggggactaactgcgcaatgtagttaggtgctcaataaacggagtt

SEQ ID NO: 5233 - DNA, 2071 bp, Homo sapiens
agttctagtttccaacaacagaggctgcagccacccagccccgaagcagggcccagcgagacagggcccagccccaagcgtgacccagctgcagagaagctgagacggtgattcggactgactggactctggcctccaggtgtctgcacctcacactggacccacctggagactccacgggctcccggcagctccggctgcttgggtggatccgggtgcccgcaggggctgtgggagggccccggggcctgcactgctcccccgatggcctgctcttcctcacggccggggctgcaccctgtgtccacgtgctagatctggagggacgccccatctgcctcctgccctgccgcactccggggagcggggccttcgttccagaggacgtggctgtgacagcgtcagggcttgtggtggtcagcgatcccatccatggggctgtccatgcactccagcacacagcccgggaccccgggggccactgggtgacagtgggcaccttcctgtctccccgagggctggctgtggatgccctcaaccgcctcctggtgacggactacttgcctggggctgtgcacagcttctcgttgggtcctgcttgggagcccctggccccagcctccatgctgggtctggagggcccctgctgggtgggcccagggcctgatgggggccttgctgtgagtgaggagtttggggatgtgaggctgtttggcagtgcccgccaacccctgggctccctggggggctggacggggcacactttcggctgcccagcgggcatctgctccaactcagagggcaatgttattgtggcagacgagcagaggcgccaggtgaccctgtttccccgggctgggccacccatctgcctggtgtcagaggggcttgggcagcccttgggagtggcctgtgcaccccagggccagctcctggtggctgatgccaaggacaactccatcaaggtgtaccagggcctcaaggagctggcctgacctgaggctgggttggagcagccctcctgtgcctgaggccagctcccaggcccttggatcaccgcgggaggaaccctcaggatgggtggagcctccaggctatgggcattgcctgcctgatgccagcaccacctgggctgggccctgggcttggctcgagttctcctgctggtgaggctccggatctcaggagcagccctgagtctgcttcccaggctgcccctgccaggcctgcagcctccccagccagggctgctctctgctgtccccattcagtgccctggcccctgcattcatgccccccacaccccctcaggccctgtgcctggactttggggctggcagctgaagccttgagatcctgggccagctgccggcacacagctaggcagactctcccaccaggtgcccctgcccaggcctcctaatcgggggcagacaggcagggagggtgtggctgggctgggctgggcggggcggcctggggcaggggtgtggcccctaaatgtccccaacctcagagggacctagagtcctgagcctccagtagcttctctgggcctggcagaggtaagggggaggcaaccctggagtgtctggaggcccatggctggctgaaccctggatgccttttcttccgcgtccccatgaatgaaagctgtctgggccttcattctgcagacagggacaaacagctccatgctgtttgtcctcccagtgcagccgtgctgggagggtctgggggagcttcctacaaggagagactcctgctgctttggaaaactgagaaaaaataggggtctaaccctctcctcccattttacaagtggggaaatgaggcgtgaaaggagaggcgtctgggttactccgtgggtctggggtccagggaagggcctgtatgggggagggagctgggaggggacggtgtctggctctacccctgtggggtggggaggtggggctcccctgtatcacaggacatcccccctgagaggtccctcatatgtctgggtcctgtgggtgggggactaactgcgcaatgtagttaggtgctcaataaacggagttgccgctga

SEQ ID NO: 5234 - DNA, 6535 bp, Homo sapiens
aggttcaaggactgttaatggtttgtaactgcctgacaataaactcaacctcagttacatcagcctgggcagatgtctaaggatatgagaccgggggaagaaaaagttagaatctgtagcagaaggacgaagcttgccacctgcctactgggctgagcttttaatgtgatttacatttctaagctctatgtaggtgccctggaaatggtggtcttcattaatgcaaagattaagtctttaattaaactttttaagaagaaaacggtttccaacctagatgaggaaagccgatggacagtccactacactgccccgtggcaccagcaggagaatgtgttccttcccaccacaagacccccctgtgttgaggacctgcaccgccaagccaagctcaacctcaaatcagtactgagggaatgcgataagttgcggcatgatggctaccgcagttctcagtactactctcagggacccacctttgcggccaacgccagcccattctgtgatgattaccaagatgaagatgaagaaacagatcaaaagtgttctctgtcttcatcagaagaagaaagatttatttccatcaggagacctaaaacaccagcctcaagtgacttctccgaccttaatactcagacgaactggaccaagtcgcttccactgccaacaccagaagagaagatgcgacagcaagcccaaacagtccaggctgacgtggtgcctattaacataactggggagaatttcgatcgccaggccagccttcggcggtctctaatttacacagacactctggtaagacgaccgaagaaagtcaaaaggagaaagactattacaggagtccctgacaacatacagaaggagctagcatcaggcactggccaagatgatgctgatggccactcagtgtacacccctgatcactactctacactaggaaggttcaatagctgtcggtctgctgggcagcgctcagaaaccagggactccagctgtcagacggaggatgtgaaggtcgtaccaccttccatgaggagaatcagggcacagaaggggcaaggcattgctgcccagatgggccacttctcaggttcctctggcaacatgtctgtgctgagcgattctgcagggatcgtattcccttcccgccttgacagtgatgctggcttccatagtcttccgcgttctggagcaagggcaaacattcagtcccttgagccgaggctgggtgccctcggccctgcaggagacatgaatggcactttcctctaccagagaggtcacccacaagcagatgaaaacttaggccatttaggaggtgcctcagggactggaacacttttgagacccaaatcccaggagttgagacacttcgagagtgaaaatataatgagcccagcgtgtgtggtttctcctcatgcaacctactccaccagcatcatcccaaatgccacactgtcttcctcttccgaggtcatcgctattcccactgctcagagtgcgggacagcgggaaagtaaaagttctggctcatcacatgcaaggataaaatccagagaccacctcatctccaggcatgctgtgaaaggtgatcctcagtctcccggtcgccactggaatgagggccatgccaccattctttcacaggacttagaccctcattcccctggtgaacccgcactgttgtccctctgtgactcagccgtccctctaaatgctccagcaaatagggagaatgggtcccaagctatgccgtataattgtagaaacaacctggccttcccagcccacccccaagatgtggatggcaagagtgaatctagttattcagggggcggagggcacagcagctcggagccctgggaatacaaatcctcaggtaatggaagggcatcccccctgaagccgcatttagcaactcctggctattccactcccacaagtaacatgagcagctgcagtttggaccaaacgtccaacaaagaggatgctgggtcgctgtattctgaggaccacgatggctactgtgcatctgtgcacactgactctggacatggatctgggaatctgtgcaatagcagtgatggctttgggaaccccaggcacagcgtgatcaatgtttttgttggaagagctcagaaaaaccaaggggaccggtccaattaccaggataaatccctatcaagaaacatctctttgaagaaagcaaagaagcctcccctgccaccctcccggacagactccctccgcaggattcccaagaagagcagccagtgcaacgggcaggtgctcaacgagagcctgatcgccacactccagcactcgctgcagctgagcctcccaggcaagagtggcagctcgccctcccagagcccctgcagtgacttggaagagccctggctgccccgctcccggagccagagcacagttagtgctggcagcagcatgacttccgccaccacccccaatgtctactccctgtgcggggccacgccatcgcagagtgacacaagcagcgtcaagtcagagtacacggacccctggggttattacattgactacacgggcatgcaggaagatccggggaacccggcagggggctgttcaaccagcagtggggtgcccactgggaacgggccagtccgccatgtccaagaagggtccagagccacaatgccccaagtgcccggtggttcagtcaaaccaaagatcatgtcaccagagaagtcacacagagtcatttctccatccagtgggtattccagccagtcgaatacacccacagcactcacccctgtgcctgtgtttttaaaatcagtgtcaccagcaaacgggaaggggaagcccaagcccaaggtaccagaaaggaagtcctctctgatatcttcagtatccatttcctcatcgtccacttctctttcttctagtacttctactgaaggaagtggcactatgaagaagctggatccagccgtgggctctcccccggctcctcctcctcctcctgttccctctcctccattcccttgtcctgcagacaggtctcctttccttcctcccccacctcctgtcacagattgctcccagggctctcctctgcctcactctcctgtgttcccccctccgccgccagaagctctcattcctttctgctccccacctgattggtgcctttctcctccccgccctgcactgagccccattcttccagattcacctgtgtccttgccattgcccccacctctcttaccttcctcggaacccccacctgccccacctcttgaccccaaattcatgaaagacaccaggccgcctttcacaaattctggccagccagaatcctcccggggatccttgaggccgccttctaccaaggaggagaccagcaggccccccatgcccctgataaccacggaagcattgcagatggtgcagttgaggcccgtgagaaagaactcaggcgctgaggcggcacagttgtctgaacgaacagctcaggaacaacgaactccagttgctccacagtaccacttaaagccatctgctttcctgaaatcccgaaatagcacaaatgaaatggagagtgaaagccagcctgcctctgtgacaagctcgcttccgacgcctgccaagagctcgagtcagggtgaccatggcagtgcggctgagcgtggtggccctgtgagccgcagccctggagctccaagcgctggggaggcagaggctcggcccagccccagcaccaccccactcccagactcttcacccagcaggaagccaccccccatttccaagaagcccaaactgttcctggtggtaccacctccgcagaaagattttgcagtggagcccgcagagaacgtgagcgaagccctccgagctgtgcccagccccacgacgggagaggagggctctgtgcacagcagggaggcaaaagagagttctgcagcccaagctggctctcatgccacgcaccctggcacctcggttcttgagggaggagctgcaggatccatgtctcccagcagagtggaagccaatgtccccatggttcagcctgatgtctcaccagcccccaagcaggaggagccagccgagaacagtgcggatactgggggcgatggggagagctgcctatctcaacaggacggagcagctggggtgccggagaccaacgcagccggttcatcctcagaggcctgtgacttcctcaaggaagacgggaatgatgaggtaatgacccccagtcgacccaggaccacagaagacctttttgcagctattcacagatccaaaaggaaagtcctcggccgtagagattcagatgatgaccactcccgaaaccattctccctccccgcccgtgacacccaccggcgctgccccaagcctggcctctccaaagcaagtggggtcgattcagagaagcatccgaaagagcagcaccagcagtgacaacttcaaagctctgctgctgaaaaagggcagtcgttcagacaccagcgcccgcatgtctgcagcagagatgctcaagaacacagaccctagattccagaggtcgaggtcagagccttccccagatgcccccgagagcccgtcaagctgctccccaagcaagaacagaagggcgcaggaggagtgggccaagaacgaaggcttgatgcctcggagtctgtccttttccggccccaggtacggccgcagccgaacgccgccttctgccgccagcagcaggtacagcatgcggaaccggatccagagcagccccatgaccgtcatctcggagggagaaggggaagccgtggagcctgtggacagcatagcccgcggggctctgggcgctgcggagggatgttccctggacggactggcgagggaggagatggacgagggcggcctgctctgtggggaggggcctgccgcctccctgcagccccaggcccccggccctgtggatgggacagccagtgcagagggcagagagccctccccacagtgtggcggttctctgagcgaggagagttagggccaagaacgtaactctcccaggtgacacggggggagacgagcaatgcagcactctaggaagcctgctaggcgcccttccctggctcacccggggagcccactctgcttctgtgctgtgggccccggggttgccagccctgcagtgtgagtgaacggttatttaggactcacctggcacttgccctgtggcttaagaacaagtagaagcttaaacttctgaaagtgcttcccggggaagattttttttttttttttttttttttgctaaatgctgggtgtgtatgtgtgcattttccacactttttaatttttaaaaaatacacatatacacaaacaacatgtacagaaatagaagaaagcaagccagacttaagcttggtagagtaacggagtcctctggtctaggcggtaattgctttcagagaattacgtttatagaaatcagcgagttttgtaagaaaggagaagatgttacttcaagaaagaggcagtagagttgctggttcttaatgcacagaacacacagatatatgcacacgtgtgctgctgaggtgaggcaggtctggtgagcacggagaggctgggaaggggctaagtgactaattggttcaggtacttttttctgggggaggtagactttgcttcttttttgtaaaaatgacaaacgtagaagtggcaatgctgtaacctggtgcctgctgctgtgcagccacatacacacaattgtagcctgatttttagaagtgtgggtaattttttaatgaatttcctccttgagtagcagctgaggtcattgacaactgaagtgatggtgtggacatagagagaggggaagggttggaaaggagtaagtgatacactgctggaatttgtttcctgcctatgaaataaaattatttttcagaattaaatttgaaaacttgcactacagaactatgggtggagcttttccttttacaacagtttttttttttttttttttttaaccagagtttaaacttccattaggcaatttcctgtcacttgaaatgtcaacatttgctaacttttggatatccttttggttacaccaaagaaaaagttatggctatttttttttccttgaactgcctacagtatcatgtcctaattcagaaagatttatcaaaatctattatatattatcttactttgaagaaaatgctgaatagctcttgttagtcaaataaactgataaaaattggtagggcctggctatcaattagccctgggaaatgaatttttagattaaaaaggtttttttgcatcatttggtttgtgcatttttatatttgtttataaataattgagttgctaattacttctaatcttctccaatcagattttcaacaattttagacatgggacacacgtgtgtgaagtctttattttaatgtaataatctcattacccccacccttactcccttaacttccatgtacttagactcctttatttgttaaataaactagagtattgtcttcttcatt

SEQ ID NO: 5235 - DNA, 7500 bp, Homo sapiens
gagcgcttcacagacgggaaggagagcaagtgggcggtttatgattctgccctgtgctggggcgagtgagctgagctctttgatttctcccaagtaaccgtgtgggtgaactgtaaactgggtgcctggcttgaccctgactctttttctctagggtgaggagttacttcaccagggcagctggctttctgccctggtggggaaagatgcccaggagaggagtaggattacaatttgggatgctagggacacgccaaagagtcggggtgccttggctttgtgttttgcaaagtcctgacaagtactcctgaaatgaacacgctgcttcattttttaaattatacttttatttgtttattattttttggccgtggatatcgcggatctagaaacggagtccacaatgtggctagggtaaaacatttttcttttctttcttaacccctccttttccctttctttttaattgggtgacacagaagccgtctttttggataatgcggtgcctgactgtcagcgttgtctaagagggaaacagcaggctcgtggagaggacctgggccaacgcaaaaaacccagcgttttgtttgctgggctgttctttgtctctagttgattttgaaaagaagatgaaaaaggaaggctcttcaggttccttcagactccagccgaatacaggttctctctcacgtgctgtaagttggataaatttctcctccttgtccaggcagacaaagaggctgtttcgcagtgatggagagctctcggtttgtgggcagcaggtggaagtggatgacgaaaactggatatacagagcccagcccagaaaagcggtttccaacctagatgaggaaagccgatggacagtccactacactgccccgtggcaccagcaggagaatgtgttccttcccaccacaagacccccctgtgttgaggacctgcaccgccaagccaagctcaacctcaaatcagtactgagggaatgcgataagttgcggcatgatggctaccgcagttctcagtactactctcagggacccacctttgcggccaacgccagcccattctgtgatgattaccaagatgaagatgaagaaacagatcaaaagtgttctctgtcttcatcagaagaagaaagatttatttccatcaggagacctaaaacaccagcctcaagtgacttctccgaccttaatactcagacgaactggaccaagtcgcttccactgccaacaccagaagagaagatgcgacagcaagcccaaacagtccaggctgacgtggtgcctattaacataactgcatcaggcactggccaagatgatgctgatggccactcagtgtacacccctgatcactactctacactaggaaggttcaatagctgtcggtctgctgggcagcgctcagaaaccagggactccagctgtcagacggaggatgtgaaggtcgtaccaccttccatgaggagaatcagggcacagaaggggcaaggcattgctgcccagatgggccacttctcaggttcctctggcaacatgtctgtgctgagcgattctgcagggatcgtattcccttcccgccttgacagtgatgctggcttccatagtcttccgcgttctggagcaagggcaaacattcagtcccttgagccgaggctgggtgccctcggccctgcaggagacatgaatggcactttcctctaccagagaggtcacccacaagcagatgaaaacttaggccatttaggaggtgcctcagggactggaacacttttgagacccaaatcccaggagttgagacacttcgagagtgaaaatataatgagcccagcgtgtgtggtttctcctcatgcaacctactccaccagcatcatcccaaatgccacactgtcttcctcttccgaggtcatcgctattcccactgctcagagtgcgggacagcgggaaagtaaaagttctggctcatcacatgcaaggataaaatccagagaccacctcatctccaggcatgctgtgaaaggtgatcctcagtctcccggtcgccactggaatgagggccatgccaccattctttcacaggacttagaccctcattcccctggtgaacccgcactgttgtccctctgtgactcagccgtccctctaaatgctccagcaaatagggagaatgggtcccaagctatgccgtataattgtagaaacaacctggccttcccagcccacccccaagatgtggatggcaagagtgaatctagttattcagggggcggagggcacagcagctcggagccctgggaatacaaatcctcaggtaatggaagggcatcccccctgaagccgcatttagcaactcctggctattccactcccacaagtaacatgagcagctgcagtttggaccaaacgtccaacaaagaggatgctgggtcgctgtattctgaggaccacgatggctactgtgcatctgtgcacactgactctggacatggatctgggaatctgtgcaatagcagtgatggctttgggaaccccaggcacagcgtgatcaatgtttttgttggaagagctcagaaaaaccaaggggaccggtccaattaccaggataaatccctatcaagaaacatctctttgaagaaagcaaagaagcctcccctgccaccctcccggacagactccctccgcaggattcccaagaagagcagccagtgcaacgggcaggtgctcaacgagagcctgatcgccacactccagcactcgctgcagctgagcctcccaggcaagagtggcagctcgccctcccagagcccctgcagtgacttggaagagccctggctgccccgctcccggagccagagcacagttagtgctggcagcagcatgacttccgccaccacccccaatgtctactccctgtgcggggccacgccatcgcagagtgacacaagcagcgtcaagtcagagtacacggacccctggggttattacattgactacacgggcatgcaggaagatccggggaacccggcagggggctgttcaaccagcagtggggtgcccactgggaacgggccagtccgccatgtccaagaagggtccagagccacaatgccccaagtgcccggtggttcagtcaaaccaaagatcatgtcaccagagaagtcacacagagtcatttctccatccagtgggtattccagccagtcgaatacacccacagcactcacccctgtgcctgtgtttttaaaatcagtgtcaccagcaaacgggaaggggaagcccaagcccaaggtaccagaaaggaagtcctctctgatatcttcagtatccatttcctcatcgtccacttctctttcttctagtacttctactgaaggaagtggcactatgaagaagctggatccagccgtgggctctcccccggctcctcctcctcctcctgttccctctcctccattcccttgtcctgcagacaggtctcctttccttcctcccccacctcctgtcacagattgctcccagggctctcctctgcctcactctcctgtgttcccccctccgccgccagaagctctcattcctttctgctccccacctgattggtgcctttctcctccccgccctgcactgagccccattcttccagattcacctgtgtccttgccattgcccccacctctcttaccttcctcggaacccccacctgccccacctcttgaccccaaattcatgaaagacaccaggccgcctttcacaaattctggccagccagaatcctcccggggatccttgaggccgccttctaccaaggaggagaccagcaggccccccatgcccctgataaccacggaagcattgcagatggtgcagttgaggcccgtgagaaagaactcaggcgctgaggcggcacagttgtctgaacgaacagctcaggaacaacgaactccagttgctccacagtaccacttaaagccatctgctttcctgaaatcccgaaatagcacaaatgaaatggagagtgaaagccagcctgcctctgtgacaagctcgcttccgacgcctgccaagagctcgagtcagggtgaccatggcagtgcggctgagcgtggtggccctgtgagccgcagccctggagctccaagcgctggggaggcagaggctcggcccagccccagcaccaccccactcccagactcttcacccagcaggaagccaccccccatttccaagaagcccaaactgttcctggtggtaccacctccgcagaaagattttgcagtggagcccgcagagaacgtgagcgaagccctccgagctgtgcccagccccacgacgggagaggagggctctgtgcacagcagggaggcaaaagagagttctgcagcccaagctggctctcatgccacgcaccctggcacctcggttcttgagggaggagctgcaggatccatgtctcccagcagagtggaagccaatgtccccatggttcagcctgatgtctcaccagcccccaagcaggaggagccagccgagaacagtgcggatactgggggcgatggggagagctgcctatctcaacaggacggagcagctggggtgccggagaccaacgcagccggttcatcctcagaggcctgtgacttcctcaaggaagacgggaatgatgaggtaatgacccccagtcgacccaggaccacagaagacctttttgcagctattcacagatccaaaaggaaagtcctcggccgtagagattcagatgatgaccactcccgaaaccattctccctccccgcccgtgacacccaccggcgctgccccaagcctggcctctccaaagcaagtggggtcgattcagagaagcatccgaaagagcagcaccagcagtgacaacttcaaagctctgctgctgaaaaagggcagtcgttcagacaccagcgcccgcatgtctgcagcagagatgctcaagaacacagaccctagattccagaggtcgaggtcagagccttccccagatgcccccgagagcccgtcaagctgctccccaagcaagaacagaagggcgcaggaggagtgggccaagaacgaaggcttgatgcctcggagtctgtccttttccggccccaggtacggccgcagccgaacgccgccttctgccgccagcagcaggtacagcatgcggaaccggatccagagcagccccatgaccgtcatctcggagggagaaggggaagccgtggagcctgtggacagcatagcccgcggggctctgggcgctgcggagggatgttccctggacggactggcgagggaggagatggacgagggcggcctgctctgtggggaggggcctgccgcctccctgcagccccaggcccccggccctgtggatgggacagccagtgcagagggcagagagccctccccacagtgtggcggttctctgagcgaggagagttagggccaagaacgtaactctcccaggtgacacggggggagacgagcaatgcagcactctaggaagcctgctaggcgcccttccctggctcacccggggagcccactctgcttctgtgctgtgggccccggggttgccagccctgcagtgtgagtgaacggttatttaggactcacctggcacttgccctgtggcttaagaacaagtagaagcttaaacttctgaaagtgcttcccggggaagattttttttttttttttttttttttgctaaatgctgggtgtgtatgtgtgcattttccacactttttaatttttaaaaaatacacatatacacaaacaacatgtacagaaatagaagaaagcaagccagacttaagcttggtagagtaacggagtcctctggtctaggcggtaattgctttcagagaattacgtttatagaaatcagcgagttttgtaagaaaggagaagatgttacttcaagaaagaggcagtagagttgctggttcttaatgcacagaacacacagatatatgcacacgtgtgctgctgaggtgaggcaggtctggtgagcacggagaggctgggaaggggctaagtgactaattggttcaggtacttttttctgggggaggtagactttgcttcttttttgtaaaaatgacaaacgtagaagtggcaatgctgtaacctggtgcctgctgctgtgcagccacatacacacaattgtagcctgatttttagaagtgtgggtaattttttaatgaatttcctccttgagtagcagctgaggtcattgacaactgaagtgatggtgtggacatagagagaggggaagggttggaaaggagtaagtgatacactgctggaatttgtttcctgcctatgaaataaaattatttttcagaattaaatttgaaaacttgcactacagaactatgggtggagcttttccttttacaacagtttttttttttttttttttttaaccagagtttaaacttccattaggcaatttcctgtcacttgaaatgtcaacatttgctaacttttggatatccttttggttacaccaaagaaaaagttatggctatttttttttccttgaactgcctacagtatcatgtcctaattcagaaagatttatcaaaatctattatatattatcttactttgaagaaaatgctgaatagctcttgttagtcaaataaactgataaaaattggtagggcctggctatcaattagccctgggaaatgaatttttagattaaaaaggtttttttgcatcatttggtttgtgcatttttatatttgtttataaataattgagttgctaattacttctaatcttctccaatcagattttcaacaattttagacatgggacacacgtgtgtgaagtctttattttaatgtaataatctcattacccccacccttactcccttaacttccatgtacttagactcctttatttgttaaataaactagagtattgtcttcttcattagaaggacctaggatgacaatgcggagagtcttggtctgaatctagtgcgactaccacctgccagcttttggggggtatggaaatactatctaaaagttggactgcatgggtcaaatcattatgagacttataaactaaaactttagatacccatatagaaatgtctttgaggcaaaaacaaacctaaagaatgaaggctctttcccttctctgaaaaaaacaaaacactgctcttcacacaaccggaagtcaagaccagagatttggagcaattgtctactaatttggcacaaagatcgtttctttagaaaagtggcattggcttttgaatatgaaatcttctcatagctgcctaaaaaagactagaatgtatatggatatcagaaacctttaataatacataatttatgcaaagataagataaagcaacataacactaattataaaactatttttaaatccccatttttaatgaaaaatatacatttgtatttaatttcctttgaataaaacaattgtaaagtaaa

SEQ ID NO: 5236 - DNA, 3978 bp, Homo sapiens
aaagaactccagattggacttcctggtgtaaatctcttcttgcttcacacaggtcatttccttggtagggtcgcagaaaaccttaagagctgcagggcttcaaagagaggaacttgcagtccaaagtagcaaaaggtgtctgcattctgagcctcttttcgtaactgagcactcaaggtggggatcattgagataagggcttggtccccaaaccaccacagcatgaatttattgactttctcttctcctcgatcctcatggtcctgggaagcaagcacttttccatttccaaatccagtggctcaaacacctggaaatagcctaaagaaaatgcaagtcaggcctggcagctagagcaggagtcctggctcatggcccttccccggcccagcgctcggccatggcaccctagagtgtgtgtctccactgtgctatttttcagaagaatatgaggaacagtactcggaggccagacttgtggggcagaccttccgctcttctgatgaggccactaagcccacccccaacccaaggccccagtctgccaggcgtctggagtttatattgatggtgagttgcctcatcccccacctgggagagccagcatgcacccactgacaagagacctccagctgcttactttacccactggaagctgctcagccctgctcaccagcagagctaccctgaggccccactgggataggccctgcacagcaggtgcctggcctggtggcctgtccacgctttcctgcctcccagacgaagcctccaactacccagcctaaacagccaccctatgggcactggctcattgccaggcaggaatacaccctttccatcaccttctctcccaacagcctacaaaacggcagctgagcgaggatgagactaccacccagggtgtgagggcccccgaggcctccctgagcctgtctaccacagccgacaagcaaactgcctggaatagccttttccctctgcccatcctagaggagaagcggtggcctcagctttgctccacgcagtctgacattgtgcccatcaacatctctggtcacagcaacagcccagcaggcagtgtggcccactctaccacctccgacatcaggcccagtcactcagttccagaaggggttcatggaagagttgcagttggtcaggatgctcggttcccaagtctcacctcgccagtactgagaactccttccagtgagccggacgaacctcaccaggcacggagtggcccaaaccctcctggcatggagagcatgggaatggtgtacagtgtccccagttcttgcaatggacctacagaatcaaccttctccacttcctggaagggagatgcttttacctacatgactccaagtgccaccagccagagcaatcaagtcaatgaaaatgggaaaaatccttcctgtgggaattcttgggtctctctaaacaaagtcccacctctggttcctaaggaggctgctaccctccttgtcgctcgtgataacccagcaggatgcagtgggtcagctggctaccctgagcgccttattcagcaaaggcacatgcccgaaagaccctccaagattggccttctgaccagtgggacctcgaggctggagacaggccccggtggggccagcagattccgggagcggtcactgtctgtgcccacagactcaggcaccacagatgtggactatgatgaggagcagaaggccaatgaggcctgtgccctgccttttgccagtacgagctctgagggcagtaacagtgctgacaacattgcctcccttagtgcccagcaagaggcccagcacagaaggcagaggtccaagagtatctcacttaggaaggccaaaaagaagccttccccacccacacgcagtgtctcactggtcaaagatgagccaggcctcttgcctgaaggtgggtcagcactacccaaggaccagaggcccaagagcctttgcctctccttggaacatcaaggacatcactcgtcccacccagatgctcagggtcacccagctattccaaaccacaaagatccagaaagtacacaattctcccaccactggtatcttactgactggaagtctggtgacacctaccaatccctgtccagctccagcactgccactggcaccacagtcattgagtgcacccaagttcagggcagctcagagtctcttgcctcaccttccacctccagagccactacaccttcccaactctccattgaagtggaggccagggagatatcatccccgggaaggccccctggactgatgtcaccctccagtggctactccagccagtcggaaacaccaacacccactgtttccatgtccctgaccctgggccacttaccccctccaagcagcagtgtccgggtacgtccagtggtacctgagaggaagtcatcactacccccgacgtcaccaatggagaaatttcccaagtcacggctatcatttgacctaccactgacctcttcacccaacctggatctgtctgggatgagtatctccatccgaagcaaaactaaggtgagtcggcaccactcagagacaaattttggcgtcaagctggcccagaaaactaatcccaaccagccaatcatgcctatggttactcagtccgacctacgttctgttcgcctgaggtcggtcagcaagtctgagccggaagatgatattgagagccctgagtatgccgaggaacccagagcagaagaagtcttcaccttgccagagagaaagacaaaacctcccgtagctgagaagcctccggtggcccggaggcctccaagcttggtccacaagccaccatctgttcctgaggagtatgcactaacttcaccaaccttggctatgccccccaggagctcaattcaacatgcgagaccactccctcaagacagctacacggtagtgcggaaaccaaagccctccagcttcccagatggcagaagcccaggggagtcaacagcaccctcatctcttgttttcacgccttttgccagttcctctgatgctttcttctcaggaacacagcagcctccccagggaagtgtagaggacgagggccccaaggtgagggttctgcctgaaagaattagcctccagagccaggaagaagctgagaaaaagaaaggcaagattccacctcccgtaccaaaaaaacccagcgtgctgtacctgcctctcacttctcccacagctcaaatggaggcctatgtggcagaaccaaggctgcctctcagccccatcatcaccctggaggaagacaccaagtgtcccgccaccggcgatgacctgcaatcacttggtcaaagggtgacttcaactcctcaggctgacagtgaaagggaggcaagccctctgggttagtaaactgtctgctggctttttccttcagtcacaggagagatgagggtgagaatggagtgccagagatggaagcagatgccccagaataattatcctgatcccaagtcagtagcgggcaccctttgagggtttgagttactctaaataggaaccacgggctggccttactgcccttgagatcaagactagcccgaggcagatctccaaggcccagtttaggccactctcccctctaaatctctagtgctgagataatgaaatcaaactaggttctagcaccctaggacttcagcatcccacatccctagccaagcatgcatcctgtcttgggaactactccacctcactgtacagtacttttcattggctgcagtgaatttagttccctacatgggacccagtaccccaccagactgagttcaagtgccatggcaggctcggagccatctgaaacaacggaatatgttgccaccagcagcctctttttgtgccttccggaggaaagggagctcactttcttgggtggtttgagttctttggctcttcctggaaccataaacataatacataatgcttctcatccttt

SEQ ID NO: 5237 - DNA, 3082 bp, Homo sapiens
gatgaggccactaagcccacccccaacccaaggccccagtctgccaggcgtctggagtttatattgatgcctacaaaacggcagctgagcgaggatgagactaccacccagggtgtgagggcccccgaggcctccctgagcctgtctaccacagccgacaagcaaactgcctggaatagccttttccctctgcccatcctagaggagaagcggtggcctcagctttgctccacgcagtctgacattgtgcccatcaacatctctggtcacagcaacagcccagcaggcagtgtggcccactctaccacctccgacatcaggcccagtcactcagttccagaaggggttcatggaagagttgcagttggtcaggatgctcggttcccaagtctcacctcgccagtactgagaactccttccagtgagccggacgaacctcaccaggcacggagtggcccaaaccctcctggcatggagagcatgggaatggtgtacagtgtccccagttcttgcaatggacctacagaatcaaccttctccacttcctggaagggagatgcttttacctacatgactccaagtgccaccagccagagcaatcaagtcaatgaaaatgggaaaaatccttcctgtgggaattcttgggtctctctaaacaaagtcccacctctggttcctaaggaggctgctaccctccttgtcgctcgtgataacccagcaggatgcagtgggtcagctggctaccctgagcgccttattcagcaaaggcacatgcccgaaagaccctccaagattggccttctgaccagtgggacctcgaggctggagacaggccccggtggggccagcagattccgggagcggtcactgtctgtgcccacagactcaggcaccacagatgtggactatgatgaggagcagaaggccaatgaggcctgtgccctgccttttgccagtacgagctctgagggcagtaacagtgctgacaacattgcctcccttagtgcccagcaagaggcccagcacagaaggcagaggtccaagagtatctcacttaggaaggccaaaaagaagccttccccacccacacgcagtgtctcactggtcaaagatgagccaggcctcttgcctgaaggtgggtcagcactacccaaggaccagaggcccaagagcctttgcctctccttggaacatcaaggacatcactcgtcccacccagatgctcagggtcacccagctattccaaaccacaaagatccagaaagtacacaattctcccaccactggtatcttactgactggaagtctggtgacacctaccaatccctgtccagctccagcactgccactggcaccacagtcattgagtgcacccaagttcagggcagctcagagtctcttgcctcaccttccacctccagagccactacaccttcccaactctccattgaagtggaggccagggagatatcatccccgggaaggccccctggactgatgtcaccctccagtggctactccagccagtcggaaacaccaacacccactgtttccatgtccctgaccctgggccacttaccccctccaagcagcagtgtccgggtacgtccagtggtacctgagaggaagtcatcactacccccgacgtcaccaatggagaaatttcccaagtcacggctatcatttgacctaccactgacctcttcacccaacctggatctgtctgggatgagtatctccatccgaagcaaaactaaggtgagtcggcaccactcagagacaaattttggcgtcaagctggcccagaaaactaatcccaaccagccaatcatgcctatggttactcagtccgacctacgttctgttcgcctgaggtcggtcagcaagtctgagccggaagatgatattgagagccctgagtatgccgaggaacccagagcagaagaagtcttcaccttgccagagagaaagacaaaacctcccgtagctgagaagcctccggtggcccggaggcctccaagcttggtccacaagccaccatctgttcctgaggagtatgcactaacttcaccaaccttggctatgccccccaggagctcaattcaacatgcgagaccactccctcaagacagctacacggtagtgcggaaaccaaagccctccagcttcccagatggcagaagcccaggggagtcaacagcaccctcatctcttgttttcacgccttttgccagttcctctgatgctttcttctcaggaacacagcagcctccccagggaagtgtagaggacgagggccccaaggtgagggttctgcctgaaagaattagcctccagagccaggaagaagctgagaaaaagaaaggcaagattccacctcccgtaccaaaaaaacccagcgtgctgtacctgcctctcacttctcccacagctcaaatggaggcctatgtggcagaaccaaggctgcctctcagccccatcatcaccctggaggaagacaccaagtgtcccgccaccggcgatgacctgcaatcacttggtcaaagggtgacttcaactcctcaggctgacagtgaaagggaggcaagccctctgggttagtaaactgtctgctggctttttccttcagtcacaggagagatgagggtgagaatggagtgccagagatggaagcagatgccccagaataattatcctgatcccaagtcagtagcgggcaccctttgagggtttgagttactctaaataggaaccacgggctggccttactgcccttgagatcaagactagcccgaggcagatctccaaggcccagtttaggccactctcccctctaaatctctagtgctgagataatgaaatcaaactaggttctagcaccctaggacttcagcatcccacatccctagccaagcatgcatcctgtcttgggaactactccacctcactgtacagtacttttcattggctgcagtgaatttagttccctacatgggacccagtaccccaccagactgagttcaagtgccatggcaggctcggagccatctgaaacaacggaatatgttgccaccagcagcct

SEQ ID NO: 5238 - DNA, 3678 bp, Homo sapiens
atgccgttctacaggcgcacggtggtaccccagcgcctgtgcccgcgcaacccgccgcagcagctggcggagctccgcgacgtgagccacctggcagcgctcagcctgctccggcagctcgccgacctctgtggccactcgttggctctgctcgaggacctcgaggggcacctgctggccctggggcgccgcacagacagcctgtaccggcgcaccgtgcgcctccgccgccgccttccctgccgcctgcttggcccggaggaggacgaggaagagctagctgcagctaactcgggtcgggaaaatgcgacagcgactgcccactcgaggtcgtcatggcgacagccagtgaacgtgttcctctcctcgggcaggcccccgagtgtagaggagctgcttcgggaggcgcagctcaatctccagagcctgttgcaagaagaatatgaggaacagtactcggaggccagacttgtggggcagaccttccgctcttctgatgaggccactaagcccacccccaacccaaggccccagtctgccaggcgtctggagtttatattgatgcctacaaaacggcagctgagcgaggatgagactaccacccagggtgtgagggcccccgaggcctccctgagcctgtctaccacagccgacaagcaaactgcctggaatagccttttccctctgcccatcctagaggagaagcggtggcctcagctttgctccacgcagtctgacattgtgcccatcaacatctctgggcagcagtttgataaacatgcaagtttgcgacactcgttgtttaacacagagacagccgtgaaccccaagtccaccctgaggcggaggcggaccattattggattctctaacttttcccagcgagaccaaggtcacagcaacagcccagcaggcagtgtggcccactctaccacctccgacatcaggcccagtcactcagttccagaaggggttcatggaagagttgcagttggtcaggatgctcggttcccaagtctcacctcgccagtactgagaactccttccagtgagccggacgaacctcaccaggcacggagtggcccaaaccctcctggcatggagagcatgggaatggtgtacagtgtccccagttcttgcaatggacctacagaatcaaccttctccacttcctggaagggagatgcttttacctacatgactccaagtgccaccagccagagcaatcaagtcaatgaaaatgggaaaaatccttcctgtgggaattcttgggtctctctaaacaaagtcccacctctggttcctaaggaggctgctaccctccttgtcgctcgtgataacccagcaggatgcagtgggtcagctggctaccctgagcgccttattcagcaaaggcacatgcccgaaagaccctccaagattggccttctgaccagtgggacctcgaggctggagacaggccccggtggggccagcagattccgggagcggtcactgtctgtgcccacagactcaggcaccacagatgtggactatgatgaggagcagaaggccaatgaggcctgtgccctgccttttgccagtacgagctctgagggcagtaacagtgctgacaacattgcctcccttagtgcccagcaagaggcccagcacagaaggcagaggtccaagagtatctcacttaggaaggccaaaaagaagccttccccacccacacgcagtgtctcactggtcaaagatgagccaggcctcttgcctgaaggtgggtcagcactacccaaggaccagaggcccaagagcctttgcctctccttggaacatcaaggacatcactcgtcccacccagatgctcagggtcacccagctattccaaaccacaaagatccagaaagtacacaattctcccaccactggtatcttactgactggaagtctggtgacacctaccaatccctgtccagctccagcactgccactggcaccacagtcattgagtgcacccaagttcagggcagctcagagtctcttgcctcaccttccacctccagagccactacaccttcccaactctccattgaagtggaggccagggagatatcatccccgggaaggccccctggactgatgtcaccctccagtggctactccagccagtcggaaacaccaacacccactgtttccatgtccctgaccctgggccacttaccccctccaagcagcagtgtccgggtacgtccagtggtacctgagaggaagtcatcactacccccgacgtcaccaatggagaaatttcccaagtcacggctatcatttgacctaccactgacctcttcacccaacctggatctgtctgggatgagtatctccatccgaagcaaaactaaggtgagtcggcaccactcagagacaaattttggcgtcaagctggcccagaaaactaatcccaaccagccaatcatgcctatggttactcagtccgacctacgttctgttcgcctgaggtcggtcagcaagtctgagccggaagatgatattgagagccctgagtatgccgaggaacccagagcagaagaagtcttcaccttgccagagagaaagacaaaacctcccgtagctgagaagcctccggtggcccggaggcctccaagcttggtccacaagccaccatctgttcctgaggagtatgcactaacttcaccaaccttggctatgccccccaggagctcaattcaacatgcgagaccactccctcaagacagctacacggtagtgcggaaaccaaagccctccagcttcccagatggcagaagcccaggggagtcaacagcaccctcatctcttgttttcacgccttttgccagttcctctgatgctttcttctcaggaacacagcagcctccccagggaagtgtagaggacgagggccccaaggtgagggttctgcctgaaagaattagcctccagagccaggaagaagctgagaaaaagaaaggcaagattccacctcccgtaccaaaaaaacccagcgtgctgtacctgcctctcacttctcccacagctcaaatggaggcctatgtggcagaaccaaggctgcctctcagccccatcatcaccctggaggaagacaccaagtgtcccgccaccggcgatgacctgcaatcacttggtcaaagggtgacttcaactcctcaggctgacagtgaaagggaggcaagccctctggggagttctgtggaaccaggcaccgaagaaaaaagtttaatcagtgataaaacagctgaatggattgcagaggatgatgatgacgtgtttgtggcttcacgcacaactgaagatttatttactgtgatacacaggtccaaaaggaagctgctcggctggaaggaacctggtgaggcctttgtgggtggcagaacgagttcccactcaccaataaagaacacagctgagtctccaatcagtgagtctaccgccactgcagggtcaggcagcagtgccaacctagatgctggcagaaatgacgatttcaaggccttgctacagaagaagggaagtaaggcaactccaaggtctcgtccctcagcagctgaacttctgaagaccactaacccactggctcggagaattattgcacaattttcaaaagactatgaaaccaccgataaccccagtacctaa

SEQ ID NO: 5239 - DNA, 2638 bp, Homo sapiens
ctggaggaggatttgattggaaaaccaacggtgcagctggccgcggtgtccctgaggttgaggggaccgggaataggctggggggaggacgggacgggctgagactggacgggacccccggtctgcagcagcaggtgacagcagcagggacaatgataaggagattggcctgaaggagggaccgtccctcccgcgcgaaaagtcagaaatggccaatgaagcttttgcttataaaaggaatgcgatgttaattctggggcattgatgttttacaatgcctgatcaagataaaaaggtgaagaccacagaaaaatcaactgataaacagcaagaaatcaccatcagggactattcagatcttaaaagacttcggtgccttttgaacgtccaatcaagcaaacaacagcttccagccattaacttcgatagtgcccaaaatagcatgacgaagtctgagcccgccatcagggcgggtggacacagagctcggggtcagtggcatgaatccacagaagctgttgaacttgaaaattttagtataaactacaagaatgagagaaatttcagcaaacatcctcagcgtaaactatttcaggagatctttaccgccttggtgaaaaatagactcataagcagagagtgggttaatcgagccccatctattcattttctgagagtgttaatctgtctgaggctactaatgagggatccatgttatcaggaaatactccatagcttgggtgggattgaaaacctagctcagtatatggagattgtagccaatgagtacctcggctatggagaagagcagcacactgtggacaagctggtcaacatgacatatatttttcaaaaacttgctgcagtcaaagatcaaagagaatgggtcaccacaagtggagcccacaagacattagtaaatttacttggtgcccgagatactaatgttctattgggttcccttctggctctggctagtttagcagaaagtcaagaatgtagggagaagataagtgaactcaacattgtagaaaatctgttgatgattttacatgaatatgacttgctttctaaaagactaacagcggagttgctgcgcctactttgtgcagagccccaggtgaaagagcaggtgaagctctatgaggggataccggtcctcctcagtctgctccactctgaccacttgaagctcctctggagcattgtctggattctggtacaggtttgtgaggaccctgagaccagcgtggaaattcgcatttggggaggcatcaaacagcttcttcatattttacaaggagacagaaattttgtttctgatcactcctccattggaagcctgtccagtgcaaatgctgcaggccgaatccagcagcttcatttatcagaagacttgagccctagggaaatacaagaaaatactttctcacttcaagcagcctgctgtgctgccctcactgagctggtgctcaatgacaccaatgcccaccaggtggttcaggaaaatggtgtatatacaatagcaaaattaattttaccaaataagcaaaagaatgcagcaaaaagtaatctattacagtgttatgctttcagagccttgagatttctcttcagtatggaaagaaacagaccactctttaaaagacttttccccacagacttgtttgagatcttcattgacatagggcattatgtacgtgatatcagtgcttatgaagaattggtatccaagctgaatttattagtggaggatgaactgaagcaaattgctgaaaatattgaaagcattaatcagaacaaagctcctttgaaatatataggcaactatgcaattttggatcatcttggaagtggagcttttggctgtgtttacaaggttagaaagcatagtggtcaaaatcttttagcaatgaaagaggtcaatttacataacccagcatttggaaaggataagaaagatcgagacagcagcgtaaggaatattgtttctgaattaacaataattaaagagcagctttatcatcccaacattgtacgttattacaaaacatttctggaaaatgataggttgtacatagttatggagctgatagaaggagccccgcttggagagcatttcagttctttgaaggaaaaacatcaccattttactgaagaaagactatggaaaatatttatacagctgtgcttagctcttcgatacttacacaaggagaagaggattgtccatagagatctgacaccaaacaacattatgttgggggataaggacaaagtaaccgttactgactttggcctggcaaagcaaaaacaagaaaacagtaaactcacctctgtggttggaacaatcctgtattcttgtgtgcagcacctctaccttcgctctcctgctcctgctctggccacataaaacgtgctggctcctcctttgccttctgctatcattggaagcttcctgatgcctcccaagaagcaaatgccatcatggttcctgtacagcctgcagaaccgtgagccaattaaacctctcttctttctaaattacctagtctcaggtatttctttgtagtagtgcaagaacggattcatacactctttaaatgtgataaacaaaataaagtacaatccttatttc

SEQ ID NO: 5240 - DNA, 1599 bp, Homo sapiens
ttgattaggaggatgaactgaagcaaattgctgaaaatattgaaagcattaatcagaacaaagctcctttgaaatatataggcaactatgcaattttggatcatcttggaagtggagcttttggctgtgtttacaagctttatcatcccaacattgtacgttattacaaaacatttctggaaaatgataggttgtacatagttatggagctgatagaaggagccccgcttggagagcatttcagttctttgaaggaaaaacatcaccattttactgaagaaagactatggaaaatatttatacagctgtgcttagctcttcgatacttacacaaggagaagaggattgtccatagagatctgacaccaaacaacattatgttgggggataaggacaaagtaaccgttactgactttggcctggcaaagcaaaaacaagaaaacagtaaactcacctctgtggttggaacaatcctgtattcttgccccgaggtactgaagagtgagccgtatggggagaaggctgatgtctgggcagtaggctgcatcctttatcagatggcgactttgagtccccccttctacagcactaacatgctgtccttggctacaaaaatagtggaggcggtatatgaaccagtcccagaaggtatctactctgaaaaagtaacagacaccatcagcaggtgcctcactcctgatgcggaagctcgtccagatattgtagaagtcagttcgatgatatcagatgtcatgatgaaatatttagacaacttatctacatcccagttgtccttggaaaagaagctagaacgggaacgaagacgcacacaaaggtattttatggaagccaaccggaacaccgtcacatgtcaccatgagctggctgttctatctcacgagacctttgagaaggcaagtttgagtagcagcagcagtggagcagccagcctgaaaagtgaactttcagaaagcgcagacctgccccctgaaggcttccaggcctcctatggtaaagacgaagacagggcctgtgacgaaatcctgtcagatgataacttcaacctggaaaatgctgagaaagatacatattcagaggtagatgatgaattggacatttcggataactccagcagctccagttcaagccctctgaaagaatctacattcaacattttaaagagaagttttagtgcttcaggaggagaaagacaatcccaaacaagggacttcactggaggaacaggatcaagaccaagaccagctttgctgcctcttgacctgcttctgaaagtgccaccccacatgctcagggcccacattaaggaaatagaggctgagttagtgacagggtggcagtcccatagccttcctgctgtgattcttcgaaatctcaaagatcatggtagtacttactagatcacattgatgttaagcacacaatgggcaaatgcagaattatagttgggcctgagatgtctgaacgatgcttgggtggtaattttaatacaaagagcggagaattctgccttgtttgttcaccattattagtttggcgatttgatggtaacaaaatgccttctgtgttcactgttggttg

SEQ ID NO: 5241 - DNA, 1872 bp, Homo sapiens
agaaataatgtatggagggactatacaagggcatatatactagtaaaagtgttttctcaatagatcaccaaagaatttgccacacctgatatatagaaaagtttattgtgcagcacctctaccttcgctctcctgctcctgctctggccacataaaacgtgctggctcctcctttgccttctgctatcattggaagcttcctgatgcctcccaagaagcaaatgccatcatggttcctgtacagcctgcagaaccccccgaggtactgaagagtgagccgtatggggagaaggctgatgtctgggcagtaggctgcatcctttatcagatggcgactttgagtccccccttctacagcactaacatgctgtccttggctacaaaaatagtggaggcggtatatgaaccagtcccagaaggtatctactctgaaaaagtaacagacaccatcagcaggtgcctcactcctgatgcggaagctcgtccagatattgtagaagtcagttcgatgatatcagatgtcatgatgaaatatttagacaacttatctacatcccagttgtccttggaaaagaagctagaacgggaacgaagacgcacacaaaggtattttatggaagccaaccggaacaccgtcacatgtcaccatgagctggctgttctatctcacgagacctttgagaaggcaagtttgagtagcagcagcagtggagcagccagcctgaaaagtgaactttcagaaagcgcagacctgccccctgaaggcttccaggcctcctatggtaaagacgaagacagggcctgtgacgaaatcctgtcagatgataacttcaacctggaaaatgctgagaaagatacatattcagaggtagatgatgaattggacatttcggataactccagcagctccagttcaagccctctgaaagaatctacattcaacattttaaagagaagttttagtgcttcaggaggagaaagacaatcccaaacaagggacttcactggaggaacaggatcaagaccaagaccagcatcagcaggaattgctgtgtcccagaggaaagtgcgtcagatcagtgatcctattcagcagatattaattcagctgcacaaaataatctatatcacacagcttcctccagctttgcaccacaatttgaaaagaagggttatagagagattcaagaaatccctcttcagccagcagagtaacccttgtaatttgaaatctgaaattaaaaagttatctcagggatctccagaaccgattgagcccaactttttcacagcagattaccatttattacatcgttcatccggtggaaacagcctgtccccaaatgaccctacaggtttaccaaccagcattgaattggaggaaggaataacatatgaacagatgcagactgtgattgaagaagtccttgaggaaagtggctattacaattttacatctaacaggtatcattcctatccatgggggaccaagaatcacccaaccaaaagatgaaaatgctgcattttgagtggacttgattttctcagtgaagttcaagttctggacttcagccgctattgcaagatgcccaaggattgggtgctgctagagggtgtggaaaagaccaagatgccatggggcctgcaggacttctttctgggggtcctgtgctggagtatatgacagctgcggtacttgagggcttcattgccagaacacattatatacaggatgtcagagctaccagtgtgctgctgggagaaaatgctgcaaaattcatcttttggagggtggggggaaaacccaaaaacaacaacaaaaaaactctcttacagaattttccttaacattaaaaaaaacttgtcatattt

SEQ ID NO: 5242 - DNA, 2023 bp, Homo sapiens
agaaataatgtatggagggactatacaagggcatatatactagtaaaagtgttttctcaatagatcaccaaagaatttgccacacctgatatatagaaaagtttattgtgcagcacctctaccttcgctctcctgctcctgctctggccacataaaacgtgctggctcctcctttgccttctgctatcattggaagcttcctgatgcctcccaagaagcaaatgccatcatggttcctgtacagcctgcagaaccccccgaggtactgaagagtgagccgtatggggagaaggctgatgtctgggcagtaggctgcatcctttatcagatggcgactttgagtccccccttctacagcactaacatgctgtccttggctacaaaaatagtggaggcggtatatgaaccagtcccagaaggtatctactctgaaaaagtaacagacaccatcagcaggtgcctcactcctgatgcggaagctcgtccagatattgtagaagtcagttcgatgatatcagatgtcatgatgaaatatttagacaacttatctacatcccagttgtccttggaaaagaagctagaacgggaacgaagacgcacacaaaggtattttatggaagccaaccggaacaccgtcacatgtcaccatgagctggctgttctatctcacgagacctttgagaaggcaagtttgagtagcagcagcagtggagcagccagcctgaaaagtgaactttcagaaagcgcagacctgccccctgaaggcttccaggcctcctatggtaaagacgaagacagggcctgtgacgaaatcctgtcagatgataacttcaacctggaaaatgctgagaaagatacatattcagaggtagatgatgaattggacatttcggataactccagcagctccagttcaagccctctgaaagaatctacattcaacattttaaagagaagttttagtgcttcaggaggagaaagacaatcccaaacaagggacttcactggaggaacaggatcaagaccaagaccagctttgctgcctcttgacctgcttctgaaagtgccaccccacatgctcagggcccacattaaggaaatagaggctgagttagtgacagggtggcagtcccatagccttcctgctgtgattcttcgaaatctcaaagatcatgcatcagcaggaattgctgtgtcccagaggaaagtgcgtcagatcagtgatcctattcagcagatattaattcagctgcacaaaataatctatatcacacagcttcctccagctttgcaccacaatttgaaaagaagggttatagagagattcaagaaatccctcttcagccagcagagtaacccttgtaatttgaaatctgaaattaaaaagttatctcagggatctccagaaccgattgagcccaactttttcacagcagattaccatttattacatcgttcatccggtggaaacagcctgtccccaaatgaccctacaggtttaccaaccagcattgaattggaggaaggaataacatatgaacagatgcagactgtgattgaagaagtccttgaggaaagtggctattacaattttacatctaacaggtatcattcctatccatgggggaccaagaatcacccaaccaaaagatgaaaatgctgcattttgagtggacttgattttctcagtgaagttcaagttctggacttcagccgctattgcaagatgcccaaggattgggtgctgctagagggtgtggaaaagaccaagatgccatggggcctgcaggacttctttctgggggtcctgtgctggagtatatgacagctgcggtacttgagggcttcattgccagaacacattatatacaggatgtcagagctaccagtgtgctgctgggagaaaatgctgcaaaattcatcttttggagggtggggggaaaacccaaaaacaacaacaaaaaaactctcttacagaattttccttaacattaaaaaaaacttgtcatatttttcaaaggca

SEQ ID NO: 5243 - DNA, 2452 bp, Homo sapiens
ctggaggaggatttgattggaaaaccaacggtgcagctggccgcggtgtccctgaggttgaggggaccgggaataggctggggggaggacgggacgggctgagactggacgggacccccggtctgcagcagcaggtgacagcagcagggacaatgataaggagattggcctgaaggagggaccgtccctcccgcgcgaaaagtcagaaatggccaatgaagcttttgcttataaaaggaatgcgatgttaattctggggcattgatgttttacaatgcctgatcaagataaaaaggtgaagaccacagaaaaatcaactgataaacagcaagaaatcaccatcagggactattcagatcttaaaagacttcggtgccttttgaacgtccaatcaagcaaacaacagcttccagccattaacttcgatagtgcccaaaatagcatgacgaagtctgagcccgccatcagggcgggtggacacagagctcggggtcagtggcatgaatccacagaagctgttgaacttgaaaattttagtataaactacaagaatgagagaaatttcagcaaacatcctcagcgtaaactatttcaggagatctttaccgccttggtgaaaaatagactcataagcagagagtgggttaatcgagccccatctattcattttctgagagtgttaatctgtctgaggctactaatgagggatccatgttatcaggaaatactccatagcttgggtgggattgaaaacctagctcagtatatggagattgtagccaatgagtacctcggctatggagaagagcagcacactgtggacaagctggtcaacatgacatatatttttcaaaaacttgctgcagtcaaagatcaaagagaatgggtcaccacaagtggagcccacaagacattagtaaatttacttggtgcccgagatactaatgttctattgggttcccttctggctctggctagtttagcagaaagtcaagaatgtagggagaagataagtgaactcaacattgtagaaaatctgttgatgattttacatgaatatgacttgctttctaaaagactaacagcggagttgctgcgcctactttgtgcagagccccaggtgaaagagcaggtgaagctctatgaggggataccggtcctcctcagtctgctccactctgaccacttgaagctcctctggagcattgtctggattctggtacaggtttgtgaggaccctgagaccagcgtggaaattcgcatttggggaggcatcaaacagcttcttcatattttacaaggagacagaaattttgtttctgatcactcctccattggaagcctgtccagtgcaaatgctgcaggccgaatccagcagcttcatttatcagaagacttgagccctagggaaatacaagaaaatactttctcacttcaagcagcctgctgtgctgccctcactgagctggtgctcaatgacaccaatgcccaccaggtggttcaggaaaatggtgtatatacaatagcaaaattaattttaccaaataagcaaaagaatgcagcaaaaagtaatctattacagtgttatgctttcagagccttgagatttctcttcagtatggaaagaaacagaccactctttaaaagacttttccccacagacttgtttgagatcttcattgacatagggcattatgtacgtgatatcagtgcttatgaagaattggtatccaagctgaatttattagtggaggatgaactgaagcaaattgctgaaaatattgaaagcattaatcagaacaaagctcctttgaaatatataggcaactatgcaattttggatcatcttggaagtggagcttttggctgtgtttacaaggttagaaagcatagtggtcaaaatcttttagcaatgaaagaggtcaatttacataacccagcatttggaaaggataagaaagatcgagacagcagcgtaaggaatattgtttctgaattaacaataattaaagagcagctttatcatcccaacattgtacgttattacaaaacatttctggaaaatgataggttgtacatagttatggagctgatagaaggagccccgcttggagagcatttcagttctttgaaggaaaaacatcaccattttactgaagaaagactatggaaaatatttatacagctgtgcttagctcttcgatacttacacaaggagaagaggattgtccatagagatctgacaccaaacaacattatgttgggggataaggacaaagtaaccgttagttgtttaaagtgtgcagcacctctaccttcgctctcctgctcctgctctggccacataaaacgtgctggctcctcctttgccttctgctatcattggaagcttcctgatgcctcccaagaagcaaatgccatcatggttcctgtacagcctgcagaaccgtga

SEQ ID NO: 5244 - DNA, 653 bp, Homo sapiens
ggtgcagctggccgcggtgtccctgaggttgaggggaccgggaataggctggggggaggacgggacgggctgagactggacgggacccccggtctgcagcagcaggtgacagcagcagggacaatgataaggagattggcctgaaggagggaccgtccctcccgcgcgtggtataaccagaagaattcacattcccagacttgtcaacttgcatcagtggagacagtggcattcatataatacacatgtgtatgctacacttgacacaatgtgaatactcatctttcctttaggaaaccttattgtcctgttcatgtatacttgaggaatgcgatgttaattctggggcattgatgttttacaatgcctgatcaagataaaaaggtgaagaccacagaaaaatcaactgataaacagcaagaaatcaccatcagggactattcagatcttaaaagacttcggtgccttttgaacgtccaatcaagcaaacaacagcttccagccattaacttcgatagtgcccaaaatagcatgacgaagtctgagcccgccatcagggcgggtggacacagagctcggggtcagtggcatgaatccacagaagctgttgaacttgaaaattttagtataaactacaagaatgagagaaattt

SEQ ID NO: 5245 - DNA, 671 bp, Homo sapiens
gaattgtcggcattggcctggccagcgctggttggtggcctggaggaggatttgattggaaaaccaacggtgcagctggccgcggtgtccctgaggttgaggggaccgggaataggctggggggaggacgggacgggctgagactggacgggacccccggtctgcagcagcaggtgacagcagcagggacaatgataaggagattggcctgaaggagggaccgtccctcccgcgcggaatgcgatgttaattctggggcattgatgttttacaatgcctgatcaagataaaaaggtgaagaccacagaaaaatcaactgataaacagcaagaaatcaccatcagggactattcagatcttaaaagacttcggtgccttttgaacgtccaatcaagcaaacaacagcttccagccattaacttcgatagtgcccaaaatagcatgacgaagtctgagcccgccatcagggcgggtggacacagagctcggggtcagtggcatgaatccacagaagctgttgaacttgaaaattttagtataaactacaagaatgagagaaatttcagcaaacatcctcagcgtaaactatttcaggagatctttaccgccttggtgaaaaatagactcataagcagagagtgggttaatcgagccccatctattcattttct

SEQ ID NO: 5246 - DNA, 2918 bp, Homo sapiens
cccggatccttccgggacgcttcgttggccccgcggagccggcggagcagttatctgtggccacaaagaaagttatttgtctctgtcttggcaaggctgggaggaaagttttagctaagaaactcagcccattggagaccatggataagtacgatgtgattaaggccatcgggcaaggtgccttcgggaaagcatacttagctaaagggaaatcagatagcaagcactgtgtcataaaagagatcaattttgaaaagatgcccatacaagaaaaagaagcttcaaagaaagaagtgattcttctggaaaagatgaaacatcccaacattgtagccttcttcaattcatttcaagagaatggcaggctgtttattgtaatggaatattgtgatggaggggatctcatgaaaaggatcaatagacaacggggtgtgttatttagtgaagatcagatcctcggttggtttgtacagatttctctaggactaaaacatattcatgacaggaagatattacacagggacataaaagctcagaacatttttcttagcaagaacggaatggtggcaaagcttggggactttggtatagcaagagtcctgaataattccatggaacttgctcgaacttgtattggaacaccttactacctgtccccagagatctgtcagaataaaccctacaacaataaaacggatatttggtctcttggctgtgtcttatatgagctctgcacacttaaacatccttttgagggtaacaacttacagcagctggttctgaagatttgtcaagcacattttgccccaatatctccggggttttctcgtgagctccattccttgatatctcagctctttcaagtatctcctcgagaccgaccatccataaattccattttgaaaaggccctttttagagaatcttattcccaaatatttgactcctgaggtcattcaggaagaattcagtcacatgcttatatgcagagcaggagcgccagcttctcgacatgctgggaaggtggtccagaagtgtaaaatacaaaaagtgagattccagggaaagtgcccaccaagatcaaggatatctgtgccaattaaaaggaatgctatattgcatagaaatgaatggagaccaccagctggagcccagaaggccagatctataaaaatgatagaaagacccaaaattgctgctgtctgtggacattatgattattattatgctcaacttgatatgctgaggaggagagcccacaaaccaagttatcaccctattcctcaagaaaatactggagttgaggattacggtcaggaaacgaggcatggtccatccccaagtcaatggcctgctgagtaccttcagagaaaatttgaagctcaacaatataagttgaaagtggagaagcaattgggtcttcgtccatcttctgccgagccaaattacaaccagagacaagagctaagaagtaatggagaagagcctagattccaggagctgccatttaggaaaaacgaaatgaaggaacaggaatattggaagcagttagaggaaatacgccaacagtaccacaatgacatgaaagaaattagaaagaagatggggagagaaccagaggagaactcaaaaataagtcataaaacctatttggtgaagaagagtaacctgcctgtccatcaagatgcatctgagggagaagcacctgtgcagatggaatttcgctcttgttgcccaggctggagtgcaatggcacgatcttggctcaccgcaacctccgcctcccaggacattgaaaaagacttgaaacaaatgaggcttcagaacacaaaggaaagtaaaaatccagaacagaaatataaagctaagaagggggtaaaatttgaaattaatttagacaaatgtatttctgatgaaaacatcctccaagaggaagaggcaatggatataccaaatgaaactttgacctttgaggatggcatgaagtttaaggaatatgaatgtgtaaaggagcatggagattatacagacaaagcatttgaaaaacttcactgcccagaagcagggttttccacgcagactgtagctgctgtgggaaacaggaggcagtgggatggaggagcgcctcagactctgctgcagatgatggcagtggccgacatcacctccacctgccccacggggcctgacagtgagtctgtgcttagcgtcagtcgtcaggaagggaagaccaaggacccgtacagcccagtgctcatcctgatgtgatagtctacttctcactatacaccctatagatcttgtatcagacactttcaaatatgttgttttgatatctccctatgcctaaagagacttgcctgctaattatcctggacaaatgaccactctagacatgcacatataaaggaggaaaaatccaggatgccaccttcctcagagtgagggaaaatgcgtgaggaaggacagctgacttgatttaccttccaaggccagctcaacaactttttttgcgatttcatagggtcatttttttttttttaatttttattttttattgatcattcttgggtgtttctcgcagagggggatttggcagggtcataggacaatagtggagggaaggtcagcagataaacaagtgaacaaaggtctctggtttttctaggcagaggaccctgtggccttccgcagtgtttgtgtccctgggtacttgagattagggagtggtgatgattcttaacgagcatgctgccttcaagcatctgtttaacaaagcacatcttgcactgcccttaatccattcatctctgagtggacacagcacatgtttcagagagcacagggttgggggtaaggtcaccgattagcaggatcccaaggcagaagaatttttcttagtacggaacaaaatgaaaa

SEQ ID NO: 5247 - DNA, 1462 bp, Homo sapiens
aacacaggctggctgtgaagatgaacattaatccatgcctggtgctttgtgagtgctcactgagtattagccttgatgcagacccactggtttctccttttgccactgggccctgccctggagctcccagggaggtggtggcgatgcagagcgacgtgggtcagggattccccatgcagtccaactggagggctcccgtgcatgcgtgcacatcaggggcggtaaggaagggctggccggggtgtgggaggaggcgacacaagatgggaggtggccctgtctcttgggagcaaaggcagaaggaggtggaggcagctcagggctcggaggagaggggtccgggctccttggctgtgtccctgctgtctctcgctgtgggtattcaccgaatctctcccatcctcggttttcacatctgctgcatgcaggtcctcatggttctcaagtgaggcaggtggtgagcccatcaggccagtgcccagggcttattctggggacagctcctggagaggaagggctgcctccctaaggactcctgccctgccctgggtgcaaggggttccacctgctgcccctcccccactccccagctcgcctcaggcggatagttcccctctcactccaaataagagccacaatgctgacagtggcccccaaggccctgcccagcggtccccagcttcctctagctacatctcccggccctccccttcacccactcctgtaggcgcctcgaacgcgcctcagccctgctcctcccctgcctgcagcgttcctccccaggtctcccccggctctctcacctgcttccggttttgctcagactgcgctgcctcagtgcgcccttctgtcaccatcctgtgtatagtcggaaacccctgctccctttccctgcactgaatcttccgtgtgctccttttctccatggcatttgttagctttggctatcctgtctaatttgcgtatgtatttattttttattttgctgcctgttccctcattcccccaactccccaatggcagggagttctgttttggtcactgctgaatccctggtgacccgagcagtgatgatgcagagttgttgtgatatttgtggaatgaatgaatgcaggattttttgttttaccttcacttggcacaaatgctgtggttctgttcaccactcccccctgaagtaatgaaagttatgggcccatccctgtgctgagtggagctggggacacagtgggggctaggacagactgtatccctgccttgtggaacccacagtccagtgggagaggcgacattacccacatagtcatgcaggtgacagagcctgcccacggcttcaacctgcctccagccccacctgctccaagcagacagatggggcgagtgtagggagtgtgtttaaaagaaaaaagaaacaaaaagtctctctcttttttttttttgaagtacccagaccttttcagga

SEQ ID NO: 5248 - DNA, 1752 bp, Homo sapiens
actcgggaagacttcagagaagtctcacaaaggactcggctggctgcttttctcagtgccgaagccgcgccatgctcgttctcagaagcggcctgaccaaggcgcttgcctcacggacgctcgcgcctcaggtgtgttcatcttttgctacgggccctagacaatacgatggaacgttctatgaatttcgtacttattaccttaaaccttcaaatatgaatgcgttcatggaaaatcttaagaaaaacattcatcttcggacctcttactctgaattggttggattctggagtgtagaatttggaggcagaacgaataaagtgtttcatatttggaagtatgataattttgctcatcgagctgaagttcggaaagccttagccaactgtaaggaatggcaagaacaatctatcattccaaatttggctcgcattgataaacaagagacggaaattacttacctgataccatggtccaaattagaaaagcctccaaaagaaggagtctatgaactagctgtttttcagatgaaacctggtgggccagctctgtggggtgatgcatttgaaagagcaattaatgcccatgtcaatttaggctacacaaaagtagttggtgttttccacacagaatatggagaactcaacagagttcatgttctttggtggaatgagagtgcagatagtcgtgcagctgggagacataagtcccatgaggatcccagagttgtggcggctgttcgggaaagtgtcaactacctagtttctcagcagaatatgcttctgattcctgcatcattttcaccattgaaatagttttctactgaaatacaaaacatttcattaactgctctaagatgtgtctgctaatggtgcttaaattctcccaagaggttctcgcttttatttgaaggaggtggtaagttaattagttaatttgctgtgcttcttgcatttttgaaagttacatattctccactgctttaagaaataattcagttcactttcaccttggcatttcagtatctgttacacattagaagtagttgtcactatttcatcatcttggtttttcatttgttttagaatacctcttctgtattttgataactcattgctttatagcattttcttttactcaaataaggattttacatttccttgcctgacagtatttttgaattatttatataaaatatctatcttttcatcatgtctatagttcctgagattttaaaaaaatttgcttagtaaaggttattttgtgatataaaatgggatttataaaaatattagattgtttatttctttactgtggaaaagtacaatgtcatctgtattaattattgcttttacattcattgattattagtcattctaacttggaaaataatgcaattgggtcacagtgttaaaaatctagaaaagacttgttggtttatatgctgaaattgttcatttataattaattttactaatttctacttagtttggatcactaacagagatcttgggacatttatttgttttaaagaaatatttatggttatggaaacgcttgccctaataaaaatcctgcatattcattgtttttttaaattcacattttatacttatatgatctctaaagctcttgctatgttgctataagacagtaatatagtgataatttaccaactttattgaaaatgttgttacatcaataaaatagcatgctgggaacctgagaaggaaggtttctttagtactgcca

SEQ ID NO: 5249 - DNA, 2933 bp, Homo sapiens
gtctcgcgagcccggagcgtggcacgtgggttggtaactgtggcgctgctccgcgtccaccaccacccctgtcctcctcaggccccctccgcctccacccctgccctcctcaggccccctccgcctccacccctgccctactcaggccccctccgcctccacccctgccctcctcaggccccctccgcctccacccctgccctcctcaggccccctccgcctccacccctgccctcctcaggccccctccgcctccacccctgccctcctcaggccccctgcgtccccgcctcgtcctcctcaggccccctccgcctccggctccgtcctcctcaggccccctccgcctccggctccgtcctcctctggccccctccgcccccggccccggccccacggcgggatgcgggacaacaccagccccatcagcgtgattctggtgagctcggggagcaggggcaataagctgctgttcaggtaccccttccagagaagccaggagcacccggcgtcccagacaagtaagccgcgtagcagatacgctgccagcaacacgggcgaccatgctgatgagcaggacggcgattccaggttttcagatgttattctggcaacaattttggcaaccaagtctgaaatgtgtggccaaaaatttgaactgaagattgataatgtgcgatttgttgggcacccaacactgctacagcatgctctggggcaggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagctcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttctatttgtgaagtgccctgtggccccctccccagcacctctgtctgccatgcgcttcttcctcccaggctaccctgagcctttcctggcccagtcctcaccacagtccacagaagccgcaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcggtttttaaacaatt

SEQ ID NO: 5250 - DNA, 2744 bp, Homo sapiens
ccaccacccctgtcctcctcaggccccctccgcctccacccctgccctcctcaggccccctccgcctccacccctgccctactcaggccccctccgcctccacccctgccctcctcaggccccctccgcctccacccctgccctcctcaggccccctccgcctccacccctgccctcctcaggccccctccgcctccacccctgccctcctcaggccccctgcgtccccgcctcgtcctcctcaggccccctccgcctccggctccgtcctcctcaggccccctccgcctccggctccgtcctcctctggccccctccgcccccggccccggccccacggcgggatgcgggacaacaccagccccatcagcgtgattctggtgagctcggggagcaggggcaataagctgctgttcaggtaccccttccagagaagccaggagcacccggcgtcccagacaagtaagccgcgtagcagatacgctgccagcaacacgggcgaccatgctgatgagcaggacggcgattccaggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgggccagctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttctatttgtgaagtgccctgtggccccctccccagcacctctgtctgccatgcgcttcttcctcccaggctaccctgagcctttcctggcccagtcctcaccacagtccacagaagccgcaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcggtttttaaacaatt

SEQ ID NO: 5251 - DNA, 3008 bp, Homo sapiens
gtctcgcgagcccggagcgtggcacgtgggttggtaactgtggcgctgctccgcgtccaccaccacccctgtcctcctcaggccccctccgcctccacccctgccctcctcaggccccctccgcctccacccctgccctactcaggccccctccgcctccacccctgccctcctcaggccccctccgcctccacccctgccctcctcaggccccctccgcctccacccctgccctcctcaggccccctccgcctccacccctgccctcctcaggccccctgcgtccccgcctcgtcctcctcaggccccctccgcctccggctccgtcctcctcaggccccctccgcctccggctccgtcctcctctggccccctccgcccccggccccggccccacggcgggatgcgggacaacaccagccccatcagcgtgattctggtgagctcggggagcaggggcaataagctgctgttcaggtaccccttccagagaagccaggagcacccggcgtcccagacaagtaagccgcgtagcagatacgctgccagcaacacgggcgaccatgctgatgagcaggacggcgattccaggttttcagatgttattctggcaacaattttggcaaccaagtctgaaatgtgtggccaaaaatttgaactgaagattgataatgtgcgatttgttgggcacccaacactgctacagcatgctctggggcagatctccaaaacagatccttccccgaagagggaagcacctactatgattctttttaatgtggtgtttgcactgagggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagctcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttctatttgtgaagtgccctgtggccccctccccagcacctctgtctgccatgcgcttcttcctcccaggctaccctgagcctttcctggcccagtcctcaccacagtccacagaagccgcaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcggtttttaaacaatt

SEQ ID NO: 5252 - DNA, 2811 bp, Homo sapiens
gtctcgcgagcccggagcgtggcacgtgggttggtaactgtggcgctgctccgcgtccaccaccacccctgtcctcctcaggccccctccgcctccacccctgccctcctcaggccccctccgcctccacccctgccctactcaggccccctccgcctccacccctgccctcctcaggccccctccgcctccacccctgccctcctcaggccccctccgcctccacccctgccctcctcaggccccctccgcctccacccctgccctcctcaggccccctgcgtccccgcctcgtcctcctcaggccccctccgcctccggctccgtcctcctcaggccccctccgcctccggctccgtcctcctctggccccctccgcccccggccccggccccacggcgggatgcgggacaacaccagccccatcagcgtgattctggtgagctcggggagcaggggcaataagctgctgttcaggtaccccttccagagaagccaggagcacccggcgtcccagacaagtaagccgcgtagcagatacgctgccagcaacacgggcgaccatgctgatgagcaggacggcgattccaggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttctatttgtgaagtgccctgtggccccctccccagcacctctgtctgccatgcgcttcttcctcccaggctaccctgagcctttcctggcccagtcctcaccacagtccacagaagccgcaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcggtttttaaacaattaaaaaa

SEQ ID NO: 5253 - DNA, 1037 bp, Homo sapiens
accccgcgccgccgaccgccggcccgtgggcgacgggcatgctggcatggcaggacggcggggccaaggcggctccctcccaccacaagatttctttctctgtcctggacatcctggacccacagaaattcacccgcgcagcgctccctgccgtgcgcccggctccccgggaagccaggaaaagtttggcggaggtcgaagcggggaaagatgccagctccagggaccctgtccgacagctggagacccctgggcagggatttgccgcatccctgctcacccgccaagctcacccgcaccacagttctgatgctcgcgatgctgcgggcccaggcgccggccaggcgtcccccctggagggttccgaggcggaagaggaggaggatgcggaggatccgaggaggccgcggctgcgggagcgggctgcgcgcttgctgccgggcctagcgcgctcacctgacgccccggccggggcattggcgtctggggagccctgcgaggacggcgggggcggccctgtgaggtcccccccgggatcccccggctccccgcgtcccaggcgccggcgcctggagcccaactgcgccaagccgcggcgcgcgcgcaccgccttcacctacgagcagctggtggccttggagaacaagttccgggccacgcgctacctgtcagtgtgcgagcgcctgaacctcgcgctgtctctcagcctcaccgagacgcaggtcaaaatctggttccagaatcgcaggaccaagtggaagaagcagaacccgggtgccgacggcgcggcgcaggtggggggtggcgcgccccagccaggggcggcggggggcggcggcggcggcggctcggggggcagtcctggccctcccggcaccggcgctctgcacttccagactttcccctcctactccgcggccaatgtcctcttcccgtccgccgcctccttcccgctgacggctgccgcccccgggagccctttcgcgccgttccttgggccttcctacctgacccccttctacgccccgcgtctatga

SEQ ID NO: 5254 - DNA, 1580 bp, Homo sapiens
gcggccgcggcacagcgcctgatagtcccgaggctggcccgggctgcgccggtgccaatcggcgcgcagccccccgcggcgctctccccgccccgcctccccgcccccctccccagcttcacttggcagcgcggacccggctcctggctggaaagctaccgccaagccacagccgaaggcaagcccgagcggcgccatccccaaccccgcgccgccgaccgccggcccgtgggcgacgggcatgctggcatggcaggacggcggggccaaggcggctccctcccaccacaagatttctttctctgtcctggacatcctggacccacagaaattcacccgcgcagcgctccctgccgtgcgcccggctccccgggaagccaggaaaagtttggcggaggtcgaagcggggaaagatgccagctccagggaccctgtccgacagctggagacccctgatgctgcgggcccaggcgccggccaggcgtcccccctggagggttccgaggcggaagaggaggaggatgcggaggatccgaggaggccgcggctgcgggagcgggctgcgcgcttgctgccgggcctagcgcgctcacctgacgccccggccggggcattggcgtctggggagccctgcgaggacggcgggggcggccctgtgaggtcccccccgggatcccccggctccccgcgtcccaggcgccggcgcctggagcccaactgcgccaagccgcggcgcgcgcgcaccgccttcacctacgagcagctggtggccttggagaacaagttccgggccacgcgctacctgtcagtgtgcgagcgcctgaacctcgcgctgtctctcagcctcaccgagacgcaggtcaaaatctggttccagaatcgcaggaccaagtggaagaagcagaacccgggtgccgacggcgcggcgcaggtggggggtggcgcgccccagccaggggcggcggggggcggcggcggcggcggctcggggggcagtcctggccctcccggcaccggcgctctgcacttccagactttcccctcctactccgcggccaatgtcctcttcccgtccgccgcctccttcccgctgacggctgccgcccccgggagccctttcgcgccgttccttgggccttcctacctgacccccttctacgccccgcgtctatgaatccggagccccctggcccctctttcgcgggattcacgagggattggcatcgtcgtgtgccctcggctcctccaccgggggtgcaggtgcgcgggtgtcagcgcacccctgcccgccgcgcgcacccgcgatcctcgcgggccaccaaggggtcagggatctgccgtccttcaaagtgtccggggacggaggctgacctcaagccttgccgtttctggaccttgctgttcactttgggtcaggtttaattcagttcaggggctagtttttgagggtctgggtgttcggcgcggggctaaccaagatgccaggagggaaatacagggagcagagacgccctggctgccagctgctggcggctaggatggaacctttaaaggtgctggctcatcagagggtgagaaac

SEQ ID NO: 5255 - DNA, 1750 bp, Homo sapiens
gaggagtggattacatattccaacagttgttattacattggtaaggaaagaagaacttgggaagaaagagtttgctggcctgtgcttcgaagaactctgatctgctttctatagataatgaggaagaaatggtatgtgtggggacttcccagttggctgtaagttgccatttgaactaaacgaaatagatcaggaactgaggacatatctaaattttctagttttatagaaggcttttatccacaagaatcaagatcttccctctctgagcaggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtaacaatatggagtgctgtattcctaaactcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacgtacatctgcatgcaaaggactgtgtaaagatgatcaaccatctcaataaaagccaggaacagagaagagattacaccagcggtaacactgccaactgagactaaaggaaacaaacaaaaacaggacaaaatgaccaaagactgtcagatttcttagactccacaggaccaaaccatagaacaatttcactgcaaacatgcatgattctccaagacaaaagaagagagatcctaaaggcaattcagatatccccaaggctgcctctcccaccacaagcccagagtggatgggctgggggaggggtgctgttttaatttctaaaggtaggaccaacacccaggggatcagtgaaggaagagaaggccagcagatcactgagagtgcaaccccaccctccacaggaaattgcctcatgggcagggccacagcagagagacacagcatgggcagtgccttccctgcctgtgggggtcatgctgccacttttaatgggtcctccacccaacggggtcagggaggtggtgctgccccagtgggccatgattatcttaaaggcattattctccagccttaagtaagatcttaggacgtttcctttgctatgatttgtacttgcttgagtcccatgactgtttctcttcctctctttcttccttttggaatagtaatatccatcctatgtttgtcccactattgtattttggaagcacataacttgtttggtttcacaggttcacagttaagaaggaattttgcctctgaataaatagaatcttgagtctcatgca

SEQ ID NO: 5256 - DNA, 3507 bp, Homo sapiens
agtgctcagcaacgattacgccccgagggccaatcacagggctgcggccgagagagaagccttattagagctttctcaacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaatg

SEQ ID NO: 5257 - DNA, 3576 bp, Homo sapiens
aagtgctcagcaacgattacgccccgagggccaatcacagggctgcggccgagaaagaagccttaatagagctttctcaacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaatgaa

SEQ ID NO: 5258 - DNA, 3576 bp, Homo sapiens; identical to SEQ ID NO: 5257

SEQ ID NO: 5259 - DNA, 3573 bp, Homo sapiens
agtgctcagcaacgattacgccccgagggccaatcacagggctgcggccgagagagaagccttattagagctttctcaacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaatg

SEQ ID NO: 5260 - DNA, 3576 bp, Homo sapiens; identical to SEQ ID NO: 5257

SEQ ID NO: 5261 - DNA, 3573 bp, Homo sapiens; identical to SEQ ID NO: 5259

SEQ ID NO: 5262 - DNA, 3507 bp, Homo sapiens; identical to SEQ ID NO: 5256

SEQ ID NO: 5263 - DNA, 3573 bp, Homo sapiens; identical to SEQ ID NO: 5259

SEQ ID NO: 5264 - DNA, 3573 bp, Homo sapiens; identical to SEQ ID NO: 5259

SEQ ID NO: 5265 - DNA, 3576 bp, Homo sapiens; identical to SEQ ID NO: 5257

SEQ ID NO: 5266 - DNA, 3573 bp, Homo sapiens; identical to SEQ ID NO: 5259

SEQ ID NO: 5267 - DNA, 3507 bp, Homo sapiens; identical to SEQ ID NO: 5256

SEQ ID NO: 5268 - DNA, 3507 bp, Homo sapiens; identical to SEQ ID NO: 5256

SEQ ID NO: 5269 - DNA, 3576 bp, Homo sapiens; identical to SEQ ID NO: 5257

SEQ ID NO: 5270 - DNA, 3507 bp, Homo sapiens; identical to SEQ ID NO: 5256

SEQ ID NO: 5271 - DNA, 3576 bp, Homo sapiens; identical to SEQ ID NO: 5257

SEQ ID NO: 5272 - DNA, 3573 bp, Homo sapiens; identical to SEQ ID NO: 5259

SEQ ID NO: 5273 - DNA, 3576 bp, Homo sapiens; identical to SEQ ID NO: 5257

SEQ ID NO: 5274 - DNA, 3507 bp, Homo sapiens; identical to SEQ ID NO: 5256

SEQ ID NO: 5275 - DNA, 3507 bp, Homo sapiens; identical to SEQ ID NO: 5256

SEQ ID NO: 5276 - DNA, 3573 bp, Homo sapiens; identical to SEQ ID NO: 5259

SEQ ID NO: 5277 - DNA, 3250 bp, Homo sapiens
gaaacacaggctggaagcaagacctgacctgagggagttcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatggaggacggacaggtgcaagaaatagataatcctgagctgggagatgcagaagaagactcggagttagcaaagccaggtgaaaaggaaggatggagaaattcaatggagaaacagtctttggtctggaagaacaccttttggcaaggagacattgacaatttccatgacgacgtcactctgagaaaccaacggttcattccattcttgaatcccagaacacccaggaagctaacaccttacacggtggtgctgcacggccccgcaggcgtggggaaaaccacgctggccaaaaagtgtatgctggactggacagactgcaacctcagcccgacgctcagatacgcgttctacctcagctgcaaggagctcagccgcatgggcccctgcagttttgcagagctgatctccaaagactggcctgaattgcaggatgacattccaagcatcctagcccaagcacagagaatcctgttcgtggtcgatggccttgatgagctgaaagtcccacctggggcgctgatccaggacatctgcggggactgggagaagaagaagccggtgcccgtcctcctggggagtttgctgaagaggaagatgttacccagggcagccttgctggtcaccacgcggcccagggcactgagggacctccagctcctggcgcagcagccgatctacgtaagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggattgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagatgtccgtgttccaccgagaggacctggaaaggctcggggtgcaggagtccgacctccgtctgttcctggacggagacatcctccgccaggacagagtctccaaaggctgctactccttcatccacctcagcttccagcagtttctcactgccctgttctacgccctggagaaggaggagggggaggacagggacggccacgcctgggacatcggggacgtacagaagctgctttccggagaagaaagactcaagaaccccgacctgattcaagtaggacacttcttattcggcctcgctaacgagaagagagccaaggagttggaggccacttttggctgccggatgtcaccggacatcaaacaggaattgctgcaatgcaaagcacatcttcatgcaaataagcccttatccgtgaccgacctgaaggaggtcttgggctgcctgtatgagtctcaggaggaggagctggcgaaggtggtggtggccccgttcaaggaaatttctattcacctgacaaatacttctgaagtgatgcattgttccttcagcctgaagcattgtcaagacttgcagaaactctcactgcaggtagcaaagggggtgttcctggagaattacatggattttgaactggacattgaatttgaaaggtgcacttacctaaccattccgaactgggctcggcaggatcttcgctctcttcgcctctggacagatttctgctctctcttcagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagaccttggtgttacagcaatgcagcataaccaagcttggctgtagatatctctcagaggcgctccaagaagcctgcagcctcacaaacctggacttgagtatcaaccagatagctcgtggattgtggattctctgtcaggcattagagaatccaaactgtaacctaaaacacctacggttgaagacctatgaaactaatttggaaatcaagaagctgttggaggaagtgaaagaaaagaatcccaagctgactattgattgcaatgcttccggggcaacggcacctccgtgctgtgactttttttgctgagcagcctgggatcgctctacgaattacacaggaagcgggattcgggtctctaagatgtcttatgaatgcaggtcagagggtcacatgttaacactagagtctgtcgagaggtaggatttgacactggttttctcactatttttgggagattctgcacgagtcacgcacccccttcacatgacgctatgtactttctcacagggataataaagttagagcactctcgttgca

SEQ ID NO: 5278 - DNA, 3337 bp, Homo sapiens
gaaacacaggctggaagcaagacctgacctgagggagttcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatggaggacggacaggtgcaagaaatagataatcctgagctgggagatgcagaagaagactcggagttagcaaagccaggtgaaaaggaaggatggagaaattcaatggagaaacagtctttggtctggaagaacaccttttggcaaggagacattgacaatttccatgacgacgtcactctgagaaaccaacggttcattccattcttgaatcccagaacacccaggaagctaacaccttacacggtggtgctgcacggccccgcaggcgtggggaaaaccacgctggccaaaaagtgtatgctggactggacagactgcaacctcagcccgacgctcagatacgcgttctacctcagctgcaaggagctcagccgcatgggcccctgcagttttgcagagctgatctccaaagactggcctgaattgcaggatgacattccaagcatcctagcccaagcacagagaatcctgttcgtggtcgatggccttgatgagctgaaagtcccacctggggcgctgatccaggacatctgcggggactgggagaagaagaagccggtgcccgtcctcctggggagtttgctgaagaggaagatgttacccagggcagccttgctggtcaccacgcggcccagggcactgagggacctccagctcctggcgcagcagccgatctacgtaagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggattgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagatgtccgtgttccaccgagaggacctggaaaggctcggggtgcaggagtccgacctccgtctgttcctggacggagacatcctccgccaggacagagtctccaaaggctgctactccttcatccacctcagcttccagcagtttctcactgccctgttctacgccctggagaaggaggagggggaggacagggacggccacgcctgggacatcggggacgtacagaagctgctttccggagaagaaagactcaagaaccccgacctgattcaagtaggacacttcttattcggcctcgctaacgagaagagagccaaggagttggaggccacttttggctgccggatgtcaccggacatcaaacaggaattgctgcaatgcaaagcacatcttcatgcaaataagcccttatccgtgaccgacctgaaggaggtcttgggctgcctgtatgagtctcaggaggaggagctggcgaaggtggtggtggccccgttcaaggaaatttctattcacctgacaaatacttctgaagtgatgcattgttccttcagcctgaagcattgtcaagacttgcagaaactctcactgcaggtagcaaagggggtgttcctggagaattacatggattttgaactggacattgaatttgaaagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagaccttggtgttacagcaatgcagcataaccaagcttggctgtagatatctctcagaggcgctccaagaagcctgcagcctcacaaacctggacttgagtatcaaccagatagctcgtggattgtggattctctgtcaggcattagagaatccaaactgtaacctaaaacacctacgcctctggagctgctccctcatgcctttctattgtcagcatcttggatctgctctcctcagcaatcagaagcttgaaactctggacctgggccagaatcatttgtggaagagtggcataattaagctctttggggttctaagacaaagaactggatccttgaagatactcaggttgaagacctatgaaactaatttggaaatcaagaagctgttggaggaagtgaaagaaaagaatcccaagctgactattgattgcaatgcttccggggcaacggcacctccgtgctgtgactttttttgctgagcagcctgggatcgctctacgaattacacaggaagcgggattcgggtctctaagatgtcttatgaatgcaggtcagagggtcacatgttaacactagagtctgtcgagaggtaggatttgacactggttttctcactatttttgggagattctgcacgagtcacgcacccccttcacatgacgctatgtactttctcacagggataataaagttagagcactctcgttgca

SEQ ID NO: 5279 - DNA, 3826 bp, Homo sapiens
atcttgactgcctgttaaacttacctatgtggagcctcatttcaaagcacgaacgcctagagattctgcttgattggttacactgggactgcccagaccctggagttctttcgagagtcccagataactgtgattgcggccgaggctgagaatcaccgcttagaagcctcagctgtgattggctaccttctcccatcaccccagagtttttaaagctgggagccaggtaccctgcaaaacccaaaatgtgtatttcctgttctgtcgcctatcacacctggcccgggtggtctaggaagggaattgcacattaatctcacctggggagattcagcaagccgtaattctccaaagcccactgaagcccaattacagccaaatccctgaggatggggcccaggtgatgtcaaggaaacacaggctggaagcaagacctgacctgagggagttcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatggaggacggacaggtgcaagaaatagataatcctgagctgggagatgcagaagaagactcggagttagcaaagccaggtgaaaaggaaggatggagaaattcaatggagaaacagtctttggtctggaagaacaccttttggcaaggagacattgacaatttccatgacgacgtcactctgagaaaccaacggttcattccattcttgaatcccagaacacccaggaagctaacaccttacacggtggtgctgcacggccccgcaggcgtggggaaaaccacgctggccaaaaagtgtatgctggactggacagactgcaacctcagcccgacgctcagatacgcgttctacctcagctgcaaggagctcagccgcatgggcccctgcagttttgcagagctgatctccaaagactggcctgaattgcaggatgacattccaagcatcctagcccaagcacagagaatcctgttcgtggtcgatggccttgatgagctgaaagtcccacctggggcgctgatccaggacatctgcggggactgggagaagaagaagccggtgcccgtcctcctggggagtttgctgaagaggaagatgttacccagggcagccttgctggtcaccacgcggcccagggcactgagggacctccagctcctggcgcagcagccgatctacgtaagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggattgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagatgtccgtgttccaccgagaggacctggaaaggctcggggtgcaggagtccgacctccgtctgttcctggacggagacatcctccgccaggacagagtctccaaaggctgctactccttcatccacctcagcttccagcagtttctcactgccctgttctacgccctggagaaggaggagggggaggacagggacggccacgcctgggacatcggggacgtacagaagctgctttccggagaagaaagactcaagaaccccgacctgattcaagtaggacacttcttattcggcctcgctaacgagaagagagccaaggagttggaggccacttttggctgccggatgtcaccggacatcaaacaggaattgctgcaatgcaaagcacatcttcatgcaaataagcccttatccgtgaccgacctgaaggaggtcttgggctgcctgtatgagtctcaggaggaggagctggcgaaggtggtggtggccccgttcaaggaaatttctattcacctgacaaatacttctgaagtgatgcattgttccttcagcctgaagcattgtcaagacttgcagaaactctcactgcaggtagcaaagggggtgttcctggagaattacatggattttgaactggacattgaatttgaaaggtgcacttacctaaccattccgaactgggctcggcaggatcttcgctctcttcgcctctggacagatttctgctctctcttcagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagaccttggtgttacagcaatgcagcataaccaagcttggctgtagatatctctcagaggcgctccaagaagcctgcagcctcacaaacctggacttgagtatcaaccagatagctcgtggattgtggattctctgtcaggcattagagaatccaaactgtaacctaaaacacctacgcctctggagctgctccctcatgcctttctattgtcagcatcttggatctgctctcctcagcaatcagaagcttgaaactctggacctgggccagaatcatttgtggaagagtggcataattaagctctttggggttctaagacaaagaactggatccttgaagatactcaggttgaagacctatgaaactaatttggaaatcaagaagctgttggaggaagtgaaagaaaagaatcccaagctgactattgattgcaatgcttccggggcaacggcacctccgtgctgtgactttttttgctgagcagcctgggatcgctctacgaattacacaggaagcgggattcgggtctctaagatgtcttatgaatgcaggtcagagggtcacatgttaacactagagtctgtcgagaggtaggatttgacactggttttctcactatttttgggagattctgcacgagtcacgcacccccttcacatgacgctatgtactttctcacagggataataaagttagagcactctc

SEQ ID NO: 5280 - DNA, 3337 bp, Homo sapiens; identical to SEQ ID NO: 5278

SEQ ID NO: 5281 - DNA, 3826 bp, Homo sapiens; identical to SEQ ID NO: 5279

SEQ ID NO: 5282 - DNA, 3337 bp, Homo sapiens; identical to SEQ ID NO: 5278

SEQ ID NO: 5283 - DNA, 3826 bp, Homo sapiens; identical to SEQ ID NO: 5279

SEQ ID NO: 5284 - DNA, 3250 bp, Homo sapiens; identical to SEQ ID NO: 5277

SEQ ID NO: 5285 - DNA, 3337 bp, Homo sapiens; identical to SEQ ID NO: 5278

SEQ ID NO: 5286 - DNA, 3250 bp, Homo sapiens; identical to SEQ ID NO: 5277

SEQ ID NO: 5287 - DNA, 3250 bp, Homo sapiens; identical to SEQ ID NO: 5277

SEQ ID NO: 5288 - DNA, 3250 bp, Homo sapiens; identical to SEQ ID NO: 5277

SEQ ID NO: 5289 - DNA, 3826 bp, Homo sapiens; identical to SEQ ID NO: 5279

SEQ ID NO: 5290 - DNA, 3826 bp, Homo sapiens; identical to SEQ ID NO: 5279

SEQ ID NO: 5291 - DNA, 3250 bp, Homo sapiens; identical to SEQ ID NO: 5277

SEQ ID NO: 5292 - DNA, 3337 bp, Homo sapiens; identical to SEQ ID NO: 5278

SEQ ID NO: 5293 - DNA, 3337 bp, Homo sapiens; identical to SEQ ID NO: 5278

SEQ ID NO: 5294 - DNA, 3826 bp, Homo sapiens; identical to SEQ ID NO: 5279

SEQ ID NO: 5295 - DNA, 3826 bp, Homo sapiens; identical to SEQ ID NO: 5279

SEQ ID NO: 5296 - DNA, 3826 bp, Homo sapiens; identical to SEQ ID NO: 5279

SEQ ID NO: 5297 - DNA, 3826 bp, Homo sapiens; identical to SEQ ID NO: 5279

SEQ ID NO: 5298 - DNA, 3826 bp, Homo sapiens; identical to SEQ ID NO: 5279

SEQ ID NO: 5299 - DNA, 3826 bp, Homo sapiens; identical to SEQ ID NO: 5279

SEQ ID NO: 5300 - DNA, 3826 bp, Homo sapiens; identical to SEQ ID NO: 5279

SEQ ID NO: 5301 - DNA, 3826 bp, Homo sapiens; identical to SEQ ID NO: 5279

SEQ ID NO: 5302 - DNA, 1362 bp, Homo sapiens
tgtttatactccggagggtgtccccgtgcgtcatcggtggagtggaccaaaactggtgatctgtttgccctgtgtgaccttgcccagaaccctgctgactgagagaacacatctgctggaagtcctctgggattcaaggtacagggaatgaagagtagttttacagaaaaaagaggacaatattgggatcacctttgacctttccatttggaaataatattttctattgtgttatagaaaggtgggaagctttcatccagaacaatgaatttcataaaggacaatagccgagcccttattcaaagaatgggaatgactgttataaagcaaatcacagatgacctatttgtatggaatgttctgaatcgcgaagaagtaaacatcatttgctgcgagaaggtggagcaggatgctgctagagggatcattcacatgattttgaaaaagggttcagagtcctgtaacctctttcttaaatcccttaaggagtggaactatcctctatttcaggacttgaatggacaaagtggtctgactgacagcttgggtaacttgaagaaccttacaaagctcataatggataacataaagatgaatgaagaagatgctataaaactagctgaaggcctgaaaaacctgaagaagatgtgtttatttcatttgacccacttgtctgacattggagagggaatggattacatagtcaagtctctgtcaagtgaaccctgtgaccttgaagaaattcaattagtctcctgctgcttgtctgcaaatgcagtgaaaatcctagctcagaatcttcacaatttggtcaaactgagcattcttgatttatcagaaaattacctggaaaaagatggaaatgaagctcttcatgaactgatcgacaggatgaacgtgctagaacagctcaccgcactgatgctgccctggggctgtgacgtgcaaggcagcctgagcagcctgttgaaacatttggaggaggtcccacaactcgtcaagcttgggttgaaaaactggagactcacagatacagagattagaattttaggtgcattttttggaaagaaccctctgaaaaacttccagcagttgaatttggcgggaaatcgtgtgagcagtgatggatggcttgccttcatgggtgtatttgagaatcttaagcaattagtgttttttgactttagtactaaagaatttctacctgatccagcattagtcagaaaacttagccaagtgttatccaagttaacttttctgcaagaagctaggcttgttgggtggcaatttgatgatgatgatctcagtgttattacaggtgcttttaaactagtaactgcttaaataaagtgtactcgaagc

SEQ ID NO: 5303 - DNA, 6735 bp, Homo sapiens
gcagcagccgccagttccatgcactggcggagcagctctaggcggcggcttctactttcagtttcgtgcagagcgcggaggagccgcgagcgctgagggagtctgcactatggaaacaacctgtcaatccagctcaaggcacacatagcccagacacccatgagaccctctccgtggggaccctagagcacctatcatgaacgaggagaccaaggctggctcctcatggaccccgttggcctccagctcggcaacaagaacctgtggagctgtcttgtgaggctgctcaccaaagacccagaatggctgaacgccaagatgaagttcttcctccccaacacggacctggattccaggaacgagaccttggaccctgaacagagagtcatcctgcaactcaacaagctgcatgtccagggttcggacacctggcagtctttcattcattgtgtgtgcatgcagctggaggtgcctctggacctggaggtgctgctgctgagtacttttggctatgatgatgggttcaccagccagctgggagctgaggggaaaagccaacctgaatctcagctccaccatggcctgaagcgcccacatcagagctgtgggtcctcaccccgccggaagcagtgcaagaagcagcagctagagttggccaagaagtacctgcagctcctgcggacctctgcccagcagcgctacaggagccaaatccctgggtcagggcagccccacgccttccaccaggtctatgtccctccaatcctgcgccgggccacagcatccttagacactccggagggggccattatgggggacgtcaaggtggaagatggtgctgacgtgagcatctcggacctcttcaacaccagggttaacaagggcccgagggtgaccgtgcttttggggaaggctggcatgggcaagaccacgctggcccaccggctctgccagaagtgggcagagggccatctgaactgtttccaggccctgttcctttttgaattccgccagctcaacttgatcacgaggttcctgacaccgtccgagctcctttttgatctgtacctgagccctgaatcggaccacgacactgtcttccagtacctggagaagaacgctgaccaagtcctgctgatctttgatgggctagatgaggccctccagcctatgggtcctgatggcccaggcccagtcctcacccttttctcccatctctgcaatgggaccctcctgcctggctgccgggtgatggctacctcccgtccagggaagctgcctgcctgcctgcctgcagaggcagccatggtccacatgttgggctttgatgggccacgggtggaagaatatgtgaatcacttcttcagcgcccagccatcgcgggagggggccctggtggagttacagacaaatggacgtctccgaagcctgtgtgcggtgcccgcactgtgccaagtcgcctgtctctgcctccaccatctgcttcctgaccacgccccaggccagtctgtggccctcctgcccaacatgactcagctctatatgcagatggtgctcgccctcagcccccctgggcacttgcccacctcgtccctactggacctgggggaggtggccctgaggggcctggagacagggaaggttatcttctatgcaaaagatattgctccacccttgatagcttttggggccactcacagcctgctgacttccttctgcgtctgcacaggccctgggcaccagcagacaggctatgctttcacccacctcagcctgcaggagtttcttgctgccctgcacctgatggccagccccaaggtgaacaaagacacacttacccagtatgttaccctccattcccgctgggtacagcggaccaaagctagactgggcctctcagaccacctccccaccttcctggcgggcctggcatcctgcacctgccgccccttccttagccacctggcgcagggcaatgaggactgtgtgggtgccaagcaggctgctgtagtgcaggtgttgaagaagttggccacccgcaagctcacagggccaaaggttgtagagctgtgtcactgtgtggatgagacacaggagcctgagctggccagtctcaccgcacaaagcctcccctatcaactgcccttccacaatttcccactgacctgcaccgacctggccaccctgaccaacatcctagagcacagggaggcccccatccacctggattttgatggctgtcccctggagccccactgccctgaggctctggtaggctgtgggcagatagagaatctcagctttaagagcaggaagtgtggggatgcctttgcagaagccctctccaggagcttgccgacaatggggaggctgcagatgctggggttagcaggaagtaaaatcactgcccgaggcatcagccacctggtgaaagctttgcctctctgtccacagctgaaagaagtcagttttcgggacaaccagctcagtgaccaggtggtgctgaacattgtggaggttctccctcacctaccacggctccggaagcttgacctgagcagcaacagcatctgcgtgtcaaccctactctgcttggcaagggtggcagtcacgtgtcctaccgtcaggatgcttcaggccagggaggcggacctcatcttccttctttccccgcccacagagacaactgcagagctacaaagagctccagacctgcaggaaagtgacggccagaggaaaggggctcagagcagaagcttgacgctcaggctgcagaagtgtcagctccaggtccacgatgcggaggccctcatagccctgctccaggaaggccctcacctggaggaagtggacctctcagggaaccagctggaagatgaaggctgtcggctgatggcagaggctgcatcccagctgcacatcgccaggaagctggacctcagtaacaacgggctttctgtggccggggtgcattgtgtgctgagggccgtgagtgcgtgctggaccctggcagagctgcacatcagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggtctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagggtgcaggagccgtgggcggacagagccagggttctctccctgttagaagtctgcgcccaggcctcaggcagtgtcactgaaatcagcatctccgagacccagcagcagctctgtgtccagctggaatttcctcgccaggaagagaatccagaagctgtggcactcaggttggctcactgtgaccttggagcccaccacagccttcttgtcgggcagctgatggagacatgtgccaggctgcagcagctcagcttgtctcaggttaacctctgtgaggacgatgatgccagttccctgctgctgcagagcctcctgctgtccctctctgagctgaagacatttcggctgacctccagctgtgtgagcaccgagggcctcgcccacctggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctcaggaagatagacctctcagggaatagcatcagctcagccgggggagtgcagttggcagagtctctcgttctttgcaggcgcctggaggagttgatgcttggctgcaatgccctgggggatcccacagccctggggctggctcaggagctgccccagcacctgagggtcctacacctaccattcagccatctgggcccaggtggggccctgagcctggcccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcagctgccgagctggcccaggtgctgccgcagatgggccggctgaagagagtggacctggagaagaatcagatcacagctttgggggcctggctcctggctgaaggactggcccaggggtctagcatccaagtcatccgcctctggaataaccccattccctgcgacatggcccagcacctgaagagccaggagcccaggctggactttgccttctttgacaaccagccccaggccccttggggtacttgatggccccctcaagacctttggaatccagccaagtgatgcacccaaatgatccacctttcgcccactgggataattgactcaggaaagaagagcctcggcagggcgctctgcactccacccaggaggaaggatacgtgtgtcctgctgcagtcctcagggagaacttttttgggaaccaggagctgggtctggacaaaggagtaccctgcattacgtgggatatgtgtgatcaattggggacatgcgacacacaatgagggtgtcatgacaatgcatgacacgtacggttatatgtggcagtgtgaccccttgacatgtggcgttacatgaaagtcagtgtggcacgtgttctgtggcatgggtgctggcatcccaagtagcaggatacatgattgttggtctatatatgacacatgacaaatgtccatgtcacaggactcatggctggccagatgacctcaggctggcccaagatctaatttattaatttttaaagcaaatacatatttatagattgtgtgtatggagcagctaagtcaggaaaagtcttccgcccgagctgggaggggagagtgtccatgcactgaccagtccaggggctcaagggccagggctctggaacaagccagggactcagccattaagtcccctcctgcctcaatcctcagcctacccatctataaacttgatgactcctcccttacttacatactagcttccaaggacaggtggaggtagggccagcctggcgggagtggagaagcccagtctgtcctatgtaagggacaaagccaggtctaatggtactgggtagggggcactgccaagacaataagctaggctactgggtccagctactactttggtgggattcaggtgagtctccatgcacttcacatgttacccagtgttcttgttacttccaaggagaaccaagaatggctctgtcacactcgaagccaggcttgatcaataaacacaatggtattccacgtc

SEQ ID NO: 5304 - DNA, 4353 bp, Homo sapiens
gcagcagccgccagttccatgcactggcggagcagctctaggcggcggcttctactttcagtttcgtgcagagcgcggaggagccgcgagcgctgagggagtctgcactatggaaacaacctgtcaatccagctcaaggcacacatagcccagacacccatgagaccctctccgtggggaccctagagcacctatcatgaacgaggagaccaaggctggctcctcatggaccccgttggcctccagctcggcaacaagaacctgtggagctgtcttgtgaggctgctcaccaaagacccagaatggctgaacgccaagatgaagttcttcctccccaacacggacctggattccaggaacgagaccttggaccctgaacagagagtcatcctgcaactcaacaagctgcatgtccagggttcggacacctggcagtctttcattcattgtgtgtgcatgcagctggaggtgcctctggacctggaggtgctgctgctgagtacttttggctatgatgatgggttcaccagccagctgggagctgaggggaaaagccaacctgaatctcagctccaccatggcctgaagcgcccacatcagagctgtgggtcctcaccccgccggaagcagtgcaagaagcagcagctagagttggccaagaagtacctgcagctcctgcggacctctgcccagcagcgctacaggagccaaatccctgggtcagggcagccccacgccttccaccaggtctatgtccctccaatcctgcgccgggccacagcatccttagacactccggagggggccattatgggggacgtcaaggtggaagatggtgctgacgtgagcatctcggacctcttcaacaccagggttaacaagggcccgagggtgaccgtgcttttggggaaggctggcatgggcaagaccacgctggcccaccggctctgccagaagtgggcagagggccatctgaactgtttccaggccctgttcctttttgaattccgccagctcaacttgatcacgaggttcctgacaccgtccgagctcctttttgatctgtacctgagccctgaatcggaccacgacactgtcttccagtacctggagaagaacgctgaccaagtcctgctgatctttgatgggctagatgaggccctccagcctatgggtcctgatggcccaggcccagtcctcacccttttctcccatctctgcaatgggaccctcctgcctggctgccgggtgatggctacctcccgtccagggaagctgcctgcctgcctgcctgcagaggcagccatggtccacatgttgggctttgatgggccacgggtggaagaatatgtgaatcacttcttcagcgcccagccatcgcgggagggggccctggtggagttacagacaaatggacgtctccgaagcctgtgtgcggtgcccgcactgtgccaagtcgcctgtctctgcctccaccatctgcttcctgaccacgccccaggccagtctgtggccctcctgcccaacatgactcagctctatatgcagatggtgctcgccctcagcccccctgggcacttgcccacctcgtccctactggacctgggggaggtggccctgaggggcctggagacagggaaggttatcttctatgcaaaagatattgctccacccttgatagcttttggggccactcacagcctgctgacttccttctgcgtctgcacaggccctgggcaccagcagacaggctatgctttcacccacctcagcctgcaggagtttcttgctgccctgcacctgatggccagccccaaggtgaacaaagacacacttacccagtatgttaccctccattcccgctgggtacagcggaccaaagctagactgggcctctcagaccacctccccaccttcctggcgggcctggcatcctgcacctgccgccccttccttagccacctggcgcagggcaatgaggactgtgtgggtgccaagcaggctgctgtagtgcaggtgttgaagaagttggccacccgcaagctcacagggccaaaggttgtagagctgtgtcactgtgtggatgagacacaggagcctgagctggccagtctcaccgcacaaagcctcccctatcaactgcccttccacaatttcccactgacctgcaccgacctggccaccctgaccaacatcctagagcacagggaggcccccatccacctggattttgatggctgtcccctggagccccactgccctgaggctctggtaggctgtgggcagatagagaatctcagctttaagagcaggaagtgtggggatgcctttgcagaagccctctccaggagcttgccgacaatggggaggctgcagatgctggggttagcaggaagtaaaatcactgcccgaggcatcagccacctggtgaaagctttgcctctctgtccacagctgaaagaagtcagttttcgggacaaccagctcagtgaccaggtggtgctgaacattgtggaggttctccctcacctaccacggctccggaagcttgacctgagcagcaacagcatctgcgtgtcaaccctactctgcttggcaagggtggcagtcacgtgtcctaccgtcaggatgcttcaggccagggaggcggacctcatcttccttctttccccgcccacagagacaactgcagagctacaaagagctccagacctgcaggaaagtgacggccagaggaaaggggctcagagcagaagcttgacgctcaggctgcagaagtgtcagctccaggtccacgatgcggaggccctcatagccctgctccaggaaggccctcacctggaggaagtggacctctcagggaaccagctggaagatgaaggctgtcggctgatggcagaggctgcatcccagctgcacatcgccaggaagctggacctcagtaacaacgggctttctgtggccggggtgcattgtgtgctgagggccgtgagtgcgtgctggaccctggcagagctgcacatcagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtgggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagagactccacaaggcacacagagaaactgtccttccccacactggaggcctgtgctttgggatttaag

SEQ ID NO: 5305 - DNA, 6886 bp, Homo sapiens
gcagcagccgccagttccatgcactggcggagcagctctaggcggcggcttctactttcagtttcgtgcagagcgcggaggagccgcgagcgctgagggagtctgcactatggaaacaacctgtcaatccagctcaaggcacacatagcccagacacccatgagaccctctccgtggggaccctagagcacctatcatgaacgaggagaccaaggctggctcctcatggaccccgttggcctccagctcggcaacaagaacctgtggagctgtcttgtgaggctgctcaccaaagacccagaatggctgaacgccaagatgaagttcttcctccccaacacggacctggattccaggaacgagaccttggaccctgaacagagagtcatcctgcaactcaacaagctgcatgtccagggttcggacacctggcagtctttcattcattgtgtgtgcatgcagctggaggtgcctctggacctggaggtgctgctgctgagtacttttggctatgatgatgggttcaccagccagctgggagctgaggggaaaagccaacctgaatctcagctccaccatggcctgaagcgcccacatcagagctgtgggtcctcaccccgccggaagcagtgcaagaagcagcagctagagttggccaagaagtacctgcagctcctgcggacctctgcccagcagcgctacaggagccaaatccctgggtcagggcagccccacgccttccaccaggtctatgtccctccaatcctgcgccgggccacagcatccttagacactccggagggggccattatgggggacgtcaaggtggaagatggtgctgacgtgagcatctcggacctcttcaacaccagggttaacaagggcccgagggtgaccgtgcttttggggaaggctggcatgggcaagaccacgctggcccaccggctctgccagaagtgggcagagggccatctgaactgtttccaggccctgttcctttttgaattccgccagctcaacttgatcacgaggttcctgacaccgtccgagctcctttttgatctgtacctgagccctgaatcggaccacgacactgtcttccagtacctggagaagaacgctgaccaagtcctgctgatctttgatgggctagatgaggccctccagcctatgggtcctgatggcccaggcccagtcctcacccttttctcccatctctgcaatgggaccctcctgcctggctgccgggtgatggctacctcccgtccagggaagctgcctgcctgcctgcctgcagaggcagccatggtccacatgttgggctttgatgggccacgggtggaagaatatgtgaatcacttcttcagcgcccagccatcgcgggagggggccctggtggagttacagacaaatggacgtctccgaagcctgtgtgcggtgcccgcactgtgccaagtcgcctgtctctgcctccaccatctgcttcctgaccacgccccaggccagtctgtggccctcctgcccaacatgactcagctctatatgcagatggtgctcgccctcagcccccctgggcacttgcccacctcgtccctactggacctgggggaggtggccctgaggggcctggagacagggaaggttatcttctatgcaaaagatattgctccacccttgatagcttttggggccactcacagcctgctgacttccttctgcgtctgcacaggccctgggcaccagcagacaggctatgctttcacccacctcagcctgcaggagtttcttgctgccctgcacctgatggccagccccaaggtgaacaaagacacacttacccagtatgttaccctccattcccgctgggtacagcggaccaaagctagactgggcctctcagaccacctccccaccttcctggcgggcctggcatcctgcacctgccgccccttccttagccacctggcgcagggcaatgaggactgtgtgggtgccaagcaggctgctgtagtgcaggtgttgaagaagttggccacccgcaagctcacagggccaaaggttgtagagctgtgtcactgtgtggatgagacacaggagcctgagctggccagtctcaccgcacaaagcctcccctatcaactgcccttccacaatttcccactgacctgcaccgacctggccaccctgaccaacatcctagagcacagggaggcccccatccacctggattttgatggctgtcccctggagccccactgccctgaggctctggtaggctgtgggcagatagagaatctcagctttaagagcaggaagtgtggggatgcctttgcagaagccctctccaggagcttgccgacaatggggaggctgcagatgctggggttagcaggaagtaaaatcactgcccgaggcatcagccacctggtgaaagctttgcctctctgtccacagctgaaagaagtcagttttcgggacaaccagctcagtgaccaggtggtgctgaacattgtggaggttctccctcacctaccacggctccggaagcttgacctgagcagcaacagcatctgcgtgtcaaccctactctgcttggcaagggtggcagtcacgtgtcctaccgtcaggatgcttcaggccagggaggcggacctcatcttccttctttccccgcccacagagacaactgcagagctacaaagagctccagacctgcaggaaagtgacggccagaggaaaggggctcagagcagaagcttgacgctcaggctgcagaagtgtcagctccaggtccacgatgcggaggccctcatagccctgctccaggaaggccctcacctggaggaagtggacctctcagggaaccagctggaagatgaaggctgtcggctgatggcagaggctgcatcccagctgcacatcgccaggaagctggacctcagtaacaacgggctttctgtggccggggtgcattgtgtgctgagggccgtgagtgcgtgctggaccctggcagagctgcacatcagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggcaggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagggtgcaggagccgtgggcggacagagccagggttctctccctgttagaagtctgcgcccaggcctcaggcagtgtcactgaaatcagcatctccgagacccagcagcagctctgtgtccagctggaatttcctcgccaggaagagaatccagaagctgtggcactcaggttggctcactgtgaccttggagcccaccacagccttcttgtcgggcagctgatggagacatgtgccaggctgcagcagctcagcttgtctcaggttaacctctgtgaggacgatgatgccagttccctgctgctgcagagcctcctgctgtccctctctgagctgaagacatttcgcattcagagctcccaagacccagggcggctcctgcctgacctgttgccctttgacccccaccaggctgacctccagctgtgtgagcaccgagggcctcgcccacctggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctcaggaagatagacctctcagggaatagcatcagctcagccgggggagtgcagttggcagagtctctcgttctttgcaggcgcctggaggagttgatgcttggctgcaatgccctgggggatcccacagccctggggctggctcaggagctgccccagcacctgagggtcctacacctaccattcagccatctgggcccaggtggggccctgagcctggcccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcagctgccgagctggcccaggtgctgccgcagatgggccggctgaagagagtggacctggagaagaatcagatcacagctttgggggcctggctcctggctgaaggactggcccaggggtctagcatccaagtcatccgcctctggaataaccccattccctgcgacatggcccagcacctgaagagccaggagcccaggctggactttgccttctttgacaaccagccccaggccccttggggtacttgatggccccctcaagacctttggaatccagccaagtgatgcacccaaatgatccacctttcgcccactgggataattgactcaggaaagaagagcctcggcagggcgctctgcactccacccaggaggaaggatacgtgtgtcctgctgcagtcctcagggagaacttttttgggaaccaggagctgggtctggacaaaggagtaccctgcattacgtgggatatgtgtgatcaattggggacatgcgacacacaatgagggtgtcatgacaatgcatgacacgtacggttatatgtggcagtgtgaccccttgacatgtggcgttacatgaaagtcagtgtggcacgtgttctgtggcatgggtgctggcatcccaagtagcaggatacatgattgttggtctatatatgacacatgacaaatgtccatgtcacaggactcatggctggccagatgacctcaggctggcccaagatctaatttattaatttttaaagcaaatacatatttatagattgtgtgtatggagcagctaagtcaggaaaagtcttccgcccgagctgggaggggagagtgtccatgcactgaccagtccaggggctcaagggccagggctctggaacaagccagggactcagccattaagtcccctcctgcctcaatcctcagcctacccatctataaacttgatgactcctcccttacttacatactagcttccaaggacaggtggaggtagggccagcctggcgggagtggagaagcccagtctgtcctatgtaagggacaaagccaggtctaatggtactgggtagggggcactgccaagacaataagctaggctactgggtccagctactactttggtgggattcaggtgagtctccatgcacttcacatgttacccagtgttcttgttacttccaaggagaaccaagaatggctctgtcacactcgaagccaggcttgatcaataaacacaatggtattccacgtc

SEQ ID NO: 5306 - DNA, 282 bp, Homo sapiens
gtgtgactttatcctggaggcagtgggatgctgatagcaagttcagacaggcatgaggccagaccagagctgagttttcaagataactccagccagaggagtctgcactatggaaacaacctgtcaatccagctcaaggcacacatagcccagacacccatgagaccctctccgtggggaccctagagcacctatcatgaacgaggagaccaaggctggctcctcatggaccccgttggcctccagctcggcaacaagaacctgtggagctgtcttgtgagg

SEQ ID NO: 5307 - DNA, 594 bp, Homo sapiens
acagatgaggacgctgaggtacgaagaggctgcgtaacctaccagggtcacacagctttggtgtggagtagggactcaaatccagggccctggtacggaggcatttgccctcaccaagattcaggcactgagagaagctgacgggcctagagaatggcaagacttgagatagcagaaggaaggagagagggtgagaaatggatccccgtgctgaggtctggtctggaaggagaagtctgcaaggagtctgcactatggaaacaacctgtcaatccagctcaaggcacacatagcccagacacccatgagaccctctccgtggggaccctagagcacctatcatgaacgaggagaccaaggctggctcctcatggaccccgttggcctccagctcggcaacaagaacctgtggagctgtcttgtgaggctgctcaccaaagacccagaatggctgaacgccaagatgaagttcttcctccccaacacggacctggattccaggaacgagaccttggaccctgaacagagagtcatcctgcaactcaacaagctgcatgtccagggttcggacacctggcagtctttcattcattg

SEQ ID NO: 5308 - DNA, 2350 bp, Homo sapiens
ggagctttgcacatgtatctcgtctctccctggcctccgctctataacttggccaagcccccagaaagcagggtgggcctctcagcagtggacctctccttttgcctctttctccaggtcactggtcttctggtctggacttgatccttcccccagatcaccatggccatggccaaggccagaaagccccgggaggcattgctctgggccttgagtgaccttgaggagaacgatttcaagaagttaaagttctacttacgggatatgaccctgtctgagggccagcccccactggccagaggggagttggagggcctgattccggtggacctggcagaattactgatttcaaagtatggagaaaaggaggctgtgaaagttgtcctcaagggcttgaaggtcatgaacctgttggaacttgtggaccagctcagccatatttgtctgcatgattacagagaagtataccgagagcatgtgcgctgcctagaggaatggcaggaagcaggagtcaatggcagatacaaccaggtgctcctggtggccaagcccagctcagagagcccagaatcacttgcctgccccttcccggagcaggagctggagtctgtcacggtggaggctctatttgattcaggggaaaagccctcactggccccatccttagttgtgctacaggggtcggctggcactggaaagacaactctcgccagaaaaatggtgttggactgggccaccggtactctgtacccaggccggtttgattatgtcttttatgtaagctgcaaagaagtggtcctgctgctggagagcaaactggagcagctccttttctggtgctgcggggacaatcaagcccctgtcacagagattctgaggcagccagagcggctcctgttcatcctggatggctttgatgagctgcagaggccctttgaagaaaagttgaagaagaggggtttgagtcccaaggagagcctgctgcaccttctaattaggagacatacactccccacgtgctcccttctcatcaccacccggcccctggctttgaggaatctggagcccttgctgaaacaagcacgtcatgtccatatcctaggcttctctgaggaggagagggcgaggtacttcagctcctatttcacggatgagaagcaagctgaccgtgccttcgacattgtacagaaaaatgacattctctacaaagcgtgtcaggttccaggcatttgctgggtggtctgctcctggctgcaggggcagatggagagaggcaaagttgtcttagagacacctagaaacagcactgacatcttcatggcttacgtctccacctttctgccgcccgatgatgatgggggctgctccgagctttcccggcacagggtcctgaggagtctgtgctccctagcagctgaagggattcagcaccagaggttcctatttgaagaagctgagctcaggaaacataatttagatggccccaggcttgccgctttcctgagtagtaacgactaccaattgggacttgccatcaagaagttctacagcttccgccacatcagcttccaggacttttttcatgccatgtcttacctggtgaaagaggaccaaagccggctggggaaggagtcccgcagagaagtgcaaaggctgctggaggtaaaggagcaggaagggaatgatgagatgaccctcactatgcagtttttactggacatctcgaaaaaagacagcttctcgaacttggagctcaagttctgcttcagaatttctccctgtttagcgcaggatctgaagcattttaaagaacagatggaatctatgaagcacaacaggacctgggatttggaattctccctgtatgaagctaaaataaagaatctggtaaaaggtattcagatgaacaatgtatcattcaagataaaacattcaaatgaaaagaaatcacagagccagaatttattttctgtcaaaagcagcttgagtcatggacctaaggaggagcaaaaatgtccttctgtccatggacagaaggagggcaaagataatatagcaggaacacaaaaggaagcttctactggaaaaggcagagggacagaggaaacaccaaaaaatacttacatataaacctaattaaatatgtacaagatctctatgaggaaaatgacaacactctgaggaaagaaatcaaagaagctgtaaatgaatgggaagattttccatgttcatgaatagaaagactcaatattgttaagatgttagttttccccagtttgatctgtagattcaatgcaatcccaatcaagatcccagcaaataactttgtggacattgataagatgattct

SEQ ID NO: 5309 - DNA, 423 bp, Homo sapiens
caccaaacagaagtgaactagtgagtatgggctaagagagcccaaacttggacctgtagagctgtcggaccaggaaaggggatctgtttcgtctcagtccccaggctttgcttactgggctcctggatcagggagctgagttctcgctgcctcacctccagctccccaagtctgaactgtggtcactggtcttctggtctggacttgatccttcccccagatcaccatggccatggccaaggccagaaagccccgggaggcattgctctgggccttgagtgaccttgaggagaacgatttcaagaagttaaagttctacttacgggatatgaccctgtctgagggccagcccccactggccagaggggagttggagggcctgattccggtggacctggcagaattactgatttcaaagtatgg

SEQ ID NO: 5310 - DNA, 3872 bp, Homo sapiens
ataaacacagggcgttcatctaccccactaactggagagaaggaaaacgctgggtaaatagaatggagaggcctggctgtgatcgatcagcctcaagaaaggagacagggtaaaagggagaaagaaaaggaagacccaaagtaacccaggaaatcagcacatagaagagacgaacagcccagcacgaagcgctgactcaccgctccacgccttcctggtccttaatgattggcggctggaagcgggaagaaaagatccgtggtgccatttgattggccaacgaattgctcccttgccattggctcagagggcttttgatgaacagatccagaaaatatgtgaagcgaaacgcccaccgccccttgaggggctgttctagacctttgctcctggtgtcgtatagagcgggggatatttcaagctggagatccgttttcttgtcccagtgaacaggtgcactatgttgaaataagagtggtgacggaggccttgtttatcttgtatcttattgtaaaaggtcatcaagaacccaccttggccaatcaagagaggagtcagctggctaatcaccgggcaggcaccgcctttttcttcccgctgcctagcttgtttgctttcgaccagccaaggagacctggtggcagggttgatctcatatttcttgtgcctcaaaatcccttctctgaagtctgccttccctggagaagcaagatggcagaatcggattctactgactttgacctgctgtggtatctagagaatctcagtgacaaggaatttcagagttttaagaagtatctggcacgcaagattcttgatttcaaactgccacagtttccactgatacagatgacaaaagaagaactggctaacgtgttgccaatctcttatgagggacagtatatatggaatatgctcttcagcatattttcaatgatgcgtaaggaagatctttgtaggaagatcattggcagacgaaaccgcaatcaggaggcatgcaaagctgtcatgaggagaaaattcatgctgcaatgggaaagtcacacttttggaaaatttcattataaattttttcgtgacgtttcgtcagatgtgttctacatacttcaattagcctatgattctaccagctattattcagcaaacaatctcaatgtgttcctgatgggagagagagcatctggaaaaactattgttataaatctggctgtgttgaggtggatcaagggtgagatgtggcagaacatgatctcgtacgtcgttcacctcactgctcacgaaataaaccagatgaccaacagcagcttggctgagctaatcgccaaggactggcctgacggccaggctcccattgcagacatcctgtctgatcccaagaaactccttttcatcctcgaggacttggacaacataagattcgagttaaatgtcaatgaaagtgctttgtgtagtaacagcacccagaaagttcccattccagttctcctggtcagtttgctgaagagaaaaatggctccaggctgctggttcctcatctcctcaaggcccacacgtgggaataatgtaaaaacgttcttgaaagaggtagattgctgcacgaccttgcagctgtcgaatgggaagagggagatatattttaactctttctttaaagaccgccagagggcgtcggcagccctccagcttgtacatgaggatgaaatactcgtgggtctgtgccgagtcgccatcttatgctggatcacgtgtactgtcctgaagcggcagatggacaaggggcgtgacttccagctctgctgccaaacacccactgatctacatgcccactttcttgctgatgcgttgacatcagaggctggacttactgccaatcagtatcacctaggtctcctaaaacgtctgtgtttgctggctgcaggaggactgtttctgagcaccctgaatttcagtggtgaagacctcagatgtgttgggtttactgaggctgatgtctctgtgttgcaggccgcgaatattcttttgccgagcaacactcataaagaccgttacaagttcatacacttgaacgtccaggagttttgtacagccattgcatttctgatggcagtacccaactatctgatcccctcaggcagcagagagtataaagagaagagagaacaatactctgactttaatcaagtgtttactttcatttttggtcttctaaatgcaaacaggagaaagattcttgagacatcctttggataccagctaccgatggtagacagcttcaagtggtactcggtgggatacatgaaacatttggaccgtgacccggaaaagttgacgcaccatatgcctttgttttactgtctctatgagaatcgggaagaagaatttgtgaagacgattgtggatgctctcatggaggttacagtttaccttcaatcagacaaggatatgatggtctcattatactgtctggattactgctgtcacctgaggacacttaagttgagtgttcagcgcatctttcaaaacaaagagccacttataaggccaactgctaggttgtcctatgtctcgactgcttctggttttgaagacttactcaaggctttggctcgtaatcggagcctgacatacctgagtatcaactgtacgtccatttccctaaatatgttttcacttctgcatgacatcctgcacgagcccacatgccaaataagtcatctgagcttgatgaaatgtgatttgcgagccagcgaatgtgaagaaatcgcctctctcctcatcagtggcgggagtctgagaaaactgaccttatccagcaatccgctgaggagcgacgggatgaacatactgtgtgatgccttgcttcatcccaactgcactcttatatcactggtgttagtcttctgctgtctcactgaaaattgctgcagcgcccttggaagagtgcttctgttcagcccaactctaagacaactagacctgtgtgtgaatcgcttaaaaaattacggagtgttgcatgtgacgtttcccttgctgtttccaacctgtcagttagaggagcttcatctgtctggctgtttctttagcagcgatatctgtcaatatattgccatagttattgctactaatgaaaaactgaggagcctggagattgggagcaacaaaatagaagatgcaggaatgcagctgctatgtggtggtttgagacatcccaactgcatgttggtgaatattgggctagaagagtgcatgttaaccagtgcctgctgtcgatctcttgcctctgttcttaccaccaacaaaacactagaaagactcaacttgcttcaaaatcacttgggcaatgatggagttgcaaaacttcttgagagcttgatcagcccagattgtgtacttaaggtagttgggcttccattaactggcctgaacacacaaacccagcagttgctgatgactgtaaaggaaagaaaacccagtttgatctttctgtctgaaacttggtctttaaaggaaggcagagaaattggtgtgacacctgcttctcagccaggttcaataatacctaattctaatttggattacatgtttttcaaatttcccagaatgtctgcagccatgagaacgtcaaatacagcatctaggcaacccctttgatcatgttgtacgtaaacagtatttattataaattactaccgtgactgggatgcaagagaattaggactataattttcctatttgatgtgtgtgtgtgtgtgtgtgtgtgtgtgtgtgtgtgtgtgtgtgtgaccttgatccagtcaaccacttcaaattcctacactgtctcaagagtattaaaaggattatatgaagtaataaaggataaaatgcattgg

SEQ ID NO: 5311 - DNA, 4034 bp, Homo sapiens
ataaacacagggcgttcatctaccccactaactggagagaaggaaaacgctgggtaaatagaatggagaggcctggctgtgatcgatcagcctcaagaaaggagacagggtaaaagggagaaagaaaaggaagacccaaagtaacccaggaaatcagcacatagaagagacgaacagcccagcacgaagcgctgactcaccgctccacgccttcctggtccttaatgattggcggctggaagcgggaagaaaagatccgtggtgccatttgattggccaacgaattgctcccttgccattggctcagagggcttttgatgaacagatccagaaaatatgtgaagcgaaacgcccaccgccccttgaggggctgttctagacctttgctcctggtgtcgtatagagcgggggatatttcaagctggagatccgttttcttgtcccagtgaacaggtgcactatgttgaaataagagtggtgacggaggccttgtttatcttgtatcttattgtaaaaggtcatcaagaacccaccttggccaatcaagagaggagtcagctggctaatcaccgggcaggcaccgcctttttcttcccgctgcctagcttgtttgctttcgaccagccaaggagacctggtggcagggttgatctcatatttcttgtgcctcaaaatcccttctctgaagtctgccttccctggagaagcaagatggcagaatcggattctactgactttgacctgctgtggtatctagagaatctcagtgacaaggaatttcagagttttaagaagtatctggcacgcaagattcttgatttcaaactgccacagtttccactgatacagatgacaaaagaagaactggctaacgtgttgccaatctcttatgagggacagtatatatggaatatgctcttcagcatattttcaatgatgcgtaaggaagatctttgtaggaagatcattggcagacgaaaccgcaatcaggaggcatgcaaagctgtcatgaggagaaaattcatgctgcaatgggaaagtcacacttttggaaaatttcattataaattttttcgtgacgtttcgtcagatgtgttctacatacttcaattagcctatgattctaccagctattattcagcaaacaatctcaatgtgttcctgatgggagagagagcatctggaaaaactattgttataaatctggctgtgttgaggtggatcaagggtgagatgtggcagaacatgatctcgtacgtcgttcacctcactgctcacgaaataaaccagatgaccaacagcagcttggctgagctaatcgccaaggactggcctgacggccaggctcccattgcagacatcctgtctgatcccaagaaactccttttcatcctcgaggacttggacaacataagattcgagttaaatgtcaatgaaagtgctttgtgtagtaacagcacccagaaagttcccattccagttctcctggtcagtttgctgaagagaaaaatggctccaggctgctggttcctcatctcctcaaggcccacacgtgggaataatgtaaaaacgttcttgaaagaggtagattgctgcacgaccttgcagctgtcgaatgggaagagggagatatattttaactctttctttaaagaccgccagagggcgtcggcagccctccagcttgtacatgaggatgaaatactcgtgggtctgtgccgagtcgccatcttatgctggatcacgtgtactgtcctgaagcggcagatggacaaggggcgtgacttccagctctgctgccaaacacccactgatctacatgcccactttcttgctgatgcgttgacatcagaggctggacttactgccaatcagtatcacctaggtctcctaaaacgtctgtgtttgctggctgcaggaggactgtttctgagcaccctgaatttcagtggtgaagacctcagatgtgttgggtttactgaggctgatgtctctgtgttgcaggccgcgaatattcttttgccgagcaacactcataaagaccgttacaagttcatacacttgaacgtccaggagttttgtacagccattgcatttctgatggcagtacccaactatctgatcccctcaggcagcagagagtataaagagaagagagaacaatactctgactttaatcaagtgtttactttcatttttggtcttctaaatgcaaacaggagaaagattcttgagacatcctttggataccagctaccgatggtagacagcttcaagtggtactcggtgggatacatgaaacatttggaccgtgacccggaaaagttgacgcaccatatgcctttgttttactgtctctatgagaatcgggaagaagaatttgtgaagacgattgtggatgctctcatggaggttacagtttaccttcaatcagacaaggatatgatggtctcattatactgtctggattactgctgtcacctgaggacacttaagttgagtgttcagcgcatctttcaaaacaaagagccacttataaggccaactgctagtcaaatgaagagccttgtctactggagagagatctgctctcttttttatacaatggagagcctccgggagctgcatatctttgacaatgaccttaatggtatttcagaaaggattctgtctaaagccctggagcattctagctgtaaacttcgcacactcaagttgtcctatgtctcgactgcttctggttttgaagacttactcaaggctttggctcgtaatcggagcctgacatacctgagtatcaactgtacgtccatttccctaaatatgttttcacttctgcatgacatcctgcacgagcccacatgccaaataagtcatctgagcttgatgaaatgtgatttgcgagccagcgaatgtgaagaaatcgcctctctcctcatcagtggcgggagtctgagaaaactgaccttatccagcaatccgctgaggagcgacgggatgaacatactgtgtgatgccttgcttcatcccaactgcactcttatatcactggtgttagtcttctgctgtctcactgaaaattgctgcagcgcccttggaagagtgcttctgttcagcccaactctaagacaactagacctgtgtgtgaatcgcttaaaaaattacggagtgttgcatgtgacgtttcccttgctgtttccaacctgtcagttagaggagcttcatctgtctggctgtttctttagcagcgatatctgtcaatatattgccatagttattgctactaatgaaaaactgaggagcctggagattgggagcaacaaaatagaagatgcaggaatgcagctgctatgtggtggtttgagacatcccaactgcatgttggtgaatattgggctagaagagtgcatgttaaccagtgcctgctgtcgatctcttgcctctgttcttaccaccaacaaaacactagaaagactcaacttgcttcaaaatcacttgggcaatgatggagttgcaaaacttcttgagagcttgatcagcccagattgtgtacttaaggtagttgggcttccattaactggcctgaacacacaaacccagcagttgctgatgactgtaaaggaaagaaaacccagtttgatctttctgtctgaaacttggtctttaaaggaaggcagagaaattggtgtgacacctgcttctcagccaggttcaataatacctaattctaatttggattacatgtttttcaaatttcccagaatgtctgcagccatgagaacgtcaaatacagcatctaggcaacccctttgatcatgttgtacgtaaacagtatttattataaattactaccgtgactgggatgcaagagaattaggactataattttcctatttgatgtgtgtgtgtgtgtgtgtgtgtgtgtgtgtgtgtgtgtgtgtgtgaccttgatccagtcaaccacttcaaattcctacactgtctcaagagtattaaaaggattatatgaagtaataaaggataaaatgcattgg

SEQ ID NO: 5312 - DNA, 3132 bp, Homo sapiens
atgaacttttctgtaatcacctgccccaacggtggtaccaaccaagggcttctgccttacctgatggccctggatcagtatcagctggaggaattcaagctttgcttggaaccccagcagctgatggacttctggtcggccccccaggggcacttcccgcgtatcccctgggcaaacttgagagctgccgaccctttgaatctgtcctttcttttggatgaacacttcccaaaaggtcaggcatggaaagtggtcctcggcatcttccagacaatgaatctgacctcactgtgtgagaaagttagagccgagatgaaagagaatgtgcagacccaagagctgcaagatccaacccaggaagatctagagatgctagaagcagcagcagggaatatgcagacccagggatgccaagatccaaaccaagaagaactagacgagctagaagaagaaacagggaatgtacaggcccagggatgccaagatccaaaccaagaagaaccagagatgctagaggaagcagaccacagaagaaaatacagagagaacatgaaggctgaactactggagacatgggacaacatcagttggcctaaagaccacgtatatatccgtaatacatcaaaggacgaacatgaggaactgcagcgcctactggatcctaataggactagagcccaggcccagacgatagtcttggtggggagggcaggggttgggaagaccaccttggcaatgcaggctatgctgcactgggcaaatggagttctctttcagcaaaggttctcctatgttttctatctcagctgccataaaataaggtacatgaaggaaactacctttgctgaattgatttctttggattggcccgattttgatgcccccattgaagagttcatgtctcaaccagagaagctcctgtttattattgatggctttgaggaaataatcatatctgagtcacgctctgagagcttggatgatggctcgccatgtacagactggtaccaggagctcccagtgaccaaaatcctacacagcttgttgaagaaagaattggttcccctggctaccttactgatcacgatcaagacctggtttgtgagagatcttaaggcctcattagtgaatccatgctttgtacaaattacagggttcacaggggacgacctacgggtatatttcatgagacactttgatgactcaagtgaagttgagaaaatcctgcagcagctaagaaaaaacgaaactctctttcattcctgcagtgcccccatggtgtgttggaccgtatgttcctgtctgaagcagccgaaggtgaggtattacgatctccagtcaatcactcagactaccaccagtctgtatgcctattttttctccaacttgttctccacagcagaggtagatttggcagatgacagctggccaggacaatggagggccctctgcagtctggccatagaagggctgtggtctatgaacttcacgtttaacaaagaagacactgagatcgagggcctggaagtgcctttcattgattctctctacgagttcaatattcttcaaaagatcaatgactgtgggggttgcactactttcacccacctaagtttccaggagttttttgcagccatgtcctttgtgctagaggaacctagagaattccctccccattccacaaagccacaagagatgaagatgttactgcaacacgtcttgcttgacaaagaagcctactggactccagtggttctgttcttctttggtcttttaaataaaaacatagcaagagaactggaagatactttgcattgtaaaatatctcccagggtaatggaggaattattaaagtggggagaagagttaggtaaggctgaaagtgcctctctccaatttcacattctacgactttttcactgcctacacgagtcccaggaggaagacttcacaaagaagatgttgggtcgtatctttgaagttgaccttaatattttggaggacgaagaactccaagcttcttcattttgcctaaagcactgtaaaaggttaaataagctaaggctttctgttagcagtcacatccttgaaagggacttggaaattctggagacaagcaagtttgattccaggatgcacgcatggaacagcatttgctctacgttggtcacaaatgagaatctgcatgagctagacctgagtaacagcaaacttcatgcttcctctgtgaagggtctctgtcttgcactgaaaaatccaagatgcaaagtccagaaactgacgtgcaaatcggtaactcctgagtgggttctgcaggacctcattattgcccttcagggtaacagcaagctgacccatctgaacttcagctctaacaagctgggaatgactgtccccctgattcttaaagctttgagacactcagcttgcaacctcaagtatctgtgcctggagaaatgcaacttgtcggcagccagctgtcaggacctagccttgtttctcaccagcatccaacacgtaactcgattgtgcctgggatttaatcggctccaagatgatggcataaagctattgtgtgcggccctgactcaccccaagtgtgccttagagagactggagctctggttttgccagctggcagcacccgcttgcaagcacttgtcagatgctctcctgcagaacaggagcctgacacacctgaatctgagcaagaacagcctgagagacgagggagtcaagttcctgtgtgaggccttgggtcgcccagatggtaacctgcagagcctgaatttgtcaggttgttctttcacaagagagggctgtggagagctggctaatgccctcagccataatcataatgtgaaaatcttggatttgggagaaaatgatcttcaggatgatggagtgaagctactgtgtgaggctctgaaaccacatcgtgcattgcacacacttgggttggcgaaatgcaatctgacaactgcttgctgccagcatctcttctctgttctcagcagcagtaagagcctggtcaatctgaaccttctaggcaatgaattggatactgatggtgtcaagatgctatgtaaggctttgaaaaagtcgacatgcaggctgcagaaactcgggtaa

SEQ ID NO: 5313 - DNA, 3628 bp, Homo sapiens
gtatcccgcgcctcccgacctttggccgctggcattcctgcgcgggcgggagctgcgggcgctcgggggataaggcgaggacgcaccagcattaatggaataggagaactcccgaagcttttagggccctgggaaagggggcgtggctggaaacggagctactggcttcggagaattctgtgaccctcaccaccgcgacgaccccgaggaaacgctgtcaggtcgcctttggttggcaaggcgtggttgtcctcgctgtcccgcgccttggcggaatgggcacctcactagccctggcactagctagcatcgctctaaactcaagaggcctgaatatttggacaagatggcagattcatcatcatcttctttctttcctgattttgggctgctattgtatttggaggagctaaacaaagaggaattaaatacattcaagttattcctaaaggagaccatggaacctgagcatggcctgacaccctggaatgaagtgaagaaggccaggcgggaggacctggccaatttgatgaagaaatattatccaggagagaaagcctggagtgtgtctctcaaaatctttggcaagatgaacctgaaggatctgtgtgagagagcgaaagaagagatcaactggtcggcccagactataggaccagatgatgccaaggctggagagacacaagaagatcaggaggcagtgctgggtgatggaacagaatacagaaatagaataaaggaaaaattttgcatcacttgggacaagaagtctttggctggaaagcctgaagatttccatcatggaattgcagagaaagatagaaaactgttggaacacttgttcgatgtggatgtcaaaaccggtgcacagccacagatcgtggtgcttcagggagctgctggagttgggaaaacaaccttggtgagaaaggcaatgttagattgggcagagggcagtctctaccagcagaggtttaagtatgttttttatctcaatgggagagaaattaaccagctgaaagagagaagctttgctcaattgatatcaaaggactggcccagcacagaaggccccattgaagaaatcatgtaccagccaagtagcctcttgtttattattgacagtttcgatgaactgaactttgcctttgaagaacctgagtttgcactgtgcgaagactggacccaagaacacccagtgtccttcctcatgagtagtttgctgaggaaagtgatgctccctgaggcatccttattggtgacaacaagactcacaacttctaagagactaaagcagttgttgaagaatcaccattatgtagagctactaggaatgtctgaggatgcaagagaggagtatatttaccagttttttgaagataagaggtgggccatgaaagtattcagttcactaaaaagcaatgagatgctgtttagcatgtgccaagtccccctagtgtgctgggccgcttgtacttgtctgaagcagcaaatggagaagggtggtgatgtcacattgacctgccaaacaaccacagctctgtttacctgctatatttctagcttgttcacaccagtagatggaggctctcctagtctacccaaccaagcccagctgagaagactgtgccaagtcgctgccaaaggaatatggactatgacttacgtgttttacagagaaaatctcagaaggcttgggttaactcaatctgatgtctctagttttatggacagcaatattattcagaaggacgcagagtatgaaaactgctatgtgttcacccaccttcatgttcaggagttttttgcagctatgttctatatgttgaaaggcagttgggaagctgggaacccttcctgccagccttttgaagatttgaagtcattacttcaaagcacaagttataaagacccccatttgacacagatgaagtgctttttgtttggccttttgaatgaagatcgagtaaaacaactggagaggacttttaactgtaaaatgtcactgaagataaaatcaaagttacttcagtgtatggaagtattaggaaacagtgactattctccatcacagctgggatttctggagttgtttcactgtctgtatgagactcaagataaagcgtttataagccaggcaatgagatgtttcccaaaggttgccattaatatttgtgagaaaatacatttgcttgtatcttctttctgccttaagcactgccggtgtttgcggaccatcaggctgtctgtaactgtggtatttgagaagaagatattaaaaacaagcctcccaactaacacttgggatggtgatcgcattactcactgttggcaagatctctgttctgtgcttcatacaaatgaacacttgagagaattggacctgtaccatagcaaccttgataaatcagcaatgaatatcctgcatcatgaactaaggcacccaaactgtaaactacaaaagctactgttgaaatttatcactttccctgatggttgtcaggatatctctacttctttgattcataacaagaatctgatgcatcttgacctaaaagggagtgatataggggataatggagtaaagtcattgtgtgaggccttgaaacacccagagtgtaaactacagactctcaggctggaatcttgcaacctaactgtattttgttgtctaaatatatctaatgctctcatcagaagccagagcctgatatttctgaatctgtcaaccaataatctgttggatgatggagtgcagcttttgtgtgaggccttaagacatccaaagtgttatctagagagactgtccttagaaagctgtggtctcacagaggctggctgtgagtatctttctttggctctcatcagcaataaaagactgacacatttgtgcttggcagacaatgtcttgggtgatggtggagtaaagcttatgagtgatgccctgcaacatgcacaatgtactctgaagagccttgtgctgaggcgttgccatttcacttcacttagcagtgaatatctgtcaacttctcttctacacaacaagagcctgacgcatctggatctaggatcaaactggctacaagacaatggagtgaagcttctgtgtgatgtctttcggcatccaagctgtaatcttcaggacttggaattgatgggctgtgttctcactaatgcatgttgtctggatctggcttctgttattttgaataacccaaacctgaggagcctggaccttgggaacaacgatttgcaggatgatggagtgaaaattctgtgtgatgctttgagatatccaaactgtaacattcagaggctcgggttggaatactgtggtttgacatctctctgctgtcaagatctctcctctgctcttatctgcaacaaaagactgataaaaatgaatctgacacagaataccttaggatatgaaggaattgtgaagttatataaagtcttgaagtctcctaagtgtaaactacaagttctagggttgtgcaaagaggcatttgatgaggaagcccagaagctgctggaagctgtgggagttagcaatccacacttaatcattaagccagattgtaactatcataatgaagaagatgtgtcttggtggtggtgtttctga

SEQ ID NO: 5314 - DNA, 3672 bp, Homo sapiens
gtgctgggctgttcgtctcttctatgtgctgatttcctgggttactttgggtcttccttttctttctcccttttaccctgtctcctttcttgaggctgatcgatcacagccaggcctctccattctatttacccagcgttttccttctctccagttagtggggtagatgaacgccctgtgtttataaggtgcctcccaggagcctgagacctgtgagaagaatggggggtggaggtgggggagactcgtcacgaagggagaccttggagcttcgagggtgggaatgttcttattagattcttcatctctgttgacacaaacatgtaggagaagctggagaacatagacagggatgaggttttatttatttattgttcctggtcactgtctctttgaggattggtatctctgctccagaaaagatggcagcctctttcttctctgattttggtcttatgtggtatctggaggagctcaaaaaggaggagttcaggaaatttaaagaacatctcaagcaaatgactttgcagcttgaactcaagcagattccctggactgaggtcaaaaaagcatcccgggaagaacttgcaaacctcttgatcaagcactatgaagaacaacaagcttggaacataaccttaagaatctttcaaaagatggatagaaaggatctctgcatgaaggtcatgagggagagaacaggatacacaaagacctatcaagctcacgcaaagcagaaattcagccgcttatggtccagcaagtctgtcactgagattcacctatactttgaggaggaagtcaagcaagaagaatgtgaccatttggaccgcctttttgctcccaaggaagctgggaaacagccacgtacagtgatcattcaaggaccacaaggaattggaaaaacgacactcctgatgaagctgatgatggcctggtcggacaacaagatctttcgggataggttcctgtacacgttctatttctgctgcagagaactgagggagttgccgccaacgagtttggctgacttgatttccagagagtggcctgaccccgctgctcctataacagagatcgtgtctcaaccggagagactcttgttcgtcatcgacagcttcgaagagctgcagggcggcttgaacgaacccgattcggatctgtgtggtgacttgatggagaaacggccggtgcaggtgcttctgagcagtttgctgaggaagaagatgctcccggaggcctccctgctcatcgctatcaaacccgtgtgcccgaaggagctccgggatcaggtgacgatctcagaaatctaccagccccggggattcaacgagagtgataggttagtgtatttctgctgtttcttcaaagacccgaaaagagccatggaagccttcaatcttgtaagagaaagtgaacagctgttttccatatgccaaatcccgctcctctgctggatcctgtgtaccagtctgaagcaagagatgcagaaaggaaaagacctggccctgacctgccagagcactacctctgtgtactcctctttcgtctttaacctgttcacacctgagggtgccgagggcccgactccgcaaacccagcaccagctgaaggccctgtgctccctggctgcagagggtatgtggacagacacatttgagttttgtgaagacgacctccggagaaatggggttgttgacgctgacatccctgcgctgctgggcaccaagatacttctgaagtacggggagcgtgagagctcctacgtgttcctccacgtgtgtatccaggagttctgtgccgccttgttctatttgctcaagagccaccttgatcatcctcacccagctgtgagatgtgtacaggaattgctagttgccaattttgaaaaagcaaggagagcacattggatttttttggggtgttttctaactggccttttaaataaaaaggaacaagaaaaactggatgcgttttttggcttccaactgtcccaagagataaagcagcaaattcaccagtgcctgaagagcttaggggagcgtggcaatcctcagggacaggtggattccttggcgatattttactgtctctttgaaatgcaggatcctgcctttgtgaagcaggcagtgaacctcctccaagaagctaactttcatattattgacaacgtggacttggtggtttctgcctactgcttaaaatactgctccagcttgaggaaactctgtttttccgttcaaaatgtctttaagaaagaggatgaacacagctctacgtcggattacagcctcatctgttggcatcacatctgctctgtgctcaccaccagcgggcacctcagagagctccaggtgcaggacagcaccctcagcgagtcgacctttgtgacctggtgtaaccagctgaggcatcccagctgtcgccttcagaagcttggaataaataacgtttccttttctggccagagtgttctgctctttgaggtgctcttttatcagccagacttgaaatacctgagcttcaccctcacgaaactctctcgtgatgacatcaggtccctctgtgatgccttgaactacccagcaggcaacgtcaaagagctagcgctggtaaattgtcacctctcacccattgattgtgaagtccttgctggccttctaaccaacaacaagaagctgacgtatctgaatgtatcctgcaaccagttagacacaggcgtgccccttttgtgtgaagccctgtgcagcccagacacggtcctggtatacctgatgttggctttctgccacctcagcgagcagtgctgcgaatacatctctgaaatgcttctgcgtaacaagagcgtgcgctatctagacctcagtgccaatgtcctgaaggacgaaggactgaaaactctctgcgaggccttgaaacatccggactgctgcctggattcactgtgtttggtaaaatgttttatcactgctgctggctgtgaagacctcgcctctgctctcatcagcaatcaaaacctgaagattctgcaaattgggtgcaatgaaatcggagatgtgggtgtgcagctgttgtgtcgggctctgacgcatacggattgccgcttagagattcttgggttggaagaatgtgggttaacgagcacctgctgtaaggatctcgcgtctgttctcacctgcagtaagaccctgcagcagctcaacctgaccttgaacaccttggaccacacaggggtggttgtactctgtgaggccctgagacacccagagtgtgccctgcaggtgctcgggctgagaaaaactgattttgatgaggaaacccaggcacttctgacggctgaggaagagagaaatcctaacctgaccatcacagacgactgtgacacaatcacaagggtagagatctgattgcgaggaacctgggctctgactcgaacacctgcaaaggacagggactgggaccgttacttacatgacactgcacccaggagatacaaatcattgatactctgagttgtgagatttctggcaccccattcatagatttgatatgatacacgtggtttttatgtgctctgtggccttggatgagtcactgaaaggccttcatggtctctcggtctcacaaggacctcttaacccctcaataaagtgttacatttctaaacattgg

SEQ ID NO: 5315 - DNA, 3504 bp, Homo sapiens
gtgctgggctgttcgtctcttctatgtgctgatttcctgggttactttgggtcttccttttctttctcccttttaccctgtctcctttcttgaggctgatcgatcacagccaggcctctccattctatttacccagcgttttccttctctccagttagtggggtagatgaacgccctgtgtttataaggtgcctcccaggagcctgagacctgtgagaagaatggggggtggaggtgggggagactcgtcacgaagggagaccttggagcttcgagggtgggaatgttcttattagattcttcatctctgttgacacaaacatgtaggagaagctggagaacatagacagggatgaggttttatttatttattgttcctggtcactgtctctttgaggattggtatctctgctccagaaaagatggcagcctctttcttctctgattttggtcttatgtggtatctggaggagctcaaaaaggaggagttcaggaaatttaaagaacatctcaagcaaatgactttgcagcttgaactcaagcagattccctggactgaggtcaaaaaagcatcccgggaagaacttgcaaacctcttgatcaagcactatgaagaacaacaagcttggaacataaccttaagaatctttcaaaagatggatagaaaggatctctgcatgaaggtcatgagggagagaacaggatacacaaagacctatcaagctcacgcaaagcagaaattcagccgcttatggtccagcaagtctgtcactgagattcacctatactttgaggaggaagtcaagcaagaagaatgtgaccatttggaccgcctttttgctcccaaggaagctgggaaacagccacgtacagtgatcattcaaggaccacaaggaattggaaaaacgacactcctgatgaagctgatgatggcctggtcggacaacaagatctttcgggataggttcctgtacacgttctatttctgctgcagagaactgagggagttgccgccaacgagtttggctgacttgatttccagagagtggcctgaccccgctgctcctataacagagatcgtgtctcaaccggagagactcttgttcgtcatcgacagcttcgaagagctgcagggcggcttgaacgaacccgattcggatctgtgtggtgacttgatggagaaacggccggtgcaggtgcttctgagcagtttgctgaggaagaagatgctcccggaggcctccctgctcatcgctatcaaacccgtgtgcccgaaggagctccgggatcaggtgacgatctcagaaatctaccagccccggggattcaacgagagtgataggttagtgtatttctgctgtttcttcaaagacccgaaaagagccatggaagccttcaatcttgtaagagaaagtgaacagctgttttccatatgccaaatcccgctcctctgctggatcctgtgtaccagtctgaagcaagagatgcagaaaggaaaagacctggccctgacctgccagagcactacctctgtgtactcctctttcgtctttaacctgttcacacctgagggtgccgagggcccgactccgcaaacccagcaccagctgaaggccctgtgctccctggctgcagagggtatgtggacagacacatttgagttttgtgaagacgacctccggagaaatggggttgttgacgctgacatccctgcgctgctgggcaccaagatacttctgaagtacggggagcgtgagagctcctacgtgttcctccacgtgtgtatccaggagttctgtgccgccttgttctatttgctcaagagccaccttgatcatcctcacccagctgtgagatgtgtacaggaattgctagttgccaattttgaaaaagcaaggagagcacattggatttttttggggtgttttctaactggccttttaaataaaaaggaacaagaaaaactggatgcgttttttggcttccaactgtcccaagagataaagcagcaaattcaccagtgcctgaagagcttaggggagcgtggcaatcctcagggacaggtggattccttggcgatattttactgtctctttgaaatgcaggatcctgcctttgtgaagcaggcagtgaacctcctccaagaagctaactttcatattattgacaacgtggacttggtggtttctgcctactgcttaaaatactgctccagcttgaggaaactctgtttttccgttcaaaatgtctttaagaaagaggatgaacacagctctacgtcggattacagcctcatctgttggcatcacatctgctctgtgctcaccaccagcgggcacctcagagagctccaggtgcaggacagcaccctcagcgagtcgacctttgtgacctggtgtaaccagctgaggcatcccagctgtcgccttcagaagcttggaataaataacgtttccttttctggccagagtgttctgctctttgaggtgctcttttatcagccagacttgaaatacctgagcttcaccctcacgaaactctctcgtgatgacatcaggtccctctgtgatgccttgaactacccagcaggcaacgtcaaagagctagcgttggctttctgccacctcagcgagcagtgctgcgaatacatctctgaaatgcttctgcgtaacaagagcgtgcgctatctagacctcagtgccaatgtcctgaaggacgaaggactgaaaactctctgcgaggccttgaaacatccggactgctgcctggattcactgtgtttggtaaaatgttttatcactgctgctggctgtgaagacctcgcctctgctctcatcagcaatcaaaacctgaagattctgcaaattgggtgcaatgaaatcggagatgtgggtgtgcagctgttgtgtcgggctctgacgcatacggattgccgcttagagattcttgggttggaagaatgtgggttaacgagcacctgctgtaaggatctcgcgtctgttctcacctgcagtaagaccctgcagcagctcaacctgaccttgaacaccttggaccacacaggggtggttgtactctgtgaggccctgagacacccagagtgtgccctgcaggtgctcgggctgagaaaaactgattttgatgaggaaacccaggcacttctgacggctgaggaagagagaaatcctaacctgaccatcacagacgactgtgacacaatcacaagggtagagatctgattgcgaggaacctgggctctgactcgaacacctgcaaaggacagggactgggaccgttacttacatgacactgcacccaggagatacaaatcattgatactctgagttgtgagatttctggcaccccattcatagatttgatatgatacacgtggtttttatgtgctctgtggccttggatgagtcactgaaaggccttcatggtctctcggtctcacaaggacctcttaacccctcaataaagtgttacatttctaaacattgg

SEQ ID NO: 5316 - DNA, 3421 bp, Homo sapiens
gaaacacaggctggaagcaagacctgacctgagggagttcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatggaggacggacaggtgcaagaaatagataatcctgagctgggagatgcagaagaagactcggagttagcaaagccaggtgaaaaggaaggatggagaaattcaatggagaaacagtctttggtctggaagaacaccttttggcaaggagacattgacaatttccatgacgacgtcactctgagaaaccaacggttcattccattcttgaatcccagaacacccaggaagctaacaccttacacggtggtgctgcacggccccgcaggcgtggggaaaaccacgctggccaaaaagtgtatgctggactggacagactgcaacctcagcccgacgctcagatacgcgttctacctcagctgcaaggagctcagccgcatgggcccctgcagttttgcagagctgatctccaaagactggcctgaattgcaggatgacattccaagcatcctagcccaagcacagagaatcctgttcgtggtcgatggccttgatgagctgaaagtcccacctggggcgctgatccaggacatctgcggggactgggagaagaagaagccggtgcccgtcctcctggggagtttgctgaagaggaagatgttacccagggcagccttgctggtcaccacgcggcccagggcactgagggacctccagctcctggcgcagcagccgatctacgtaagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggattgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagatgtccgtgttccaccgagaggacctggaaaggctcggggtgcaggagtccgacctccgtctgttcctggacggagacatcctccgccaggacagagtctccaaaggctgctactccttcatccacctcagcttccagcagtttctcactgccctgttctacgccctggagaaggaggagggggaggacagggacggccacgcctgggacatcggggacgtacagaagctgctttccggagaagaaagactcaagaaccccgacctgattcaagtaggacacttcttattcggcctcgctaacgagaagagagccaaggagttggaggccacttttggctgccggatgtcaccggacatcaaacaggaattgctgcaatgcaaagcacatcttcatgcaaataagcccttatccgtgaccgacctgaaggaggtcttgggctgcctgtatgagtctcaggaggaggagctggcgaaggtggtggtggccccgttcaaggaaatttctattcacctgacaaatacttctgaagtgatgcattgttccttcagcctgaagcattgtcaagacttgcagaaactctcactgcaggtagcaaagggggtgttcctggagaattacatggattttgaactggacattgaatttgaaaggtgcacttacctaaccattccgaactgggctcggcaggatcttcgctctcttcgcctctggacagatttctgctctctcttcagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagaccttggtgttacagcaatgcagcataaccaagcttggctgtagatatctctcagaggcgctccaagaagcctgcagcctcacaaacctggacttgagtatcaaccagatagctcgtggattgtggattctctgtcaggcattagagaatccaaactgtaacctaaaacacctacgcctctggagctgctccctcatgcctttctattgtcagcatcttggatctgctctcctcagcaatcagaagcttgaaactctggacctgggccagaatcatttgtggaagagtggcataattaagctctttggggttctaagacaaagaactggatccttgaagatactcaggttgaagacctatgaaactaatttggaaatcaagaagctgttggaggaagtgaaagaaaagaatcccaagctgactattgattgcaatgcttccggggcaacggcacctccgtgctgtgactttttttgctgagcagcctgggatcgctctacgaattacacaggaagcgggattcgggtctctaagatgtcttatgaatgcaggtcagagggtcacatgttaacactagagtctgtcgagaggtaggatttgacactggttttctcactatttttgggagattctgcacgagtcacgcacccccttcacatgacgctatgtactttctcacagggataataaagttagagcactctcgttgca

SEQ ID NO: 5317 - DNA, 3250 bp, Homo sapiens; identical to SEQ ID NO: 5277

SEQ ID NO: 5318 - DNA, 2485 bp, Homo sapiens
atccgtttcctttgcaggaaacacaggctggaagcaagacctgacctgagggagttcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatggaggaggacaggagggcctatttcctgagacactttggagacgaggaccaagccatgcgtgcctttgagctaatgaggagcaacgcggccctgttccagctgggctcggcccccgcggtgtgctggattgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagatgtccgtgttccaccgagaggacctggaaaggctcggggtgcaggagtccgacctccgtctgttcctggacggagacatcctccgccaggacagagtctccaaaggctgctactccttcatccacctcagcttccagcagtttctcactgccctgttctacgccctggagaaggaggagggggaggacagggacggccacgcctgggacatcggggacgtacagaagctgctttccggagaagaaagactcaagaaccccgacctgattcaagtaggacacttcttattcggcctcgctaacgagaagagagccaaggagttggaggccacttttggctgccggatgtcaccggacatcaaacaggaattgctgcaatgcaaagcacatcttcatgcaaataagcccttatccgtgaccgacctgaaggaggtcttgggctgcctgtatgagtctcaggaggaggagctggcgaaggtggtggtggccccgttcaaggaaatttctattcacctgacaaatacttctgaagtgatgcattgttccttcagcctgaagcattgtcaagacttgcagaaactctcactgcaggtagcaaagggggtgttcctggagaattacatggattttgaactggacattgaatttgaaaggtgcacttacctaaccattccgaactgggctcggcaggatcttcgctctcttcgcctctggacagatttctgctctctcttcagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagcctcacaaacctggacttgagtatcaaccagatagctcgtggattgtggattctctgtcaggcattagagaatccaaactgtaacctaaaacacctacggttgaagacctatgaaactaatttggaaatcaagaagctgttggaggaagtgaaagaaaagaatcccaagctgactattgattgcaatgcttccggggcaacggcacctccgtgctgtgactttttttgctgagcagcctgggatcgctctacgaattacacaggaagcgggattcgggtctctaagatgtcttatgaatgcaggtcagagggtcacatgttaacactagagtctgtcgagaggtaggatttgacactggttttctcactatttttgggagattctgcacgagtcacgcacccccttcacatgacgctatgtactttctcacagggataataaagttagagcactctc

SEQ ID NO: 5319 - DNA, 3826 bp, Homo sapiens; identical to SEQ ID NO: 5279

SEQ ID NO: 5320 - DNA, 3337 bp, Homo sapiens; identical to SEQ ID NO: 5278

SEQ ID NO: 5321 - DNA, 1973 bp, Homo sapiens
agtcgcgcagcctcgagggatggaggaggtgcgtgagggacacgcgctcggtggcgggatggaagccgatgggcccgcgagcctccaggagctgcctccctcgccacggtcgccttcaccgccgccgtcgccgccaccactgccctcgccgccgtcgctgccatcgcccgcagccccggaggcccccgagctccccgagccggcgcagccgtccgaggctcacgcccggcagctgctgctggaggagtgggggccgctgagcgggggcctggagctgccccagcgcctcacctggaagctgctcctgttgcggcggccgctctaccgcaacctgctgcgctcgcccaaccccgaaggcatcaacatttatgagccagcaccccctactggtcccacccagcgacccctggaaactctgggcaatttccgtggctggtacattagaactgaaaagctccagcagaaccaaagctggacagtgaagcagcagtgtgtggaccttctggccgagggcctgtgggaggagctgctggatgacgaacaaccagccattacggtcatggactggttcgaggacagccggctggatgcgtgcgtctatgagctgcatgtctggctgctggcggccgaccgccgcacggtcattgctcagcaccacgtggccccccgaacttctgggagaggaccccctggccgctgggtccaggtgtcccacgtattccgccattatggtcccggtgtgcgctttatccacttcctgcacaaggccaagaaccgcatggagcctggtgggctgcggcggacacgggtgaccgactcctccgtgtctgtgcagctccgggagtgactggctggctcctctgtcctgaccccacagcacctccctgacctttaggagccccaactcttagtcacctcctaggcctcttatttctccctggcccttggcttctcacttgatggacagcttcacacacccttaagcggtggactccagcattttcccagcactgtctgagccccatgagggcggagccactccttgtaaattcagtgcccgacagatgctctggcacagatgctttgtagatctctgttgagagaatgcatagacacctgtgcccaaggatgctgagggctggtctctgcttctttgaacttcactgaaactgaatgctcactgctgtgttgccagcaccacccagcccagggctgtgaacggagtgggtggcagcaaatgtgtgttgaaaggggaatgaagccattcacttcactcagttcctgtcccatttaaccgccccgatccttgatcttccattaccttcacatcccggggtccttctgaactgaccttgacctctgatctcttcacacatctccccttagcatctccacttacctacttttttttttttttttgagatggcatctcactctgtcacccaggctggagtgtagtgacacgatctcgactcactgcaatttccacctctcaggttcaagtggttctcctgcctcagcctctcaagtagctgggattacaggtgcacagcacctcccccgactaatttttatatttttagtagagacgggatttcgccatgttggccaggctggtctcaaactcctgacctcaagtgatctgcccaccttggcttcccaaagtgctgggattgcagacgtgagtcactgcgcccagccattccatgtctcttaagtctcagaatctcccctagctccctccaggtgtctgcagtggttgtcccctcaaagctgtcccacaccctcctccgaggaccctttgtgtatctcctccagctaccgcagagcccacaaacccaggcatctatcaaagtccctcattcatgagggtggtgaggacacagactgcgaccagaacagaaatatgaaaatgtgaatgacagcgtcccccgtgtgtggaatgtggggattaaaagcatttatcaacctct

SEQ ID NO: 5322 - DNA, 1602 bp, Homo sapiens
acagagccgtaaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcgctcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttgcctgcaaaaataaaatgcagaacgt

SEQ ID NO: 5323 - DNA, 2269 bp, Homo sapiens
aggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcgctcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaaggtgagtgagtgggggcgtgcttgggaggcgcaggatggcaccggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttgcctgcaaaaataaaatgcagaacgtactctacgatagatcacagttttttattcttaatgtcacaagcaggagaaaaatctcacattcatactaaaagttccaactagactcaacaggaatgaagtctctatttgtaatggaaagtcccagcctcccgctgccgtccagtgcgtgtactgtacacatccacactcacactcactcagggttcccggaccggctgtcctgcctgcggaactgaggtaaactagctcaggtgctgacactaggagggtctaccttacataaggtacaggtagaagcttgattgctaggcccaggcccacccagaccctccaatcctaacaggtatttaggcttgaggttcactccctcctcagctgcacacgcagccaggtattaacgaggatcagagctgttctgaggggtgggaaggagcagccccaccaccactcactcaccctcagtcacatcggggagggggcaccagttacatttacatcacattatttataaaataagaattacatttcatataacatggccagaaggagctctagtcccccaggaaagctgccggggacagcatttgagcctcttctttgcacaggcataacttaactatacagctaattcctagttaatagcatttatacttaaccacctcaatgaaccaagcttgaaggaatttaaaaggcaatttagcttaaatacaaaaataaatttttgttaaaaaacgttt

SEQ ID NO: 5324 - DNA, 3289 bp, Homo sapiens
tgcgcacgaaatctcccgcgggagctaagcctcttcgacaagaattctatagcgcgagcaaatcagtatctcgcgagaaattgaagaggaaacgtgagaatgaaagtggatgcccgcgaatcccggaagtcagactgtttttttcagttccctggaggctttttgatactgattcgcgtacacctgttgtttgaaagctctcagcgggacaatgctgacccagctgaaagcaaaatcagaggggaagcttgcaaaacagatttgcaaagttgtgttggatcattttgaaaaacagtattccaaagaactcggagatgcctggaatacagtaagggagatactaacatctccatcatgctggcaatatgctgtcctgcttaaccgattcaattatccttttgaactggaaaaggatttacatttgaagggctatcacacactctctcagggatctttacccaactatcctaaatcagtgaagtgttaccttagcagaactccgggccgaatcccttcagaaagacaccaaattggaaacctgaaaaaatattatctcctaaatgctgcttctcttctcccagtgttggctctggaattaagggatggggagaaggttctggatctctgtgctgctcctggagggaaatcaatagctctgctgcagtgtgcttgtccaggttatcttcattgtaatgaatatgatagtctgagattgaggtggctaaggcagacgttggaatctttcatcccacagcctttgataaatgtaattaaagtgtctgaattggatggcagaaaaatgggagatgcccagcctgaaatgtttgacaaggtgttagtggatgctccgtgttcaaatgatcgaagctggttgttttcttctgactctcagaaggcatcctgtaggataagtcaaaggaggaatttgcctcttctacagatagagctgttaaggtctgcaattaaggccttacgtcctggagggatacttgtatactctacatgcacgctttccaaggcagaaaatcaagatgtgatcagtgaaattttaaactcccacggtaacatcatgcctatggacattaaaggaatagcaaggacttgctcccacgacttcacatttgctcccactggccaggaatgtgggctcttagtgattccagataagggcaaagcctggggcccaatgtatgtagccaaattgaagaaatcatggagcacaggaaaatggtgacatgaatttgtaaactgtgtttatgtgttattatatttatatttctgaactcagtacatgttaatatttaaataattatgcagtaactttctctgggtctgtttggaatcctatttagttaatactttagcatcttagaatctaggcttgagaattgttcaggtgtatttttttcctagaaatatatctgtaacaatgatttaaggtggtgcagatggtgtttgttctatattataaatctgctgtctttgcttggcattttatagttaaattaattagaatatgtggttttatgcataacgtgtttagttctgtattctttctatgatagtgctttgaaccttcaaaaattcacattttccagcgctccgaccattttcccgcttatcaaatgtacaaatttgttcaaggtttttttttccccccaacttttgtaactgattgtctcagaactgattggtattctgagactaactttttaagcagcactatttctagttctggcaaaatagtttttttatttgcaatgttgttttctgttaaagactatattatgtttactgcaaaggtcagtgactctactgacaccagctttatttcccccactttttttgcattcacaaatacaaattgaaagggtaaattatattgaaaggcctttagaacagcagattcacatgcacatgtttgactttcgacattcagcttatagaattatggagtctatccagcaggctataaagcaagtacttgagacaaaaccggaatgattaataactgcaatcactgaactatatttggagagttttgttacataattgcagtcataatgagcactacagaatctgattatcttacattcacaatctggaggggctttttatttcactttgttataaaatgttctctgagaatatgatgccacatattaatgcacaagagggagatgcctaatgagagtggactgtgtgattaccagaacccagtgccatttactaagtggctctccatgtttacataaatcctgggaatactgtatacatttcttcttatgtacttagggttttagcttcagtcagcatcacactttttctccagaaattacttcacttagagtacaaacatatttttccaactattaagaaaaattatgcagcacatctcaaaaaatagcatctctttggaaaatagcctttaaaaaaaaacaactttatctgattatagaaatacaaaattctgctaaagctgaatacttttgaattgttcattatgttctgtgcctttaaactagagactatttgcttattaatattttttgttttgcaagcatatgtaacccggtttatatcatcaggaagtcttaggaagaatttttttttctgtaccttcagtctgttaatcatttgttttcctttatgtccaattgatatgtttaaagtaaagctaaagtccaggcacggtggcttatgcctgtaatcccagcactttgtcaggccgaggcagggggcatctcctgaggtcagaagttcgagactagcctgcccaacatggtaaaaccccgactctactaaaaatgcaaaaaaattagacaggcatggtggctggcaccagcaatcccagctacttaggaggctgaggcaggagaatcacttgaacccaggaggcagaggttgcagttagccaagatctcgccattgcactccagcctgggcgacaagagtgaaaccccgtagcaaaaaaataataataatagtaattaaataaaaataaagtaacgctagaactgttggaccaaatcaagtatatgggtaaatacagaagaataatgatggtggaaaagatgttttcttttttaagttatcattattagtttgttttttttatcttcagacactataggttttaaaaataggtttcttttatgtaggttaatcacagagtaaatctgcacactgtactttgttaaatgtcggtattttcccagtataatgcgatgaagcttaatctgaatacttggtatgctattgaatttactttcctatgattactgaaaaa

SEQ ID NO: 5325 - DNA, 2150 bp, Homo sapiens
ctcagcttcccgagtagctgggactgcaggcgccagcaacctcgcccggctaattttttgtatttttggtagagacggggtttcaccgtgttagccaggagggtctcgatctcctgacctcgtgatctgctcgcctcggcctcccaaagtgctgggattacaggcgtgagccaccacgcccggccaggtcccgaaacttaagcttcatttgtttcactgcaaatctgcttctgcctacaagcctggtctcattttcctctacctaaggatcttcctccatgcaatttcggcctaggaggcccttcccgccccttttcgcctagctaactctttcggtactcaaccaccaactcctaatcctccctggtcccccaagtgggctaggggcttcttgggagtccctcgcactgctctaagcatccaggcagagtcattattccgggtgccaggttgctctttttccagcagccttcaggggactcctggctgggcggagtctgtagaggcgcgcggagtcctgggagagcgtcagatgtatttcctttcccttttttcgctcgtgtcccgccgggtggcgctcaccacctccccggaacacgcgagtctcctgtcgcggttccggtcggaattaccccgtggagcacgccgatatggctgcgctgacactgaggggtgtccgggagctgctgaagcgtgtggacctcgcgacggtcccgcggagacatcgatataagaagaaatgggctgccacagagcccaaattccctgctgttcgactggctttgcagaattttgacatgacttacagtgtgcagtttggagatctttggccatcaatccgtgtcagtctcctctcagagcagaagtatggtgcactggtcaataactttgctgcctgggatcatgtaagtgctaagctggagcagctgagtgccaaggattttgtgaatgaagccatctcccactgggaactgcagtctgagggtggccaatctgcagccccatcccctgcctcctgggcctgcagtccgaaccttcgatgcttcacttttgacagaggggatatcagtcgcttccctcctgccagacctggcagcctgggtgtcatggagtactacctgatggatgctgcctccttgctgcctgttctggccctcggcctgcagcctggggacatcgtgcttgacctatgtgcagctcctgggggaaagacactagcgttgcttcagactggctgttgccgcaatcttgctgccaatgatctctccccgtcccgaatagccagactacagaagatccttcacagctatgtgcctgaagagatcagggatggaaatcaagttcgagttacctcatgggatggcaggaaatggggagaactggagggggacacctatgaccgggtgctggtggatgtgccctgtaccacagaccgccactcccttcatgaggaggagaacaacatctttaagcggtcaaggaagaaggagcgacagatattgcctgtgctgcaagtgcagcttcttgcggctggactccttgccaccaaaccaggaggccatgttgtctattctacctgctcactctcacacttacagaacgagtatgtggtgcaaggtgccattgagctcctggccaatcaatacagcatccaggtacaggtggaagatctgactcacttccgaagggttttcatggacacattttgtttcttctcatcctgtcaggttggggagctggtaataccaaacctcatggccaattttggccccatgtacttctgcaaaatgcgtaggctgacatagtatcacccaatccctgaagcaagaatacaaagggtatactctgttggatgcaccagaaactggaaactgggaccagtggcagagatgcactctcggtcctgtctccatcctgttcgtgtctttctgcagttttcggcaataagaagtagaagatttgctgtcctgctgtccaattgtggagcatcagcaggtttccaactcactcattaacccctaccccatctccaggcctgtactaaagtttgctgcccgcttaggggcttagaaggagaagccagtgagcaggctcacactaagttgtaaacataggagaagcatttggccaataaagttgttgaaactcta

SEQ ID NO: 5326 - DNA, 1498 bp, Homo sapiens
accccgtggagcacgccgatatggctgcgctgacactgaggggtgtccgggagctgctgaagcgtgtggacctcgcgacggtcccgcggagacatcgatataagaagaaatggcccggtcgccctcacccctcggaaaataccatagcgaccttgcctgcactcctgggtctccgccgccttgcaggaaaggattcagccccttcctcaacctcgagctgcctctggcgaccgggcaaggttacagcgaccaccctgtccatactgccggcccaaaccctggcaaaaggctgccacagagcccaaattccctgctgttcgactggctttgcagaattttgacatgacttacagtgtgcagtttggagatctttggccatcaatccgtgtcagtctcctctcagagcagaagtatggtgcactggtcaataactttgctgcctgggatcatgtaagtgctaagctggagcagctgagtgccaaggattttgtgaatgaagccatctcccactgggaactgcagtctgagggtggccaatctgcagccccatcccctgcctcctgggcctgcagtccgaaccttcgatgcttcacttttgacagaggggatatcagtcgcttccctcctgccagacctggcagcctgggtgtcatggagtactacctgatggatgctgcctccttgctgcctgttctggccctcggcctgcagcctggggacatcgtgcttgacctatgtgcagctcctgggggaaagacactagcgttgcttcagactggctgttgccgcaatcttgctgccaatgatctctccccgtcccgaatagccagactacagaagatccttcacagctatgtgcctgaagagatcagggatggaaatcaagttcgagttacctcatgggatggcaggaaatggggagaactggagggggacacctatgaccgggtgctggtggatgtgccctgtaccacagaccgccactcccttcatgaggaggagaacaacatctttaagcggtcaaggaagaaggagcgacagatattgcctgtgctgcaagtgcagcttcttgcggctggactccttgccaccaaaccaggaggccatgttgtctattctacctgctcactctcacacttacagaacgagtatgtggtgcaaggtgccattgagctcctggccaatcaatacagcatccaggtacaggtggaagatctgactcacttccgaagggttttcatggacacattttgtttcttctcatcctgtcaggttggggagctggtaataccaaacctcatggccaattttggccccatgtacttctgcaaaatgcgtaggctgacatagtatcacccaatccctgaagcaagaatacaaagggtatactctgttggatgcaccagaaactggaaactgggaccagtggcagagatgcactctcggtcctgtctccatcctgttcgtgtctttctgcagttttcggcaataagaagta

SEQ ID NO: 5327 - DNA, 1620 bp, Homo sapiens
agctgtgtccacctacctttctgtcccccactcccccttttacttccctccctcccctccccctttcccttgcccattcttcccccacatgacttctcctttcctcattgattttccagcccggtcgccctcacccctcggaaaataccatagcgaccttgcctgcactcctgggtctccgccgccttgcaggaaaggattcagccccttcctcaacctcgagctgcctctggcgaccgggcaaggttacagcgaccaccctgtccatactgccggcccaaaccctggcaaaaggctgccacagagcccaaattccctgctgttcgactggctttgcagaattttgacatgacttacagtgtgcagtttggagatctttggccatcaatccgtgtcagtctcctctcagagcagaagtatggtgcactggtcaataactttgctgcctgggatcatgtaagtgctaagctggagcagctgagtgccaaggattttgtgaatgaagccatctcccactgggaactgcagtctgagggtggccaatctgcagccccatcccctgcctcctgggcctgcagtccgaaccttcgatgcttcacttttgacagaggggatatcagtcgcttccctcctgccagacctggcagcctgggtgtcatggagtactacctgatggatgctgcctccttgctgcctgttctggccctcggcctgcagcctggggacatcgtgcttgacctatgtgcagctcctgggggaaagacactagcgttgcttcagactggctgttgccgcaatcttgctgccaatgatctctccccgtcccgaatagccagactacagaagatccttcacagctatgtgcctgaagagatcagggatggaaatcaagttcgagttacctcatgggatggcaggaaatggggagaactggagggggacacctatgaccgggtgctggtggatgtgccctgtaccacagaccgccactcccttcatgaggaggagaacaacatctttaagcggtcaaggaagaaggagcgacagatattgcctgtgctgcaagtgcagcttcttgcggctggactccttgccaccaaaccaggaggccatgttgtctattctacctgctcactctcacacttacagaacgagtatgtggtgcaaggtgccattgagctcctggccaatcaatacagcatccaggtacaggtggaagatctgactcacttccgaagggttttcatggacacattttgtttcttctcatcctgtcaggttggggagctggtaataccaaacctcatggccaattttggccccatgtacttctgcaaaatgcgtaggctgacatagtatcacccaatccctgaagcaagaatacaaagggtatactctgttggatgcaccagaaactggaaactgggaccagtggcagagatgcactctcggtcctgtctccatcctgttcgtgtctttctgcagttttcggcaataagaagtagaagatttgctgtcctgctgtccaattgtggagcatcagcaggtttccaactcactcattaacccctaccccatctccaggcctgtactaaagtttgctgcccgcttaggggctta

SEQ ID NO: 5328 - DNA, 1672 bp, Homo sapiens
aaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcgctcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaaggtgagtgagtgggggcgtgcttgggaggcgcaggatggcaccggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttgcctgcaaaaataaaatgcagaacgtactct

SEQ ID NO: 5329 - DNA, 1663 bp, Homo sapiens
gctttttgaccccggaagtccgggcgggcgccgagccgggtgcgttttgccacagagccgtaaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcgctcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaagctcagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttgcctgcaaaaataaaatgcagaacgtactct

SEQ ID NO: 5330 - DNA, 2201 bp, Homo sapiens
tccgccgagaaatagggggcgcgtgtttggaaattgatagaaaagataaagggaccgagctgctgtcagcctggcttactgatctgcgtccgtttcaccacggattcagttactaagcatttttttctttttttggttctttgcaacgtgagtggcattggctcagtgatttccatgagcatctctaccagaaaacattgcctcgatgaggtgtggtggaagcccggcagccccttctaatcggctaggcttgagaaagcgtgtacctctgcatttccgaaattaactcagcgtgatcggcaagattttcctcagcatctggtgtcaagacactcgtcactattaattcggaaagaaaaaaaaaaacaaaacaccgttttccagcatttctcttggtggagaactaaacaacaggaaaaatgtctattttccctaagatatctttgagacctgaggttgaaaactatcttaaggaaggctttatgaataaggagattgtgactgctttaggtaaacaagaagcagaaaggaagtttgaaactttgttaaagcacctgtcacatcctccatcatttacaactgtcagagtgaatacacatttagcctcagtacaacatgtgaaaaatctgttacttgatgaacttcagaagcagtttaatggattaagtgttcctattcttcaacatccagaccttcaagatgtgttacttattcctgttattggacccagaaagaatattaaaaaacaacagtgtgaagccattgttggagcccagtgtggcaatgcagttttaagaggagcccatgtctatgccccaggaattgtgtcagcatcacaatttatgaaagctggagatgttatttctgtatactctgatattaaaggaaaatgtaagaaaggagccaaagaatttgatggaacaaaagtatttcttggaaatgggatttctgaactaagccgcaaagaaatcttcagtggattacctgaactgaaaggcatgggcataagaatgacagaaccagtatatctcagcccttcatttgacagtgtactgccccgttacttatttttacaaaatttgccatctgccttagtaagtcatgtactaaatcctcaacctggagagaagattctagacttgtgtgcagcacctggagggaaaacaacacacattgcagcactaatgcatgatcagggagaagttatagcactggataaaatcttcaacaaagtagaaaaaatcaaacagaatgccttattgttagggctgaattccatcagggcattttgttttgatggaacaaaggcggttaaacttgatatggtggaggacacagaaggagaacctccatttctaccagaatcctttgaccgaattcttctggatgcaccctgtagtggaatgggacagagaccaaacatggcctgtacttggtctgtgaaggaagtggcatcatatcagccattacagcgaaaactcttcactgcagcggttcagctgctgaagccagagggtgtgctggtttatagcacgtgcactataacactggccgaaaatgaagaacaggttgcctgggccctgacaaaatttccttgccttcagcttcagccccaggaaccgcagattggaggagaaggaatgaggggagctgggctctcatgtgaacagttgaaacagctgcagcgatttgatccatcggctgtgccattaccggacactgacatggactctcttagagaggccagaagagaagacatgttgcgtctggctaataaggactctataggtttttttattgcaaaatttgtaaaatgcaaaagcacataggagagggatggatgctcagaaatgaaaattccaaacatttgctgtctgtggtttttttttttttaaccaaagtgttgtcaggccaactgaatgatgatgtggttgctatggaaacagaaaaggctgccagctgttttaccagggatccagagacatagaggaagtagggggtggtatgagattatattttctgtttttaaaagattttttttttttatgtatttagtagagtataaagaaaagcagatgcctatagatgtctggagcatattttcatttgtgatctaatgttttaatttgtaaagtgtacaagtcatttttaatgttaaaaattagtgaatctaacaaaaggaataaattagcaatatttga

SEQ ID NO: 5331 - DNA, 3698 bp, Homo sapiens
cgccgcgccccctgccccacctccgctcgcggttgccatgaagacccggtccgggagcagtcgactgccggagactcgggaggctgagctttcctcggcctgagccagccagaccccgggcaccgcgctcacccctcttcgccgccacgtccgcgaaggcctcacgcgcgaggccaggcgaggccccgaggcgcccaccacttcacgacaccggagcgaaccgggcgccagaggctgcgacccccctgccccgaatcctgccggtgggagtggctgcatttgaaccaaacggccttcgcgggcagcagccgtcgccccgcagtcccggggctcccaagggcctgtgaccgacgccgccctccgcgtcttcgtccccgaagccccgggaaccatccgccctcgggagaccatgctgcagatgcgaggaaagccgtttcctggaacatcggaattctaaccccagggtgaaggactcacgacaggcgaggggcagacatgctgaattccacgggcgaactggagttttcgaacgaagaagatcccgagatcatctcccaactcacttccctgcctctgtccggtgggaaaagctcagctggtgtgcccgaaaaaacgggctatccggactccgtttatgtcatggcagccaacatttttcagggtattcgaatcgaaaagtcggcacagaaagtcttaatcaagtatgggaatgaacccctgcggtccttgtccgagtctgaggatcagtcctttcagcgtttgtcttatgagctggctttcagtgccctgaaatatcaagatattttggaaactatattgatagacagctgtatcttcccaagtaccacaataccagatcatttgagcagtcttattattgtgatgctatatgatttccaagatagaaaatttcaaactcgtgtcctttctgataatgaagagcccatatcagaagttcaagaagtagagaaccttcttaacagttttaagataaaattggctgcagcattggcaagatgtcgaatcaagcatgatgccctttcaatttaccacatccttccagaaacagttaggaaacaggaactaagggcctccactttaccactttatgcttggataaatacttgtaaaatcagccctgaagaagtttataataatttgaagagaagaggctataataaagtcaaatctgtattgcatattgatgataaagtctttgctgtggatcaacattgctatgatgtcttaatttttccatctcatcttaaaaatgatcttataaatatagatcttttcaaagattacaaacttatatttcaggacaaatctcgaagtcttgctgtccattctgtaaaggctttattaaatatggatgatgatgtcttaatggtcaatacaggctcatggtacacagtttcccacatgtcaattttaacaaataataatacctcaaaagtatttgtgtgtggagtacaatcacaagctaaggatcctgacttgaagacccttttcacaaaaataggatgtaaaaatattgaaatacttcatgagaaatttattaacattgaatcaaaggatcacaggttacagaaagttaaagtgattttgctgctacctcgttgttcaggactgggtgttagtaatccagtagaatttattttaaatgaacatgaagatacagaattccttaaagatcactctcaaggaggcatctcagtggacaaacttcacgttcttgctcaacagcagtatgaacagctaacacatgcaatgaaatttactaaagctcaagcagttgtttactgcacatgttcagtttttccagaagaaaatgaagctgttgttaagaaagcactggaatttcaagaccttgggaataaaggacaaccttacaggcttagtcctcctgttcttccactgtgctccttaaaggaaattcaattgtctactgataaatttttcagaatggaaccatctgaaattaccaatggttgttttctttctattttaacaagggagcgggacccttctgagacagtgtctgtgaatgatgttttggcccgagctgcagccaagggtctgctggatgggattgagttgggtaaatcatcaaaacgggagaagaagaagaaaaaatcaaaaacatcattgacaaaaggtgccactactgataatggcatccaaatgaaaattgctgagttcctgaatcgagaaactaaagccagtgctaatctatcagagactgtaacaaaaccacctcttccccagaaaaatactgctcaagtgggggcttcctcacagaccagaaaacccaacaagctggccccccatcctgcagtgcctgcatttgtgaagaacacttgtccctccagaccgcgtgaacggcagacacacttcttaagacctcggccagaagacagaatggttgctctgaaacccatcaagattgttctgcctccagtctttatgccattttcaagtccccaagggatcagatctcggatgccaactcaacatttgtactgtcgttgggttgcacccaaggcacttgtgcccacctgccttcccacacactcactatccagaaaagaggaaaagcctaaagatgacacaccttcctccctactcaggcctcctcggcgatggctttgattgtcttgtgttttttataggggccaaagagcagttgattttttttcaaagtctagtatttctctgaagattctacatctctacacaagatattcattcttttggtcacctagggatcttctaagtgtgatattactttcagagaattcagacaagtgagaaacaataatgtaggagtcagcaaagcagaattcagagacttcagccaatcactgctgctctgagaggatccagttagagactcagtatcagcggtcagaacttatctcactcctgtgaactttcaggctggacttaaagctgccaagtttcccctgcagggaaggaaacactgcctcccttcagcaggtagctcattagaaagccaaacaggcaaacgatcctggcctctcccgccagctgaccgctcttcagcatccatgcggttgtagtcgtgactttctcagtcacgatcaagggtgattttttcttaaatatcaagctgttctttgaacagggaatgaacatgagtttttgtaacgtgactgaagttgagtttaagtaggaagcgcaggaagttcccaagtgccaggtgtgtgtagctcagagttccttttacagtgaggtgtctctcactgggggagcttccaggatcctgagcagactggacacaatcatctctcccttcctctatgtcaagcactgttacaaaagactgtgagcaaatttccatctaaatattaataattctgaagaagaggcaaaactgttgaatgcaagcgatacctattgttgaagaaacccacaaatttctgattctaagatcaggggatacaacaaaatctacaagtcatttcaaatagcacacaggaatcaaactttggtaaatcatttctgaggcacaattaaatatattgtagcactatgttaattaattatattaaatgtcgattcatcttgaatgtattctcaattgcctaccaaaaattggtatgattatcatttctgggtctactgatttttcatcatggcaacagaaattgtcattaaatagaattaagatacaa

SEQ ID NO: 5332 - DNA, 4968 bp, Homo sapiens
gctgcttcgctgcacacccgagaaagtttcagccaaacttcgggcggcggctgaggcggcggccgaggagcggcggactcggggcgcggggagtcgaggcatttgcgctgggcttcggagcgtagcgccagggcctgagcctttgaagcaggaggaggggaggagagagtggggctcctctatcgggaccccctccccatgtggatctgcccaggcggccgcggcggcggcggcggaggaggcgaccgagaagatacccgccctgcgccccgctctgctgtgggcgctgctggcgctctggctgtgctgcgcgacccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacaggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgcctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccagaaacagtgagaagaggaacagagctctgggaaagagacagggaagtctggaatggaaaagaacacgatgagaattagacactggaaaatatgtatgtgtggttaataaagtgctttaaactgaattgacattaacagtgggtgatcaactttactatgtgcttgtgcttttgcttttgatggagtaattcattgttttcttatccacctaaatgcacccagctgcccttgattttctctgggctactggccttcacaaccctctcccatgtaccctctctgactttggggtaaccctcccctaacttaaagctagagaattctgaaactgaggaggggatcctctgttaatcagtgagcactttttgatgagctgatagatgatatatgagagactatgcgtggcacaatactttgttacactcttcactgatacaagtgttctagagtgtacacacaacccaaagatagaaataaaaagaggagcagtgtcggggagcttggggcctggtgttccatggagagggagaaaggaacaagcttgaccaattcattcaactccttataaaaatgatgaggaggctgaaaaccaagaattttgattgggaacagaatacaagcagctgaatcagatgaattactaagcaacaaagatcctgtttttatacaaatatccttagtacaaaaacaaaagaaggaaaactgtaggggggagtaatgtgctaagtaagcagaattgcctcaaaaagaagttgttctagttactctttcagagtgggaatcttagattctggtattgtggatatggttcacatataatgggattgtgtgttttattttggagggattaaaggtcatagtttggtcctcagtataaaatcaactggtaatttattcatttcatttggtaaaaatgtattgactgcctgctatgttctaggcaccatgctatgtatttggaatacagctatacaaagcattgtcacataattgaaatgaaaattttatattatttaagtcacaagaacaagctatttaattatattacttttagtttctcttttaataaagaatagataatgctatcattctagatactaaataagtattttcttaacataatattactatccactttatcttgtagaagaaataactaaaatacatctgtcttcactcctgtatttgtttgcattttaaggattaaagacagaaatagaaatgtaaacaactttattttgaaaatatttcaacactgcaaatatctctgggtctgatattctagtaatctaattggctagtaattgatgttagtgtgatttattgttgaaggctaaatgtgtttttcagtttcaagaaaattgcttttaataattgcctagaacaagaggttgatttggcagcaagatgttgacgggaagttagagaagtcaataaaggaagtttttagctgagagagagtgattattcactcccatagcctctgcattgttatccattagccacgataagaaccttagggaattctgagagtgtgtccaggaaaggatctgtcaaactagaatagtatctcctccttgagaaaggaaataaccaaggattccgcagctgagaggctgccagggctagtgaaatagagtaaggaaatcttggctgtctcttattctctggttgtagtttaacgcaagacacttatttactcactgatggtgtgtgtgtgtgtgggaggggagattagcatgaggggtgggaatggggagattcgatgaagagaaaactaacatttttttggtgactcaggaactgtgccaggtacttccatgcttattagctcaattacacaaaaatcttgggaccaggtattatttttcaagtcttcccacatgaagtaactgaagtttggagatgttaagtgattcacccaaagttgtacagctaatatgtggttaggctgggtcctgaaaccgaggcagtttattttcaaagcctttgctttgtgcatcttactgcgccacattgcactgcacatctgcttcctgaaagcactttgtaggtgtgtaaaacttttcgttaaatgctttaagctgtttgggttaaaaatatatgttcatgttataagaaaaccaagacactcctaattataatcaaatagtacttgttacatatcaatatgtgtgtgtgtgtgtgtgtgtgtgtgtgtgtgtgtgtgtgtgtgtgtgtgtgtatggcgttgtgcagatgtttaaaagtagttacatagactagttcttgcttttcagggtcccataatctaaaccagatgacttcagctttggataaatatatagaaggaaatttaaagagaattcaaaacaatagatgatgcagtgacactgtgaataaatgttatttatacagtttgtaagatttcatgctcattgttcatatgtcccaggtggagttcagaaaatattctcttcatttccacaaaggggaatagtgcctggagatggttttcttttaaaaagtccttttcataatgcagtgcccttccttccattgcccttcattccattgcttcccatgcttgtcaagagactaaaatgttacttatagtaatagtcactatctcaatgtaaatagcacccttatttgatgagaattattatttcagttctaaaaatggggaaacaaagtcagcaggaggcaaagtagcttgttaaagtattctgcaactttcaaatggttgcttccactgcatttcacgtcttggcacttctaattgagggttactctaaccaccctatttaaaattgtaactgtcccccacccccttaattactaaccctggtctactttttgttttctttttctgtaactcttatcttcttactatataatttatactatataatttacttcattatgtctattgttcattgtctgtcttttccaaattctactgcctcttaccctctccagaatgaaaactagtatctttgtttttgtttactgatgtaacccaaacacctacaaacagtgcccagtatatactaggcccacaaatatatattggctgactgactgtatggtttagtatcatgtcatagtattgagactgtaactttggtcttctcattttcttctttgtattgtgcgtcctagacttagtttggcctctccttttgtccttgtatactctaatactggataagaattttggagtctttttcaactctgagtcagtgaatgccacataacttagtgactatatttaaatggttaatttacaattttttccctgcaaaggatactgtagtcactgtgagtattttagtattattgtaggactcaagagggaattaaaactacaaaaatgactcctcttgtatgacacagaaagaaatgtttcttcacagagggaggagaaaaatatcttcaagagagaactaatagaatcaaatcaatgaaccatgtctcatctttttggataagtaactgttagtaatccagacacttcatgagctttcattatgtaaagtctttagcagaagctaaaggaggggcaccaaccacagtaattttaacttaagaacaaaatggagcatgaaaataaattattaaatcatttactcccactatttttgggttagggccaataatggggagagaaagaggtagactagttttgtgtttgtggctattttaatagagtagcacaagtaatcaaaaaacagtaggctgttttgaatttactggctgtcccttatgagttcacagttagattggactgtcctcaatgtactttcttttttttctttctttcccacatctctttatttctctgattttgtttaaacttcataaagagctctctgatctttcctttccaaacaatgaaggtttatcctttgtaaactacctctgtactccacaggctgatgatatgtgatatccctatatcattaaagtaaagcctaagcaca

SEQ ID NO: 5333 - DNA, 2621 bp, Homo sapiens
ggcgccttgggaccgcgtgggagccgcagccgaaccgagtagggaccgggaccgcgcggcgccgccgtccccggccgggcccggcccccgcgagccgagcgcgcgcccccgtcgcccacccgggcgcggctggatgcggcggggtccccgcggcggcgacccccggccccgagcgcccggagcgcccagaggcggcgtgcggggcccggggacgccgcgccctccatgcgccgaggcgcgccccgagacagccgggggcccgcgccgcagccgccgcccgcgctgagccccggcccggcccgcggcccgcgcccggcggcagcatgagccaggccgagctgtccacctgctccgcgccgcagacgcagcgcatcttccaggaggctgtgcgcaagggcaacacgcaggagctgcagtcgctgctgcagaacatgaccaactgcgagttcaacgtgaactcgttcgggcccgagggccagacggcgctgcaccagtcggtcatcgacggcaacctggagctcgtgaagctgctggtcaagttcggcgccgacatccgcctggccaaccgcgacggctggagcgcgctgcacatcgccgcgttcggtggccaccaggacatcgtgctctatctcatcaccaaggcgaagtacgcggccagcggccggtgatgcccgccgggaccccggaccccggccctgcgcccgcgtcgtctctgctgtaccttcccgccaactacctcggtgcgcgcccggctcgcaggccccgccagaaggcccgtggccacggcgaatacggcgcgtgcgtcccggccccagggtccggcagccccgccggccgagcgcctccctgcggcctagccgggcccggccgggccggagcagcttcccacggcccccacccgctcgcctgcccgccgcctcgcgggtgggggcggggcgcgggctccagccccttttgaaatttgagtctcgcaaccagcaagttcggaatcccgagataccggatcctctgcgcaaaatgttttctcccgaaggtgaaaggcgggcggcgggagccgaaggcggactcggagcgctccgccgccgccttcaggacccgcccgcaggcccgggacgcgccgatgccggctgcagccgaggagcagccccgaggtccgaggtccgcgccgctggcgcgcggccgaggagacgctcggctgttcgctgttgctggtgttctaaactatttatcttgtgtgtgtacatttgtgggtggagtttgtgcgcctggtttttttgtttggaaaacactgcgtggtcaatgtggttatgggggggagtgatgcatttttttctagtcttaaaactaaaaacttgagtctaccatttcttggttgcactgaaaataccgcccagcctgatggtgttcccgtgctgtccctcccccttcccttctccccgcgtctacctccccaccccgttctgttccccctccctccttctccctctccctcaaatccgtgagttttggaagccccagggcctctctcccccgcccctcctggatgaggccaccatcccccaaaccggcttgttttgcagtttccccaggatcctggaagctcgctggcgctcgagggtggcggggacacgggggggtgggtgaaggttcgttaccttttctagtgcgttctatcatagttaacggttgcacacttttttaaaaaaagtaaatggatttgccacaattaaatgtcataacatttatgacagaatataaaatattaacatattttaagccaagttttaggtgtattttttgaatcttggttataaacccaattttaaagggcgatgtatccagcgttgtgaaggcaacagagtgtacccatatttatatttttataaaatacctataagactgtgaatctcttgtgctaatggctgagttaattgaaggatcgttttgcccctttttagcctcccagagcttcgaggactcaattcgaacccgaaatcctgccgtgggggaggggttgcgtcgagacctgggcccggggaggttctcctgcgtcactttctgtcctgaaaggcgcccttcctggtttctgtggctccaattttctatgcagccccacaccccttgttgttttgatcctgagaaataaaagggaggctgaattattcaaatttaaatgaggtttccccttcatggaagtgctgctgacccttcgtgcagaaatggggagcacttgaggacacaggtgggtggaggccctttgtgcgtggctggtcgtattcgggcagccctccgtcgctttttataaaactttgtgtgagaagaatatattgataatgtcagtgaaacaagcagacattgaaatggaggcacagattactccacaaggagttcttctgtatattttttctagatgcaaatacctttttaattatgttaattaatgttaagactttctaggcttatatcgaagctgtgtgtgggtcacggggtgatcactgctaactggataaagtttgtgcagcacattcctgagtgtacgatattgacctgtagcccagcgtgaaaaatttataaataaatttttcattgatctttttatattaaaaaaaagtttcttggtc

SEQ ID NO: 5334 - DNA, 2000 bp, Homo sapiens
atcttgtcgtatgatattaacacggctgctcggaaacacctcgagagagacaccagctttccccacgctcttcctttggtttctcttctggggggacattggatcgcacagctttgcaggggaaaaacagcttgtgtttttgaaagcaaggaataaaaacctcacaggcctccgtggctgactcgtaccttggaagattctgcaatgaggccacacggcacagaaatgttcttttacatccagacactaaacagtggcttgcatccttctctgtattagcaatgaacaaaaactaccaagacttaaaaaaaaaaatctctgattagaacccatggatgctgacaattatgtgtggctttcagatgcaaagccatttggctgcaggtgacatgaagaggctgggatacgattttgatcatttgctttcgccagcacttcctattagcacgagtgtggccagggagggtccttctctcatcacacttagagccactcgtgatgctgagtgtgctctttcatctggtgcagggcagggggcagggcgaggagagaagacccctgcttcacccactaaccaacaccctgggctggaagagctccaacaagcagcagacagagagttccatccccagcctgacagcaggaacagtgaagtccaagatagagccagctgtcgctgggagcccgggatggtgggtgcagcctcctccgcagctggtgagagtgtgtgtgtgcaggggtgtagggtggcctgttagcctagtgtctcctgcactcaaatgccctgtttcagttgagtaagctaattcacacagtgtcatgcaggctcctctggcttcggttcaagttaatgtcccattgaaaggcttctgttcaccttaggacacccagtcgggtagcccctgcagcgctctgccctgtgagcctgtgcaggtggtgcttggctgtgatcgaggttggcctgttccaggaagggaagcacggcctgggatatgggacggcactgtcctggcactgcctctaaccagcgtcagccttagcaggcacctgcctccttctgtgttgggtgtgtccagagccagagaggagcattccttttcatcacacctgaattatctccttcaacacccagagggaccaggctcccacccttggcatgatccaggaagaacagtgactcgagtgtggcttggcagcgccttacaggagaggcagggatgccgagaagggcaggtttgggcttcccccggaggcagagtggggtctggaaggcagggccccttggacagcatatacccttcaccctgccctggggaaggcagcaggacccagcggctcagtcttccgggtgggtcctaaccagccccacccccacagtgtgggtgctcccttgccttctctgggaccaggtcagcgtggctacagtaaagggccgcatcccttcacaggggacgctacccacagaggccagcattggtagggtgctgaggatgtgatgtgtgaggttgtaggggacatcagggccttctgtggcacaggcaggacttgacctcaggcggtgggctcctcggcctccctcacagtgccagagcccactctcctgtctccatgtcagtcccttccactaaactagcccaacacctggttcacggctacctgagcacactgggggctgggggcggggggcagggcggtgatgcacacttattaaaaccaagtatcagacatggtggctcacgcctgtcatcccagcacgttgggaggccgaggccggcagatcaccttaaggtcaggagttcgagaccagcctgaccaacatggtgaaaacctgcctctatgaaaaattcaaaattatccaggtgtggtggtgtgcgcctgtaatcccagctactcagggggctgaggcaggagaatcacttgaacccaggatgcagaggttgcagtgaaccaagatcgcaccactgcactccagcttcggtgacagggcgagactccatctc

SEQ ID NO: 5335 - DNA, 2301 bp, Homo sapiens
gattattttgcttccggacctcgactggaaattttttaaaagcccttatgacaaatgagcatgttacctctcctttttctttttagcagctttcagctttaacctaatgggtctatttattttattctgcatgcttaccagtggatcgtaaaggtgggaatgctcacatgatttcttcatcttcagtccatagccgaacgtttaacactagcaatgcgttaggccctgtgtgtaagcacaagaagcccctgtcagctgcgaaggcctgcatttcggaaatccttccatccaaattcaaacccaggctctctgctcccagcgctcttttgcaggaacagaagagtatcctcttgccctcagagaaggctcaaagctgtgagaacctttgtgtttctggttctttaaatgattccaaaagaggcctccccctccaagtgggagggagcattgagaacctgctcatgcgctcccgacgggattatgacagcaagtcgagcagtaccatgagcctccaggagtacagcaccagcggcaggaggccctgtcctctctcaagaaaggctgggatgcagttcaccatgctttatcgggacatgcaccagatcaaccgatctggcctcttcctgggctccatctcctcctcctcgagtgtgcgggatcttgcctcccactttgaaaagagtagcctggcattgtccaggggtgagctgggccccagccaggagggctcggaacacatccccaagcacaccgtctcttcccgcatcaccgcttttgagcagctgattcagcggtcccgttccatgccatccctggacctgtccggaaggctgagcaagtctcccacacctgtgctgtcccggggcagcctgacctcagcccgctcggccgagtccctacttgagtcaaccaagctccatcccaaggagatggatgggatgaactccagtggggtctatgcttccccaacatgtagcaatatggcacaccatgccttgagcttcaggggccttgtgccttctgagcctctctccacctgctctgatgacgtggaccgctgttcaaatatctccactgacagcagagaaggcagtggcggcagtgttcatggagatttccccaaacatcgcctcaacaagtgcaagggcacctgcccggcctcatacacccgcttcaccaccatccggaagcatgagcagcagcagacctctagacagcctgagtggcgcctggatgccagaggggacaagagcaccctcctcaggaacatctacctaatgagcccccttcctttccggctgaaaaagcccctccaccaccaccccagacaaccttcccctggtgactcctcaggcctcctggtgggccagaagccagacctccccagtcagccccatcaggaccagcccccttctggggggaagcccgtggttcccacacgcctgtcttcccgacacaccatggccaggcttagccgcagctcagagccctctcaggagagacccacggccctggaggactacccaagggccattaataatggaaactccgtgccatactcagaccacagcctggacaggaacaacaacccacaaagtgaactggcaccatcccgtggaggtggcattttgtgtgtttgcctagtctcacctgcccgtccctccactttgcttgcattatcccgtcctcctctgtgcccttggtgctcattttctggtctgtcctttgttttctgtttgttttgcttggcaattaatcatggctcgtagtggctgcacttctttaaaaacaaagcccccatgtcatttagactaaccaccaaactgtgtttcgaaagaaaaattggccgtttagctcaactgagaaatgtgttcatttgaactcttgaaccccttgctgtttgcaccaatccccaacataccccatggttttttgagaggcagcctctctcaatggccctatatgtgtgtgagtgtgtgccttgtccctataaggtcctgcacgcctctttgtagggacactttacaaagaaagttctctcattttgctcaccttttgccttttgagtagttttctttgcattaaactagttcacaaataaatccaaaaaatggggtggggggtggaatttttttttccttcagaattcgaccattgatcattaatcaagaatgacttcaaaattttgatatttataatagatgaaaggtgaactcttttcgcaagctggtttccagcgaaatctttgcctgttttaactctactttgttgttttaaagattcagaatcgccaagacattt

SEQ ID NO: 5336 - DNA, 4855 bp, Homo sapiens
atggccacgcgggtcgaggtgggctccataacgcccttgacggccgtgccaggcctgggtgagatgggcaaggaggagaccctgacgaggacctacttcctccaggccggcgaagcctctggggctcccccagcccggatcttggaagcgaagagccccctgcggagcccggcccggttactccctctgccaaggctcgcccccaaacccttctcgaaggagcaggacgtgaaatctcctgtcccgtctctgcggcccagttcgactggaccttccccctctggggggctctctgaggagccagcagcaaaggatctggacaacaggatgcccggcttggtggggcaggaggtgggcagtggggagggcccgaggacgagctcgcccctcttcaacaaggctgtgttcctgcggcccagctccagcaccatgattctcttcgaaaccaccaaaagcggccccgctctggggaaggcggttagtgagggggcggaggaggccaagctaggtgtgtccggctcccggcctgaggtggctgccaagcccgccctgcccacccagaagcctgcggggacccttccccggtcagctcccctgtctcaggacacaaaaccacctgtaccccaagaggaggcaggccaagaccatcctccctcaaaggccagcagtgtggaggacacggcacgcccccttgtggagcccaggcctcgcctgaagagaaggcccgtgtctgccattttcacggagtccattcagcctcagaagccaggccccggcgcagcggccacagtgggcaaagtgccacccacccctcccgagaagacgtgggtgaggaagcccaggcccttgtccatggacctcacggcccggtttgagaacaaagaggccttgctgaggaaggtggccgatgaaggaagtggacccacagcaggggatatggctgggctagagaggcccagagcagcgtccaagctggacagggactgtttggtcaaggcggaggctcctcttcatgatcctgatttggacttcctggaggtggccaagaaaatccgtgaacggaaggagaagatgctttcgaagccggagatgggcagccccagagccctggtggggggctcatctggggtcacccccagcaatgaccagagtccctgggaagaaaaggccaagctggacccagagccagagaaggctgctgagtccccctcacccaggctgggaaggggcctagaacttgctgaggttaagagcagagtggcggatggggaggccgcggcagggggagagtgggcctccaggaggagtgtcaggaagtgcatcagcctgtttcgggaggacagcaccttggccttggcagtggggtctgaatctcccctggccacccctgcgtccccatcggcggcaccagagccggagaaaggggttgtgagcgttcaggaacggatcagaggctggactgccgagagctcagaggctaagcccgaggtcaggaggaggacgttccaggctcggccgctgtcggcggatttgaccaaattgttttcaagttcagcttccagcaacgaagtcaaatatgagaagagtgctgagctgagcggcgagtttcctaaggaaccgagagaaaagcaaaaggaggggcacagtttggatggagcatgcatcccgagaagcccctggaagcctgggacactccgggataagtccaggcagacggagcagaaggttagctctaaccaagaccccgacagctgtcgcggtggaagctcagtggaggccccgtgcccttctgacgtcactccagaggatgaccggagcttccagactgtgtgggccacagtatttgagcaccacgtggagagacacacagtggctgaccagtcgggacgttgtctctccaccacaccccctggtgacatggcccatgcccgtgtctcagaacccaggccgaggcctgagatgggctcttggctgggcagggacccaccagacatgacaaaactgaagaaagagaactccagagggtttgacaatcccgagacggagaaattgggaccaaccacccttttgaatggtgaactgagaccgtatcacacgcctctccgggacaaataccctttgtctgaaaaccacaataataacaccttcctcaaacacttggaaaatcctcccacatcgcagagaattgagcccagatatgacattgtgcatgcagtgggagagcgtgtgcacagcgaggccatctcaccggcaccggaggagaaagcggtcacgctccgcagcctcaggtcttggctctcactgaaggacaggcagctgtcccaggaggtcacccctgctgacctggagtgtggtttggaaggtcaggcggggtccgtccaaagggccagtttgatttgggaagctcgaggcatgcctgaggctagtggaccgaagtttgggggcaattgcccgtttcccaaatggacaggcggggcagtggtgagctcgcacaaagccaccgtggcagtcagcgaagagcactgtgctcccggggccacctccgtcagggctatcaaggctgccatctgggaaagccagcatgaggggccagagggggccagaagcaagccaggagtgggagcaaggggcccaccccagggatgccccctcgatcctctttccagggctacgaatgggccttctgactcccaagcacgaacacatccagatgcatttgctgtgcagaaagggcccttcattgtagccgccagggagggtgatccagggccggcccaggtgccacagcctgcagtcagaatgcggaaagccggcgccatggaccagagaatggacagatggcggcggcggactttaccccccaacgtgaaatttgatacattcagttctcttgtcccagaggactctccacatgtggggcacagacgaacagattatgtgagccccacagccagtgccttaagaaaacctcaactatcccactacagggtggagacccaggaggtgaacccaggtgcttcacgggaccagacttccccagcagtgaagcaagggtcacctgtggaacccaaggcgacattttttgcagtcacctatcagattcccaatactcaaaaggcaaagggtgtggttctgtcaggagctgaaagcttgctggaacattctagaaaaatcactccaccctcgtctcctcattctttaacatccactttggtttctcttggtcatgaagaggcattggagatggcaggcagtaaaaactggatgaagggacgagagcatgaaaatgcaagcattttaaaaactctgaagccaacagaccgtccatcatctcttggggcctggagtctggaccctttcaatggaagaatcattgatgtggatgccttatggagtcatcggggatcagaagatggccctcgtcctcaaagcaattggaaggaaagtgcgaacaagatgtcccccagcggcggagctccccaaaccaccccgactctgaggagtcgtccaaaagatcttcctgtgagaaggaagactgatgtgatcagtgacacgttcccaggtaaaatcagagatggctacagatccagcgttcttgacattgacgccctgatggcagagtaccaggagctgtcgctgaaagtccctggggaggctcaggagaggaggagtcccaccgtggagcccagtacgttgcctcgggagaggcctgttcagctgggcggggtggagcagagaaggaggagcctgaaggagatgcccgataccgggggtctctggaaaccggccagttctgccgaaataaaccacagtttcactcctggcttaggcaagcagctggcagagaccttggagacagccatgggcaccaaatctagccctcccttctgggctctgccaccctcggctccttctgaaaggtatccagggggctctcctatacctgcggatcccaggaaaaaaacggggtttgctgaggatgacagaaaggcctttgccagtaaacatcatgttgcaaagtgtcagaattacctggctgagtcaaagccctctggtcgggaggatccaggcagtggggtcagggtgtcacccaaatcgccccccactgaccagaagaaagggaccccaaggaaatccaccgggcggggagaggaggacagtgtggcccagtggggtgaccacccacgtgactgtggacgggtgccgctggatatcaagagggcctactcagagaaggggccccctgccaacatccgagagggcctgtccatcatgcatgaagccagagagaggaggcgagagcagcccaaagggaggcccagccttactggagagaatttggaggccaaaatgggaccctgttggtgggagtcagggactggagacagtcacaaggtgctgccacgggacctggagaaggaggatgccccccaggagaaggagcgaccgctccagcaggtgtcccctgtggcctcggttccctggagaagccacagcttctgcaaagacaggaggagtgggccctttgtggtgagtgatgcaacatggctggagaggattgcacaggggtgctggttgctggacactgctgtgaatgtggttgttggagcatctggacagcccagggccctgacggggttgagggcagcaggcaactgtccaggaatctggtgtcacctgactagctgtgttgtggttcttgatgtggagggtgtttggtggctctgctggggaaaccttcttcctcttgagtttccagcccagcactgcctggcatggagtggttaagggaacatagactggtgttggaaagtcctgggttccaatcccagcacggtctcctgtcaacctcttt

SEQ ID NO: 5337 - DNA, 2115 bp, Homo sapiens
agatttccgcatatttcgcaactggctcctcaatgacataccattttcaagaacattacactttaagtgaaaactccagctctctcgtttcttcattacacagagatgtaacattgaccagagaaatgatcacactgagcttccgaaccacacgaactccgagcttattgctgtatgtgagctctttctatgaggaatacctttcagttatcctcgccaacaatggaagtttgcagattaggtacaagctagatagacatcaaaatcctgatgcatttacctttgattttaaaaacatggctgatgggcaacttcaccaagtgaagattaacagagaagaagccgtggtcatggtagaggtaatcccacaaatgcaaaagtcaaactaactaatattattattttgagaacaaataatctaatgaaaaaatttgataataaatattaatagaagagcaacccattcagtgctgctcttccataagtcaagaagaggccaaatatggccaggatctgggagagaggaggtggttgtttattctgtattgctttgttttgtttgtttagcaatgcaattccgtcaaaggtattattaatattttactatttaaaatatcaaaatatctttatttgttttactttactcaataggggaatgttctctagtttatcatagtgactactggtggaatctattcattgatattgcagtgggaacttgtcttattccgattataaaagaacaaatactttagcaacttaaaaacacggtttaaaagcacacaacatagttattaaaatgggaataagtaagaaaatagacctgagtcaccacagaggaagtaaattacacattgtcattggcattggaaggaaaatatactgtatagagaacagcagtgcttggttttatgtttcatattttctccacagaatgagtacgtatttaagtttaaaacagccagttccatctttttcatggattctgccaattatagatccttccattatgaagaagagtaaagccagcaagtgggtacatcgtggatagggtggtagctgatggcatcataggaattgcttataaaatagcttccccttctaaatgattaattatttgaaggtggcttcttgagcttttgtagtggtacttaaaagtgatttattttcatctttcctttcctcatcttcctttgcttccttatcattaaaattgtactttgtgttgatgtttgcttctcatgggacatctaataggttaaccagagcgcaaagaaacaagtcatcttgtcctcagggacagaattcaacgccgtcaaatctctcatattgggaaaggttttaggtaagtaggagaaagagctttttcccaaaaaatctaagtgtcatgtcacaaactctggaagcattcatcatgctgaaagaagctccttgtcttacttgaataataatttcacagtgagtgacaatcaaggtgcaaactgtactcttgcctgagtgtacatataatcatgagtaagtgctgcctgtgagatgtgcaagggcgttcctggaaaaatacctccacacttaacctctcacttggcaatcatgcataatgaatcacggtatttttctaacccttcttgaaaagtgaaatgttatcaaagctgacacgaagttcacagattatgtatgtattaatcaacatcaactccggagaccatcattcaatgataaaactacatttgagttgaacacaagagaaaaaactggtaatcttattacagcagatgaatacagttttatttctctctcaagccctgctttgcctgttgtttccatcctttttgactttagtatctaacaggaatggggaggcatattcataaatatctgttacgcaaggtagaaagttacagtaattgtctatcatattgtctatcataacctgttgtaaaagcacagttagctttacatttaataaaggaactgaggaaagtaatcttttttaaaaaaaacccatcttatgtaactcaattaagaaaatgaactatactttaatattaggatcaaaaagttgaataatatttattatatacatctttgtttccttccaaataaaggagaacatgg

SEQ ID NO: 5338 - DNA, 4216 bp, Homo sapiens
cagagatgtaacattgaccagagaaatgatcacactgagcttccgaaccacacgaactccgagcttattgctgtatgtgagctctttctatgaggaatacctttcagttatcctcgccaacaatggaagtttgcagattaggtacaagctagatagacatcaaaatcctgatgcatttacctttgattttaaaaacatggctgatgggcaacttcaccaagtgaagattaacagagaagaagccgtggtcatggtagaggttaaccagagcgcaaagaaacaagtcatcttgtcctcagggacagaattcaacgccgtcaaatctctcatattgggaaaggttttaggtcgttctggaccagtggatgagggagagcccttggttaatgcagacagaagagactctgctgtcatcggaggtgtgatagcagtggagatatttattttgctttgcatcactgccatagccatacgcatctatcaacagagaaagttacgcaaagaaaatgagtcaaaagtctcaaaaaaagaagagtgctaggacagctctaaacagtgagctcgatgtgcaaaacgcagtccatgaaaaccagaaagagtgagtcttctgattggcagctgtggctgtctctatcatcgtgactgtggacttccctgctgttgccatcagggtgcacacagcaggtgcagtgctgtcacctggctgaagatctgcagcctcagagcctctgggaggtccctttctccctcggtgaaacacagtcctccacatcaatttccaaacaatgaattaggtatggccattcatcactgttcagtagtttccccgtccaaaggctctcttccaaaactgcagtttgatctgtgttaataattgtggggttttagatgagaaaatgactataaagctgtggccctactttattttttaaaaatgacagaacttttgttcagatgtaaaagacaaaattgcactttaatgttttttgttacttgaaaacatatctgggatccctttttttggtcctctgctgatattataaaacaagaaatgcttcttggactaccttcactggcatttccatagtcctggaatccagagccaagtggcctatctaaaattcacagcccttttattctcctgtgtgatggttaatacaacacagttgaagcctggaaacactaccattatttttggtgtattgctttttctaattgactgtttttaatgattttgatacattttaatgttgaaattaatattgaatgttagctatgaaattttagtattgaattttataatggaacagaacattggtaggtaacaagatgcaagaggatgtcaatacaagattgtctgcctgtttttctttgtaatttgtaattacagtttttgtaacttgtgattatgtttttaactaaatttaccaccagatacaaacactacttcttacacagagttatcctttatttatatcattaagacgtgaatgaaacatcatcctaacttacttccccaagatattgagaggtcatatctgtttttcatcattcatttctttttctaaaagttgttactgatatgcttttgatttcctatgactctattatgttgtacagaacatcttttcaatttattaaaaaaaatagcttaactgaagatcactaattccttttctaaattttgaactgctctaggcataaatatcattgtgtattatcctttcatctaatcacttttggaatgtaaactgaaggctgttcactccaagttaagttaacatttacatgatgtttattaaatctgccagtctgatcaaaggtttatgaccatggggccaaattcccatagattacccaaaattgaatatgtgcagttaactggaacatgtctcattaaggtttacatacacactaagacagcaaaggattggaattaactttatggagacagttccagggactaatattgaagcagtggttatttgataatgcatggaaccaccatttggattcaataaaccaattacataaaagcaatgatgctacgctcttcatattccagataccaactgcctaccaaggactaatgagatggtatatttcttccacatcagggcaagctgaaaatatattgattcagcgttactgttatgtaaatgaatttccatcttctcatatgtgttatttttgaaagaatgaatacactctctgtcttaaatccgctcttaacaaatgatctcttctcagaatactacatctgtattgagagtacagacagcccattggtcactgcaccttttgcaagacagcgaaacggatgcatcaaattgcattgatacatcatcaccatcaatcttttgcactgatttttagacttaatcttcttatttgaaaataaactcatttttaaataaaataaaaaatattttagggaaagctctataaaattaaaattacagaattatatgctttttaaaatttatgcaaaaatgtgcagacaaatgtattctgtattggtttatgtatcactttgcccttgtatattttgagattattaagatttgttgacttttttggtttgatatttatcatctgttaaatttttccttttaaattattaaatgcaaagtgcaagaaaaagagataaatatttactgattgctagatgtaaaaatatctatgaatatatatatttaaacttctgccagagagcaaccatctgacagtcaacttactaaaatctaaattgagtactttttactgttgcagagaattaagtcactaaacgttatttagatatatagatgctagttgcaagtaacacccttttgtaatataaaagtaaaagcataataatttcccaacttttgtcttcaaattaaaaaagaaaatagcatataattaccattcttcatttgagaaagctgaagattctgatgcttaaaaacttcagaattctaatattaaaaatagagtggttcatgtgacattgaaggcttatctctgtaaaatagtgacactggtgagtggtattatctcaatatttttgtccaaattcaccttaggaagtcactgtaaatcttcattgtttcctaaaagtcattattacggcataaacttaacatactttgatagtagttagtactgatacgtgacatattctaccccgtgtctctgttactctgtctctattactgtgaaaagtcacagtaaatttaacattttcttccagactgtgtatgatctttcattgtaatagagacatggagtaggataagtcatgtattaacatataagatttttttaacctgctccctcagttttatagatgagacaaagataaggttgtaagagctaatctcttcaagtaggcagtactagtaagttgtcatgcgtggactgaactcctggcacttctttctcttaacttcaatccatagagaagcccaccttcctgccttcccagtattatttagcagaggagaaaatcatattaggctgtttgatactctgtttgcctagactgatcaataattctggatctttgttcacatcttctctgaaagaatatttgatgggaaatcttttttattttttaatttttgtgtacatactaggtgcatatatttatggagtacatgaaatgttttgatacaggcatgcactgtgaaataagcacatcatggagaatggggtatccatcccctcaacatttatcctttgtgttacaaacaacctgattacactctgtattttaaaatatgcagttaagtttttattgactatagtcaccctattgtgctatcatatagtaagttttactcattctttctactttttttgtacccattaacctatccccacctctgccccaccattatctcagctgtctactacttttttcagcctttactaaccatccttctactctatatccatgagttccgttgttttggtttttagatcccacaaataaatgagaacatggcaatgtttgtctttctatgcctggcctatttcacttaacataatgacctccagttccatccatgctgtcgcaagtgacaggatctcattctcttttatggctgaagagtactccattttgtatgtgaaccacattttcttcattcatctgttgatgaacacttagggtgtttccaaatcttagctgttataaacagtattgcaacaaataaaagagtgcagatgg

SEQ ID NO: 5339 - DNA, 4523 bp, Homo sapiens
agatttccgcatatttcgcaactggctcctcaatgacataccattttcaagaacattacactttaagtgaaaactccagctctctcgtttcttcattacacagagatgtaacattgaccagagaaatgatcacactgagcttccgaaccacacgaactccgagcttattgctgtatgtgagctctttctatgaggaatacctttcagttatcctcgccaacaatggaagtttgcagattaggtacaagctagatagacatcaaaatcctgatgcatttacctttgattttaaaaacatggctgatgggcaacttcaccaagtgaagattaacagagaagaagccgtggtcatggtagaggttaaccagagcgcaaagaaacaagtcatcttgtcctcagggacagaattcaacgccgtcaaatctctcatattgggaaaggttttagaggctgccggcgcggacccggacacaaggcgggcggcgactagtggcttcactggctgcctctcggcggtgcgcttcggctgcgctgctcccctgaaggcggcgctgcgccccagcggcccctcccgggtcaccgtccgcggccacgtggcccctatggcccgctgcgcggcgggggcggcgtccggctccccggcgcgggaactggctccccgactcgcggggggcgcaggtcgttctggaccagtggatgagggagagcccttggttaatgcagacagaagagactctgctgtcatcggaggtgtgatagcagtggagatatttattttgctttgcatcactgccatagccatacgcatctatcaacagagaaagttacgcaaagaaaatgagtcaaaagtctcaaaaaaagaagagtgctaggacagctctaaacagtgagctcgatgtgcaaaacgcagtccatgaaaaccagaaagagtgagtcttctgattggcagctgtggctgtctctatcatcgtgactgtggacttccctgctgttgccatcagggtgcacacagcaggtgcagtgctgtcacctggctgaagatctgcagcctcagagcctctgggaggtccctttctccctcggtgaaacacagtcctccacatcaatttccaaacaatgaattaggtatggccattcatcactgttcagtagtttccccgtccaaaggctctcttccaaaactgcagtttgatctgtgttaataattgtggggttttagatgagaaaatgactataaagctgtggccctactttattttttaaaaatgacagaacttttgttcagatgtaaaagacaaaattgcactttaatgttttttgttacttgaaaacatatctgggatccctttttttggtcctctgctgatattataaaacaagaaatgcttcttggactaccttcactggcatttccatagtcctggaatccagagccaagtggcctatctaaaattcacagcccttttattctcctgtgtgatggttaatacaacacagttgaagcctggaaacactaccattatttttggtgtattgctttttctaattgactgtttttaatgattttgatacattttaatgttgaaattaatattgaatgttagctatgaaattttagtattgaattttataatggaacagaacattggtaggtaacaagatgcaagaggatgtcaatacaagattgtctgcctgtttttctttgtaatttgtaattacagtttttgtaacttgtgattatgtttttaactaaatttaccaccagatacaaacactacttcttacacagagttatcctttatttatatcattaagacgtgaatgaaacatcatcctaacttacttccccaagatattgagaggtcatatctgtttttcatcattcatttctttttctaaaagttgttactgatatgcttttgatttcctatgactctattatgttgtacagaacatcttttcaatttattaaaaaaaatagcttaactgaagatcactaattccttttctaaattttgaactgctctaggcataaatatcattgtgtattatcctttcatctaatcacttttggaatgtaaactgaaggctgttcactccaagttaagttaacatttacatgatgtttattaaatctgccagtctgatcaaaggtttatgaccatggggccaaattcccatagattacccaaaattgaatatgtgcagttaactggaacatgtctcattaaggtttacatacacactaagacagcaaaggattggaattaactttatggagacagttccagggactaatattgaagcagtggttatttgataatgcatggaaccaccatttggattcaataaaccaattacataaaagcaatgatgctacgctcttcatattccagataccaactgcctaccaaggactaatgagatggtatatttcttccacatcagggcaagctgaaaatatattgattcagcgttactgttatgtaaatgaatttccatcttctcatatgtgttatttttgaaagaatgaatacactctctgtcttaaatccgctcttaacaaatgatctcttctcagaatactacatctgtattgagagtacagacagcccattggtcactgcaccttttgcaagacagcgaaacggatgcatcaaattgcattgatacatcatcaccatcaatcttttgcactgatttttagacttaatcttcttatttgaaaataaactcatttttaaataaaataaaaaatattttagggaaagctctataaaattaaaattacagaattatatgctttttaaaatttatgcaaaaatgtgcagacaaatgtattctgtattggtttatgtatcactttgcccttgtatattttgagattattaagatttgttgacttttttggtttgatatttatcatctgttaaatttttccttttaaattattaaatgcaaagtgcaagaaaaagagataaatatttactgattgctagatgtaaaaatatctatgaatatatatatttaaacttctgccagagagcaaccatctgacagtcaacttactaaaatctaaattgagtactttttactgttgcagagaattaagtcactaaacgttatttagatatatagatgctagttgcaagtaacacccttttgtaatataaaagtaaaagcataataatttcccaacttttgtcttcaaattaaaaaagaaaatagcatataattaccattcttcatttgagaaagctgaagattctgatgcttaaaaacttcagaattctaatattaaaaatagagtggttcatgtgacattgaaggcttatctctgtaaaatagtgacactggtgagtggtattatctcaatatttttgtccaaattcaccttaggaagtcactgtaaatcttcattgtttcctaaaagtcattattacggcataaacttaacatactttgatagtagttagtactgatacgtgacatattctaccccgtgtctctgttactctgtctctattactgtgaaaagtcacagtaaatttaacattttcttccagactgtgtatgatctttcattgtaatagagacatggagtaggataagtcatgtattaacatataagatttttttaacctgctccctcagttttatagatgagacaaagataaggttgtaagagctaatctcttcaagtaggcagtactagtaagttgtcatgcgtggactgaactcctggcacttctttctcttaacttcaatccatagagaagcccaccttcctgccttcccagtattatttagcagaggagaaaatcatattaggctgtttgatactctgtttgcctagactgatcaataattctggatctttgttcacatcttctctgaaagaatatttgatgggaaatcttttttattttttaatttttgtgtacatactaggtgcatatatttatggagtacatgaaatgttttgatacaggcatgcactgtgaaataagcacatcatggagaatggggtatccatcccctcaacatttatcctttgtgttacaaacaacctgattacactctgtattttaaaatatgcagttaagtttttattgactatagtcaccctattgtgctatcatatagtaagttttactcattctttctactttttttgtacccattaacctatccccacctctgccccaccattatctcagctgtctactacttttttcagcctttactaaccatccttctactctatatccatgagttccgttgttttggtttttagatcccacaaataaatgagaacatggcaatgtttgtctttctatgcctggcctatttcacttaacataatgacctccagttccatccatgctgtcgcaagtgacaggatctcattctcttttatggctgaagagtactccattttgtatgtgaaccacattttcttcattcatctgttgatgaacacttagggtgtttccaaatcttagctgttataaacagtattg

SEQ ID NO: 5340 - DNA, 392 bp, Homo sapiens
tggcttcctcctgagcacactgggatgtggcattacatcggggctgctgagtgcccttaccttcagctgcccagatgcagaggcagttccacaaggtactggcacaagaagagtcgtggaagactgacctggccatggcttctcatgtcccagctcaggacctgccacatcaattctccctttcctctggccgtcacgtgtggagtgaaattctcagaagcggctgtccctgtgcacctctctggctgtgtccagaaaatgaacatctgtttacagcttcaattttctaatgattagaatgccacaaacaagaaaacccagaggaaagctgttgatgctgaaatgtttccttcctctacatattccatgatgcgtcctgtggggttatgcaa

SEQ ID NO: 5341 - DNA, 1381 bp, Homo sapiens
agacagcctcagagctggtggggagacagcatgccactggaaaaattcgtagacatggaattcctggatcaaatgatactaagggggacttgcctggaagcagacttgtgtccgcagtatacaaactcaccctttaatgcacacactgaccagataacacaaacacatttacccccacagcacctagactcttctcacagtacacacacttgccttccagtacacagacatatccaaaggcacaccgacaagcaccacagcaaaaagatgttccccagaacacatggacaccccaatccccgtatcattagactctcccagaggcacgtatgtactgcttaatgcagagactcacctgaggcacactgatgcaccccgcatgacacagacttgcccccccataaggactctactatgacacacagacaatcccaacatcacacactgttcccacatcacacgaacccattttaggaaacacacagcatacagacttaccccatagaacacggcttccccgacaagcacacatactctcaaggccagtagactcaccccacagcacacagactttctctagagtgtacagcttcttcccacagcaaacagactctccccagggcacacagacacccctgacatcacatactctcaccacagaccatagactcgtcctagagcacagggactcttgccaatgaaacagactttcccgagaatagactcatgagacagcttgaagacccgcatcatgacacaaagactctcccacaacagacagactcaccccattgtgtacagacaagcaccataggccacagaccatcacctcaggacacagacttgcccagcaccacacagacactctgcagagcacgtagagtcaccccgcaaagcacagactaaacccatactacagagactctccctatagctttcagacaagtttaccccaccacagagacatgcaacggtacatcttacaacatatatcactccttgatgcacacaattgtgccacagcacacaaacttgtcctacagtgcacaaattcatgtcacaaaagacacactcaccacacaatacaaatacttgctccagccggacgcggtggctcacgcctgttatcccagcactttgggaggcctaggcaggtggatcacctgacgttgggagttcgagaccagtctcaccaacatggagaaaccccgtctccactaaaaatacaaaattagccgggcatggtggtgcatgcctgtaatctcagctgctccggaggctgaggcaggagaatcgcttgaacccaagaggcggaggttgcagtgagccaagattgtgccactgcactccagcctgggcaacaagggcaaaactttgcctc

SEQ ID NO: 5342 - DNA, 580 bp, Homo sapiens
ccgggaagaagcagaaagctacacggaaaaaggtccgcgagaacccacgaacctgcgctatggaggcctctctaggagggccggagcccaacggagtcataaacgaagaggcgaaagcgggagctacggggaagcgaagaggaagggcgccggcaaatgggggcagggccagtggcgagaacagggcctttcctgtgcttcagctccctggaaactggcactgcagaaggaggcaagggtgttaaaacgaggaggcagtgtcaggacaaaatcccaggatctggaaccccaaatacttggctcgcgggaagtgctcagtaaaccattttaaggtcctggagaaagattcgcgcaaaaagaggtgtagcgcggggggagtgttttgtcgtgaaaagaaccagcttacattaaggaagaaatgaaagaggaaattttaaaatgctaataacgcagccttcttgccttgtctctatctctgatccgggtaaaatgtatactcctctgcccatttttctttgtcttcatctcctgaaatgtagacatttaatagtgagcttctccccttgacctcatcactctg

SEQ ID NO: 5343 - DNA, 686 bp, Homo sapiens
gacttctgaatgcggactggaggagatgaggatggagggctgggaggatagtaagagagggagcagggagaccagttacgggccactgaagtagtcaaggtgtcagacaagagctttgagacaagaggactcgtcttagagatagattgcatgagggccatgagggtaagggaggtgtccaagctgacctcagccttctggcttgtccactggttggatggggtcaccattttattgtaatggcggatactggttgcagagaactgagtgttggaggaccatgaatgagttccatttcagatctgctcagcttgctgtccctgggagacaaccacaggagttgtttaggagacaccgggctacttcagcctggagctccaggaggaggtctgcattggtcgttgggacaataggaccaggacatggcaggctgcaggaccccagttgcaccaaactgccatcccctcctgcctggtttcccttcttcatgaaccgatcaatgggccatagccaggttgggatgcatgtcttccacaggatgggaactacctccagctgatcagttaacagttcagttggggacctttgagtaaaatagatgaccctctattaggtggttgggcctcttccaatcagttgacagcctacagagaacaaagactgatctccccccagcaagaaggaat

SEQ ID NO: 5344 - DNA, 1017 bp, Homo sapiens
gctaatgaatgaatgtgatcatttaaaagaaagtctctttcagtatgagagagagaaaacagaaggagtagtggttgtgagacaacttcaacaagaagtggctgacagcgtaaaaaaattaacgacgttagagtctccactggaaggtatatcacgttgtcatattaatttggatgagacacaggcctcaaataagaaattatttcaagtgaaaagtcaaatataagaaactcctggaaatgacaataaatatgttaaatgtatttggaaatgaagactttgattgccatggagacttaaaaacagatcaactgaaaatggatattctgattaagaagctaaaacagaagtttgatgatcttacggcagagaaggaagctttatcttcaaaatgtgtcaatttggctaaagacaatcaagttcttcaacaggagtttttatctatgaaaaaagtacaacagcaatgtgagaaacttgaggaggataaaaagatgttgaaagaagaaatattaaatcttaagacacatatggaaaacaatagggtagaacttagtaaactacaagaatataaattggagctagatgaaaaggcaatgcaggcagtagaaaaattagaagaaatccatttacaggaacaagcacaatatgaaaaacaattagagcagttaagcaaggataatatggcttcactaaataaaaaggaactcacacttaaagatgtggaatgtaaattctcagaaatgaaaactgcttatgaagaggttacaaccgaattagaagaatataaggaagcctttgcagcagcattgaaagctaacaattccatgtcaaaaaaattaacaaaatcaaataagaaaatagcagtgatcagcatgaagctccttatggagaaagagcagatgaaatattttctcagtgctcttcctacaaggcgagacccagagtcaccttgtgttgaaaatcttactagtataggactcaacagaaaatatattccccaaacacccataagaattc

SEQ ID NO: 5345 - DNA, 515 bp, Homo sapiens
atataagaaactcctggaaatgacaataaatatgttaaatgtatttggaaatgaagactttgattgccatggagacttaaaaacagatcaactgaaaatggatattctgattaagaagctaaaacagaaggaacaagcacaatatgaaaaacaattagagcagttaagcaaggataatatggcttcactaaataaaaaggaactcacacttaaagatgtggaatgtaaattctcagaaatgaaaactgcttatgaagaggttacaaccgaattagaagaatataaggaagcctttgcagcagcattgaaagctaacaattccatgtcaaaaaaattaacaaaatcaaataagaaaatagcagtgatcagcatgaagctccttatggagaaagagcagatgaaatattttctcagtgctcttcctacaaggcgagacccagagtcaccttgtgttgaaaatcttactagtataggactcaacagaaaatatattccccaaacacccataagaattc

SEQ ID NO: 5346 - DNA, 1695 bp, Homo sapiens
aaatgcaaagctagactgagcaagggaagtgacaggaaatggagctggggagacaaaaatgtggataacaacaaaagaatttcaacaggtaaaaaaatgagtcaaacatctctcaaacagaaaaagaatgagcctggaatgaggtcctcaaaagagagtctagaagcagaaaaaagaaaggaatctgacaaaacaggagttcgtctgagcaatcagggatcacaagaatcatcactgcggaagacagactctcgagggtaccttgtgcgcagtcaatggtctagaatatcccggagcccatccaccaaggctccatccatagatgagcctagaagcaggaacaccagtgctaaggtagagctccccagcagctccacgagctcccggactccatccacctccccaagcctgcatgactcctcaccgccgccgctgtccgggcagccctcgctccagccacccgcgtcgccccagctgccccggtcgctggactcgcggcctcccacgcccccagagcccgatcctggctcccggcgcagcaccaaaatgcaagagaatccggaggcctgggcccaaggcatcgtgcgggaaatccgccagacccgggactcgcagccgctggaatattcgcgcacgtcccccaccgagtggaagtcctccagccagcgcagggggatctaccccgcctccacccagctggaccgcaactctctgtccgagcagcagcagcagcagcgggaggacgaggacgactacgaggctgcctactgggcatccatgaggtcgttctacgagaagaacccgagctgctcgcgcccctggccgcccaaacccaagaacgccatcaccattgctctctcatcctgcgcgctcttcaacatggtggacggcaggaaaatctacgagcaagagggtctggaaaagtacatggagtatcagctcaccaatgagaacgtcatcctgaccccgggcccggcgttccgcttcgtcaaggcactacagtatgtcaatgctagactccgtgatctatatcctgatgaacaggacttatttgatattgtactgatgactaataaccatgcccaagtgggagtgcggcttataaacagcgtcaatcactacggcttactgattgaccgcttctgtctgaccgggggaaaagaccccattggctatttgaaggcatatcttaccaacttgtatattgctgcagattctgaaaaagtgcaagaggcaatacaagaaggtattgcctctgcgacaatgtttgatggagccaaagacatggcttactgtgacactcagctccgtgtagcctttgatggggatgctgtcctcttctctgatgagtctgaacattttaccaaggagcatgggctcgacaaattcttccagtatgatacattatgtgaaagtaagcctcttgctcaggaagagcctaggctggatgtcttgatcaataacgcagggatcttccagtgcccttacatgaagactgaagatgggtttgagatgcagttcggagtgaaccatctggggcactttctactcaccaatcttctccttggactcctcaaaagttcagctcccagcaggattgtggtagtttcttccaaactttataaatacggagacatcaattttgatgacttgaacagtgaacaaagctataataaaagcttttgttatagccgg

SEQ ID NO: 5347 - DNA, 2142 bp, Homo sapiens
atgcaaagctagactgagcaagggaagtgacaggaaatggagctggggagacaaaaatgtggataacaacaaaagaatttcaacaggtaaaaaaatgagtcaaacatctctcaaacagaaaaagaatgagcctggaatgaggtcctcaaaagagagtctagaagcagaaaaaagaaaggaatctgacaaaacaggagttcgtctgagcaatcagatgaggcgtgcagtcaatccgaatcactcgctgagatgttgccccttccagggtcactcgtcgtgtagacgctgcctttgtgcagctgagggaacagcccttggcccctgccacacaatacgtatttatattcacatgtgcctgttgtgggagcagggccagcagatcaccatgatgaggggatcacaagaatcatcactgcggaagacagactctcgagggtaccttgtgcgcagtcaatggtctagaatatcccggagcccatccaccaaggctccatccatagatgagcctagaagcaggaacaccagtgctaagctccccagcagctccacgagctcccggactccatccacctccccaagcctgcatgactcctcaccgccgccgctgtccgggcagccctcgctccagccacccgcgtcgccccagctgccccggtcgctggactcgcggcctcccacgcccccagagcccgatcctggctcccggcgcagcaccaaaatgcaagagaatccggaggcctgggcccaaggcatcgtgcgggaaatccgccagacccgggactcgcagccgctggaatattcgcgcacgtcccccaccgagtggaagtcctccagccagcgcagggggatctaccccgcctccacccagctggaccgcaactctctgtccgagcagcagcagcagcagcgggaggacgaggacgactacgaggctgcctactgggcatccatgaggtcgttctacgagaagaacccgagctgctcgcgcccctggccgcccaaacccaagaacgccatcaccattgctctctcatcctgcgcgctcttcaacatggtggacggcaggaaaatctacgagcaagagggtctggaaaagtacatggagtatcagctcaccaatgagaacgtcatcctgaccccgggcccggcgttccgcttcgtcaaggcactacagtatgtcaatgctagactccgtgatctatatcctgatgaacaggacttatttgatattgtactgatgactaataaccatgcccaagtgggagtgcggcttataaacagcgtcaatcactacggcttactgattgaccgcttctgtctgaccgggggaaaagaccccattggctatttgaaggcatatcttaccaacttgtatattgctgcagattctgaaaaagtgcaagaggcaatacaagaaggtattgcctctgcgacaatgtttgatggagccaaagacatggcttactgtgacactcagctccgtgtagcctttgatggggatgctgtcctcttctctgatgagtctgaacattttaccaaggagcatgggctcgacaaattcttccagtatgatacattatgtgaaagtaagcctcttgctcagggtcccctaaaaggctttctggaagatttaggcagactgcaaaagaagttctatgccaaaaatgaacggttactttgtcctatcaggacctacctggttacagctaggagtgcagccagttcaggcgcccgtgtgctgaagacccttcgacgctggggtctagagatagacgaagctcttttccttgctggagcccccaaaagtcccatcttggtgaagatccggccccacatcttctttgatgaccacatgttccacattgaaggggcacagaggaagagcctaggctggatgtcttgatcaataacgcagggatcttccagtgcccttacatgaagactgaagatgggtttgagatgcagttcggagtgaaccatctggggcactttctactcaccaatcttctccttggactcctcaaaagttcagctcccagcaggattgtggtagtttcttccaaactttataaatacggagacatcaattttgatgacttgaacagtgaacaaagctataataaaagcttttgttatagccgg

SEQ ID NO: 5348 - DNA, 3405 bp, Homo sapiens
gtgctttactgcgcgctctggtactgctgtggctccccgtcctggtgcgggacctgtgccccgcgcttcagccctccccgcacagcctactgattcccctgccgcccttgctcacctcctgctcgccatggagtcgctggttttcgcgcggcgctccggccccactccctcggccgcagagctagcccggccgctggcggaagggctgatcaagtcgcccaagcccctaatgaagaagcaggcggtgaagcggcaccaccacaagcacaacctgcggcaccgctacgagttcctggagaccctgggcaaaggcacctacgggaaggtgaagaaggcgcgggagagctcggggcgcctggtggccatcaagtcaatccggaaggacaaaatcaaagatgagcaagatctgatgcacatacggagggagattgagatcatgtcatcactcaaccaccctcacatcattgccatccatgaagtgtttgagaacagcagcaagatcgtgatcgtcatggagtatgccagccggggcgacctttatgactacatcagcgagcggcagcagctcagtgagcgcgaagctaggcatttcttccggcagatcgtctctgccgtgcactattgccatcagaacagagttgtccaccgagatctcaagctggagaacatcctcttggatgccaatgggaatatcaagattgctgacttcggtctctccaacctctaccatcaaggcaagttcctgcagacattctgtgggagccccctctatgcctcgccagagattgtcaatgggaagccctacacaggcccagaggtggacagctggtccctgggtgttctcctctacatcctggtgcatggcaccatgccctttgatgggcatgaccataagatcctagtgaaacagatcagcaacggggcctaccgggagccacctaaaccctctgatgcctgtggcctgatccggtggctgttgatggtgaaccccacccgccgggccaccctggaggatgtggccagtcactggtgggtcaactggggctacgccacccgagtgggagagcaggaggctccgcatgagggtgggcaccctggcagtgactctgcccgcgcctccatggctgactggctccggcgttcctcccgccccctcctggagaatggggccaaggtgtgcagcttcttcaagcagcatgcacctggtgggggaagcaccacccctggcctggagcgccagcattcgctcaagaagtcccgcaaggagaatgacatggcccagtctctccacagtgacacggctgatgacactgcccatcgccctggcaagagcaacctcaagctgccaaagggcattctcaagaagaaggtgtcagcctctgcagaaggggtacaggaggaccctccggagctcagcccaatccctgcgagcccagggcaggctgcccccctgctccccaagaagggcattctcaagaagccccgacagcgcgagtctggctactactcctctcccgagcccagtgaatctggggagctcttggacgcaggcgacgtgtttgtgagtggggatcccaaggagcagaagcctccgcaagcttcagggctgctcctccatcgcaaaggcatcctcaaactcaatggcaagttctcccagacagccttggagctcgcggcccccaccaccttcggctccctggatgaactcgccccacctcgccccctggcccgggccagccgaccctcaggggctgtgagcgaggacagcatcctgtcctctgagtcctttgaccagctggacttgcctgaacggctcccagagcccccactgcggggctgtgtgtctgtggacaacctcacggggcttgaggagcccccctcagagggccctggaagctgcctgaggcgctggcggcaggatcctttgggggacagctgcttttccctgacagactgccaggaggtgacagcgacctaccgacaggcactgagggtctgctcaaagctcacctgagtggagtaggcattgccccagcccggtcaggctctcagatgcagctggttgcaccccgaggggagatgccttctcccccacctcccaggacctgcatcccagctcagaaggctgagagggtttgcagtggagccctgagcagggctggatatgggaagtaggcaaatgaaatgcgccaagggttcagtgtctgtcttcagccctgctgaacgaagaggatactaaagagaggggaacgggaatgcccgcgacagagtccacattgcctgtttcttgtgtacatgggggggccacagagacctggaaagagaactctcccagggcccatctcctgcatcccatgaatactctgtacacatggtgccttctaaggacagctccttccctactcattccctgcccaagtggggccagacctctttacacacacattcccgttcctaccaaccaccagaactggatggtggcacccctaatgtgcatgaggcatcctgggaatggtctggagtaacgcttcgttatttttatttttatttttatttatttatttatttttttgagacggagtttcgctcttggtgcccaggctagagtgcaatggcgcgatctcagctcacctcaacctccgcctcccgggttcaagcgattctcctgcctcagcctccctagtagctgggattacaggcgcccgccaccatgcccggctaattttgtatttttagtagagacagggtttctccatgttggtcaggctggtctcaaactcccgacctcaggtgatccacccacctcggcctcccaaagtgctgggattacaggcgtgagccaccgcgccccacctaacccttccttatttagcctaggagtaagagaacacaatctctgtttcttcaatggttctcttcccttttccatcctccaaacctggcctgagcctcctgaagttgctgctgtgaatctgaaagacttgaaaagcctccgcctgctgtgtggacttcatctcaaggggcccagcctcctctggactccaccttggacctcagtgactcagaacttctgcctctaagctgctctaaagtccagactatggatgtgttctctaggccttcaggactctagaatgtccatatttatttttatgttcttggctttgtgttttaggaaaagtgaatcttgctgttttcaataatgtgaatgctatgttctgggaaaatccactatgacatctaagttttgtgtacagagagatatttttgcaactatttccacctcctcccacaaccccccacactccactccacactcttgagtctctttacctaatggtctctacctaatggacctccgtggccaaaaagtaccattaaaaccagaaaggtgattggaagcag

SEQ ID NO: 5349 - DNA, 462 bp, Homo sapiens
atgtccaaagacctgaaaattctatgtaaagaccctgctttggagctgagctgctaccgggaccatcagttcagtggccgtaaatttcagcaggaaaaattactgaaggaaagctccacattgaatatggggaatctttccttttatacaaccgaagagaaaatacatgaactctttagtagatctgatatcaggaatatctttatgggcctggataaaataaagaaaacagcatgtggtttttgctttgtagaatgccataacagagctgatgctgaaaatgccatgcggtttctaactgggacctgcctagatgaatggattatctgcactgattgggatgtcggttttagagagggtcaacagtatggtcgcggtaaatctgggggtcaggtaagggatgagtttcgtgaagattttcattctggtagaggaggctttggaagacagactcagatctag

SEQ ID NO: 5350 - DNA, 1653 bp, Homo sapiens
atgcctaagacctgccaatgctatgttggtacaaagactacaaatcccagtgcctggccatcaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaatgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctcatga

SEQ ID NO: 5351 - DNA, 3280 bp, Homo sapiens
gaacttgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaagggatatatcattcagaaaagagaaataaaaccaagcttggaagcagataaaccagttgaagacatactgacgtatgaggaatttcatcctttcttgttttctcaacattcacaatgtccatatatagaatttgaatcatttgacaaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccagaaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaagtaagttaccattagttgacagaatggcttttgtgaattgttttgtaacgtctatttagtaacacatgtaattcctttttaaagatataaagtgaaacttactcctggagtgcagaaaaagggaaaaggtatttaaatttgtttttttgaattatgattttaaacagttcagtgacttaacagtagattattcttactcttttttgtatttacagctgcaaaaacagccttgaatagtttcatgcattccaaagaagcaacagcaagagaaaaagacttattccgcagcgt

SEQ ID NO: 5352 - DNA, 3995 bp, Homo sapiens
gaggagaagtggcgtcgagtccggccgggcagtagaggaacttgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaaggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaagatattgaaaaagtacttgtttctctgcagaaagcagaagactatatgaaaacaacatccaacttcagtgggaagggatatatcattcagaaaagagaaataaaaccaagcttggaagcagataaaccagttgaagacatactgacgtatgaggaatttcatcctttcttgttttctcaacattcacaatgtccatatatagaatttgaatcatttgacaaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaatgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctcatga

SEQ ID NO: 5353 - DNA, 3729 bp, Homo sapiens
ttgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaagatattgaaaaagtacttgtttctctgcagaaagcagaagactatatgaaaacaacatccaacttcagtgggaagggatatatcattcagaaaagagaaataaaaccaagcttggaagcagataaaccagttgaagacatactgacgtatgaggaatttcatcctttcttgttttctcaacattcacaatgtccatatatagaatttgaatcatttgacaaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaatgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgta

SEQ ID NO: 5354 - DNA, 2901 bp, Homo sapiens
ctctgccctcatgcgcatcctcacgcgctcccgcgtgctcaacgaggagcccctgacactggcgggcgaggagatcgtggcccagggcaagcgctcggacccgcggagcctgctgtgctatggcggcgccccagggcctggctgccacttctccatcccctaggctttcagcagggccccggctaacctcagtgacgtggtgcagctcatctttctggtggactccaatccctttccctttggctatatcagcaactacaccgtctccaccaaggtggcctcgatggcgttccagacacaggccggcgcccagatccccatcgagcggctggcctcagagcgcgccatcaccgtgaaggtgcccaacaactcggactgggctgcccggggccaccgcagctctgccaactccgttgtggtccagccccaggcctccgtcggtgctgtggtcaccctggacagcagcaaccctgcggccgtgctgcatctgcagctcaactatacgctgctggacggccgctacctgtctgaggaacccgagccctacctggcagtctacctgcactcggagccccggcccaatgagcacaactgctcggctagcaggaggatccgcccagagtccctccagggtgccgaccaccggccctacaccttcttcatttccccggggaccagagacccagtggggagttaccgtctgaacctctccagccacttccgcctgtcggcgctggaggtgtccgtgggcctgtacacgtccctgtgccagtacttcagcgaggaggacgtggtgtggcggacagaggggctgctgcccctggaggagacctcgccccgccaggccgtctgcctcacccgccacctcaccgccttcggcgccagcctcttcgtgcccccaagccatgtacgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccccttctgtgggcagcggggccgcttcaagtacgagtcctcgtcaagacaggctggggccggggctcaggtaccacggcccacgtgggcatcatgctgtatggggtggacagccggagcggccaccggcacctggatggcgacagagccttccaccgcaacagcctggacatcttccggatcgccaccccgcacagcctgggtagcgtgtggaagatccgagtgtggcacgacaaagggctcagccctgcctggttcctgcagcacgtcatcatcagggacctgcagacggcacacagcaccttcttcctggtcaatgactggctttcggtggagacggaggccaacgggggcctggtggagaaggaggtgctggccgcgagtcacgcagccctgttgcgcttccggcgcctgctggtggctgagctgcagtgcggcttctttgacaagcacatctggctctccatatgggaccggccgcctcgtagctgtttcactcgcatccagagggccacctgctgcgttctcctcatctgcctcttcctgggcgccaacgccgtgtggtacggggctgttggtgactctgcctacagcacggggcatgtgtccaggctgagcccgctgagcgtcgacacagtcgctgttggcctggtgtccagcgtggttgtctatcccgtctacctggccatcctctttctcttctggatgtcccggagcaaggtggctgggagcccgagccccacacctgccgggcagcaggtgctggacatcgacagctgcctggactcgtccgtgctggacagctccttcctcacgttctcaggcctccacgctgaggttatcaatactctggctgaccatcgtcatcgtgggactgactttggtggaagtccttggttacttatcattactgtgtttctgagaagttataaatttgccatctccctctgcacaacttacctttgggttatcaatactctggctgaccatcgtcatcgtgggactgactttggtggaagtccttggttacttatcattactgtgtttctgagaagttataaatttgccatctccctctgcacaacttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaggttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtcagaatggcggcagcggagcatcgtcattcttca

SEQ ID NO: 5355 - DNA, 1428 bp, Homo sapiens
atccggccccggtccccgtccccttccctcccccctgccctaagccacctccacctctgtcctggccgcctcagggcgccctgaaaggaccaggacatgcggctgcgcttttggctcctcatttggctcctgctgggatttatcagccatcagcccacccctgtcatcaatagtctggctgtctatcgtcatcgtgagactgactttggtgtaggagttcgagaccaccctggccaacatggcaaaaccccatctccacaaaaattggataatttgataattatcattattgggtttctgagacgtgacacatttaccattctcttctgcacaagttacctttgtgtgtctttcctgaagactatcttctggtctcgaaatggacatgatggatccacggatgtacagcagagagcctggaggtccaaccgcagtagacagaaagggctgaggtccatttgtatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaagcctctttgcaactgggtcagaatggcggcagcggagcatcgtcattcttcaggattgccctgctggccctacctcacagctgaagctttaaaaaacaggatgggccgccagccacctcctccaactcaacaacattctataactgataactccctgagcctcaagacacctcccgaatgtctccttcatccccttccaccctcagtggatgataatatcaaggagtgtcctcttgctcctcttccaccctcagtggatgataatctgaaggagtatctcctggtccctcttccaccctctcctcttccaccctcagtggatgataatctgaaggactgtctctttgtccctcttccaccctctcctcttccaccctcagtggatgataatctcaagactcctcccttagctactcaggaggccgaggcggaaaaaccacccaaacccaagaggtggagggtggatgaggtggaacaatcaccgaaacccaagaggcggagggcggatgaggtggaacaatcgcccaagcccaagaggcagagggaggccgaggcacaacaattacccaaacccaagaggcggaggttgagtaagctgagaacacgccattgcactcaagcctgggcaataagaataaatccgtgggtcgaaaaaaagaaaaaaatcaaaaaacaaaacaaaacccacgctccaaaaacaaactaa

SEQ ID NO: 5356 - DNA, 2171 bp, Homo sapiens
attggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctactcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccttccaccctcagcggatgatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgctgagcgtctgcgggggccgcttccaccctgagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagt

SEQ ID NO: 5357 - DNA, 3470 bp, Homo sapiens
atcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctactcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtccgctcccaccctcagctccaccctcagcagatgataatatcaagacacctgccgagcgtctgcgggggccgcttccaccctcagcggatgataatctcaagacaccttccgagcgtcatatcatgcccttcccctcagcagatgataatatcaatacacctgccgagcgtcttcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccttccaccctcagcggatgatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgctgagcgtctgcgggggccgcttccaccctgagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaat

SEQ ID NO: 5358 - DNA, 2587 bp, Homo sapiens
aggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtctactcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacaccttccgagcgtcagctcactccccttccaccctcagctccaccctcagcagatgataatatcaagacacctgctgagcgtctgcgggggccgcttccaccctgagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctga

SEQ ID NO: 5359 - DNA, 3501 bp, Homo sapiens
cggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctactcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcgtactccccttccaccctcagctccaccctcagcagatgataatatcaagacacctgccgagcgtctgcgggggccgcttccaccctcagcggatgataatctcaagacaccttccgagcgtcatatcatgcccccaccctcagcagatgataatatcaatacacctgccgagcgtcttcgggggccgcttccaccctcagcggatgataatctcaagacaccttccgagcgtcagctcactccccttccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctggcttccaccctgagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctga

SEQ ID NO: 5360 - DNA, 1342 bp, Homo sapiens
aaacattccctcctttggccctacaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctactcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagt

SEQ ID NO: 5361 - DNA, 758 bp, Homo sapiens
gaaggtgacaacaaaagtcaaccgtcatgacaaaatcaatggaaagaggaagaccgccaaagaacatctgaggaaactaagcatgaaagaacgtgagcacagagaagaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataat

SEQ ID NO: 5362 - DNA, 984 bp, Homo sapiens
cacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacagagaagaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaactgtgttgcgcaaaaacaccttcatccccacccagtggggcccccatctaatattctaagtgtcagaggttccgtatttgtaatagcaaatgggccctgactgtaaattagtgaagagtgaatgtaacttattacccacagggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcag

SEQ ID NO: 5363 - DNA, 1298 bp, Homo sapiens
agaccgaagaaggtttggcagatagcagaacctttttgtctccctctcattgctcctaagcctcacgctcccttgtcccgcgtgtcctgttgcttccctgatcttctccgtgacctgtagctaaaccttccaccagcgcttgagaacttaatttgaaccggatcctttcccagacccctttcttcttctcctcctcctcctccacctcctccagggcgccctgaaaggaccaggacatgcggctgcgcttttggctcctcatttggctcctgctgggatttatcagccatcagcccacccctgtgtctttcctgaagactatcttctggtctcgaaatggacatgatggatccatggatgtacagcagagagcctggaggtccaaccgcagtagacagaaagggctgaggtccatttgtatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaagcctctttgcaactgggtcagaatggcggcagcggagcatcgtcattcttcaggattgccctactggctctacctcacagctgaaactttaaaaaacaggatgggccgccagccacctcctccaactcaacaacattctataactgataactccctgagcctcaagacacctcctgagtgtctgctcactccccttccaccctcagtggatgataatatcaaggagtgtcctcttgctcctcttccaccctctcctcttccaccctcagtggatgataatctgaaggaatgtctctttgtcccgcttccaccctctcctcttccaccctcagtggatgataatctgaaggaatgtctctttgtcccgcttccaccctctcctcttccaccctcagtggatgataatctcaagactcctcccttagctactcaggaggccgaggtggaaaaaccacccaaacccaagaggtggagggtggatgaggtggaacaatcgcccaagcccaagaggcagagggaggccgaggcacaacaattacccaaacccaagaggcggaggttgagtaagctgagaacacgccattgcactcaagcctgggcaataagaataaatccgtag

SEQ ID NO: 5364 - DNA, 603 bp, Homo sapiens
atcggaactcgaggcggggctgctgggtcttccaggagcgcccagacgcgggcaggtggccgccggtggccacaggcctgggcaggatggaagcgcccgcagagcgggcgcttccacgtctgcaggctctggctcggccgccgccacccataagctacgaggaggagctttacgactgcctggactactactacctgcgcgacttcccggcctgcggggcagggcgcagcaagggccggactcggcgcgagcaggcgctgcgcaccaactggcctgcacctggcgggcacgagcgcaaggtcgcgcagaagctcctcaatggccagcgcaagcgccgccagcgccagctgcatcccaagatgcgcactcgcctcacctgagcctgggataccgaaggacctgttcgaagtatttactgtaactccaactgtaacttggttctgaggaggagagaatccatgtttggtcaacagaacttttcgctgtcacttaagtttactgcttcgatatcttttccttactaattgattgttaattaagtagtgcccaagtggattagcctttttagagtttattaattaaaagagagcagcaagaatggca

SEQ ID NO: 5365 - DNA, 3431 bp, Homo sapiens
ggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 5366 - DNA, 3575 bp, Homo sapiens
attgattcaattttacactgtgccaggcattgtggcattccacacaaatggtgagaagctaaaagtgagaaatttggcacaggtgaagaaggctgggtaacacatttgaaagactgctaaacaggtcttgcatgactggcctaagtgcaaagtgaagcagcccatcacgctccagctctccaaatcggagccggcatttcacccatgtgatacaggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcc

SEQ ID NO: 5367 - DNA, 3487 bp, Homo sapiens
ctggagttgccgtgtgacgcgtgggcgggacgaggcccgggctcggggacctttcgcactcgggtcaggggtaaagcagcctgtcgcttgccgggcagctggtgagtcggtgacctggcctgtgaggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 5368 - DNA, 1501 bp, Homo sapiens
ctggggtgcggggaaaaggcgcagtctcggtgggattgcgtgcaggagggtcgtggtctggctgtggcggaggagcataagaagactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggaga

SEQ ID NO: 5369 - DNA, 1480 bp, Homo sapiens
cctgcttgtgctcagctccagctcactggctggccaccgagacttctggacaggaaactgcaccatcctcttctcccagcaagggggctccagagactgcccacccaggaagtctggtggcctggggatttggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagg

SEQ ID NO: 5370 - DNA, 1330 bp, Homo sapiens
tgcaggagggtcgtggtctggctgtggcggaggagcataagaaggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaag

SEQ ID NO: 5371 - DNA, 802 bp, Homo sapiens
ggaaaaggcgcagtctcggtgggattgcgtgcaggagggtcgtggtctggctgtggcggaggagcataagaaggactccagattcaattatttatatatacttcaggatttaaactttgcttccagagttgtcatggaggaggccaagaagcaaatagagacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatc

SEQ ID NO: 5372 - DNA, 440 bp, Homo sapiens
tttccccaaattgctacttctctggggctccaggtcctgcttgtgctcagctccagctcactggctggccaccgagacttctggacaggaaactgcaccatcctcttctcccagcaagggggctccagagactgcccacccaggaagtctggtggcctggggatttggtgggtctgctccttagcagtggcctggggctctgttgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcacca

SEQ ID NO: 5373 - DNA, 1637 bp, Homo sapiens
ctttccccaaattgctacttctctggggctccaggtcctgcttgtgctcagctccagctcactggctggccaccgagacttctggacaggaaactgcaccatcctcttctcccagcaagggggctccagagactgcccacccaggaagtctggtggcctggggatttggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggc

SEQ ID NO: 5374 - DNA, 784 bp, Homo sapiens
tccgggccgtgctgggacctttgctccacgaggtcctgcttgtgctcagctccagctcactggctggccaccgagacttctggacaggaaactgcaccatcctcttctcccagcaagggggctccagagactgcccacccaggaagtctggtggcctggggatttggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccc

SEQ ID NO: 5375 - DNA, 825 bp, Homo sapiens
gggaggcagtccttttgcaagagctgctaagagcgctgggtcctgcttgtgctcagctccagctcactggctggccaccgagacttctggacaggaaactgcaccatcctcttctcccagcaagggggctccagagactgcccacccaggaagtctggtggcctggggatttggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccag

SEQ ID NO: 5376 - DNA, 552 bp, Homo sapiens
tttgctccacgaggtgcctatggaggggagggaacacgattctggaggctgctgggattggggtgggggttcctgggaggcagtccttttgcaagagctgctaagagcgctgggtcctgcttgtgctcagctccagctcactggctggccaccgagacttctggacaggaaactgcaccatcctcttctcccagcaagggggctccagagactgcccacccaggaagtctggtggcctggggatttggtgggtctgctccttagcagtggcctggggctctgtgacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacag

SEQ ID NO: 5377 - DNA, 2731 bp, Homo sapiens
cttctctggggctccaggtcctgcttgtgctcagctccagctcactggctggccaccgagacttctggacaggaaactgcaccatcctcttctcccagcaagggggctccagagactgcccacccaggaagtctggtggcctggggatttggtgggtctgctccttagcagtggcctggggctctgtgtgtgtatctggggtggggtcggggaatgtcctaaggatctgagaagggggtttctggggagaagtgaggggtgatggtgatggaagcttgggacaggagcaggactctgggtcccagaataactcatgaggggctcaggggaggaggtcctctatgtgaattggggagattcttggagacaggtttgtgctgggaccctggaaagtggcacgagcgaggttctctaataagcagcgtgtttcactgggtggagtgagctgtcctcagtgttggagtgagggggaaggggcccaagagaagcagggcagatgcacccaaacattccctgctggcctggaggggactttgggggagaaaagccggcacggtggctgggagcccagactttggagtcagaggagggttggagtcttgactctaccgccgcctaactgtgtgaccatagttacttaatctctttgaacctcagtttgcttatctgtaaaatgagtttaagaatagtcctgagccaggagcagtagcgtgcgcccataatctcagatactcaggaagctgaaacctgattgcttcagcccagtagtttgaggcgatagtgtcctattattgcacctgtgaatagcactgagttccagcctgggcaacatagagagaccccatctcaaaaaaaaaattaatagttttgacctcagagggatattatgaggaaagcacataaagccttataacaggctgggcgcagtggcttactccaataatccccacactttgggaggcccaggtgagaggatcacttgagcccaggaattcctagactagcctgggcaaaatagggagaacctgtctctaaaaaacataatagtaatataataaagccttagtacaggctaatatatggcaagtaaatgttagctgatattgttgatattgataaaagggaggatcaggtggagaagggagctgaggccagaaaggagcccagttctagaagagtataatctgggtccttcctgcaggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 5378 - DNA, 2400 bp, Homo sapiens
aattgaagtcctctccccactgctttgagaaggaaccgttaagacgctgggccccacccacaagattgcgtcttgtttgtggcaagattctgaggggaagtgtagctcccaggttggttccaagtcttcttccaattaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacacactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggaaaggatgctctgcttttctgtcaatggggttttcaaggaagtggaaggacagtctcagggttctgttctcgccttcacccggaccttcattgctacccctggcagcagttccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgccttcaggacaatgagtggaactacactagagctggccaggccttcactatgctccagaccgagggcaagatccccgcggaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgttgt

SEQ ID NO: 5379 - DNA, 2400 bp, Homo sapiens; identical to SEQ ID NO: 5378

SEQ ID NO: 5380 - DNA, 805 bp, Homo sapiens
aggagtgtgggcggggcgcagttgggggagggtgcagagacctgagggcttgaggttgcctggctggccccgctcccagaggcgggtgccgcgctgtcgcccaggtatctggggtctctggtgtctgagtgtctcattgtcggcgcgaacacaattgctccagccacaggcgaggcctggccaaggtgtgggcgcatctggggcaggtcttgagaggtccagcgcccggtggtgcggacagaggcggggcaccgcggcgctcgccgccgcctccccgcaggtgatcatcctcctgcaggtgtcctcgggtctcaggtggctgcgtgtctgcgccatggttgacattctgggcgagcggcacctggtgacctgtaagggcgcgacggtggaggccgaggcggcgctgcagaacaaggtggtggcactgtacttcgcggcggcccggtgcgcgccgagccgcgacttcacgccgctgctctgcgacttctatacggcgctggtggccgaggcgcggcggcccgcgcccttcgaagtggtcttcgtgtcagccgacggcagctcccaggagatgctggacttcatgcgcgagctgcatggcgcctggctggcgctgcccttccacgacccctaccggcatgagctgaggaagaggtacaacgtcacagccatccccaagcttgtgattgtgaaacaaaatggggaggtcatcaccaacaaagggcggaagcagatccgggaacgggggttggcctgcttccaggactgggtggaggcggccgatatcttccagaatttctccgtttga

SEQ ID NO: 5381 - DNA, 1457 bp, Homo sapiens
gtgtgggcggggcgcagttgggggagggtgcagagacctgagggcttgaggttgcctggctggccccgctcccagaggcgggtgccgcgctgtcgcccaggtatctggggtctctggtgtctgagtgtctcattgtcggcgcgaacacaattgctccagccacaggcgaggcctggccaaggtgtgggcgcatctggggcaggtcttgagaggtccagcgcccggtggtgcggacagaggcggggcaccgcggcgctcgccgccgcctccccgcaggtgatcatcctcctgcaggtgtcctcgggtctcaggtggctgcgtgtctgcgccatggttgacattctgggcgagcggcacctggtgacctgtaagggcgcgacggtggaggccgaggcggcgctgcagaacaaggtggtggcactgtacttcgcggcggcccggtgcgcgccgagccgcgacttcacgccgctgctctgcgacttctatacggcgctggtggccgaggcgcggcggcccgcgcccttcgaagtggtcttcgtgtcagccgacggcagctcccaggagatgctggacttcatgcgcgagctgcatggcgcctggctggcgctgcccttccacgacccctaccggcaacggagtctcgctctgttgcccaggctggagtgcagtggcgtgatcttagctcactgcaacctttgcctcctgggttcaagtgattctctagccttagcctcctgagcatctgggactacagccattgctgtgaattacgtgagggaaagatattgaagaggagttggacactccgagagtgcagctgttctccccccgcaccatccgtgtcctgcattctgcgagtctgtgctcattaacaatgtgctgtgaccatgtgactcagcaatcctgctgctgggtatatacccgaaagaaaggaaaaggaagccagtatattgaagaggtatctgcacccccatgtttattgcagcactgttcacaacagccaagatttggaagcaacctaagtgtccatcaacagatgaatggataaagaaaacgtggtacatatacacaatggagtactcttcagccattaaaaaaatgagattctgtcatttgcaataatatagatggaaaaggaggcccttatgtgaagtgaaataagccaggcacagaaagacaaacatcacatgttctcacttatttgtgggatctaatgatcaaaacaattgaactcttggacatagagagtagaaggttggttaccagaagctggaaaggaaagtggggttgggaggaaggtgggaatggttaataggtacaaaaaaatacaaagaataaataagacctaatatttgatagcacaacagtgtgactactgtcaataatcatttaattgtacatttaaaaataactataattgcattgtttgtaacacaaaagataaatgcttgagggga

SEQ ID NO: 5382 - DNA, 1762 bp, Homo sapiens
ggacctgacctgaattgcgaccccaacctggactgctcccctgaccgcaacccctacccccgcccaccagtatggcccggcacgtgttcctaacggggcccccaggagttggaaaaacaacattgatccataaagccagtgaggttttaaaatcctctggtgtgcctgttgatggattttataccgaagaagtcagacagggagggagaagaataggattcgatgtcgtcacgttgtccggcacccgggggcctttatcgagagttgggttagagcctccacctggaaaacgtgaatgccgagttgggcagtatgtggtcgacctgacttcttttgagcagttggcactacccgtcttgaggaatgccgactgcagcagtggcccagggcaaagagtgtgcgtcatcgatgagattgggaagatggagctcttcagtcagcttttcattcaagctgttcgtcagacgctgtctaccccagggactataatccttggcacaatcccagttcctaaaggaaagccactggctcttgtagaagaaatcagaaacagaaaggatgtgaaggtgtttaattcaccgtactgtgtcatagaagaccagagcaaattctccagctgtgtatcacagtccactctcacagagcctggctggaggcagaagctactgcaatcactgctgaactcagagtggaagaaaagggcccctgtggtgcccacctctgtgtcgcctcctttctacctcaggtggattccttgaatgcaaacaacaggaatggactttggctaacttaagtgaaaacagcatcaaaaagccttataggctttggagctgtcccatgaagccaaaggaaaagctgactgtcctcatttcaagtggagccacagccgcccaggattgacgcagccaggaccagtagaaatgggatcacaggattgacgcagccaggaccggtagaaatgggatcacgggactgacgcagccaggaccagtagaaatgggatcacgggattgacgcagccaggaccagtagaaatgggatcagcttctggcacttgctgcgtgagctcactcctcttggggtgcagatctcagtcactcctcttggggtacagatctcagagaagttgccagggcctggcttgcccacttgttggctgggggcaagtttcctagaccgtacagtctcctaaagacaaccagagcactcttccaagaagggtgagcaggtgccaggaaccagaattgacgaggtccgctctgcatctcctcttcagacatgtattggcacctattgtatgccaggccccctcttcagatacaaccaccctgaacctcagaaggcttccacatgcactccctgctcttaccgggaaccttggctcagccccttttccatggttcacctgtcgaaattacatccaggcttaagcacccctggaagcctttcctgcccctgaccccacacatgcccctgttcctgcctgccccccagactccttcattgtccttgttcatgcctgtcctgtcctggtctgcgagctccatgaggtcagggtccttacctgtggtgcttctctatgcgcatctctgtgcctggctcctgtttgcccttccaccccatcagcgtgtgttgagtggatggatattatatgggccaagtaggaaggcactgtgatgggagcagagatggcccttcctttaccctggggcactcgggatggtgtggtagtgaaagaaaaataaacagatcatcgggtaaa

SEQ ID NO: 5383 - DNA, 1231 bp, Homo sapiens
gtcgcgaccctggtccggacctgacctgaattgcgaccccaacctggactgctcccctgaccgcaacccctacccccgcccaccagtatggcccggcacgtgttcctaacggggcccccaggagttggaaaaacaacattgatccataaagccagtgaggttttaaaatcctctggtgtgcctgttgatggattttataccgaagaagtcagacagggagggagaagaataggattcgatgtcgtcacgttgtccggcacccgggggcctttatcgagagttgggttagagcctccacctggaaaacgtgaatgccgagttgggcagtatgtggtcgacctgacttcttttgagcagttggcactacccgtcttgaggaatgccgactgcagcagtggcccagggcaaagagtgtgcgtcatcgatgagattgggaagatggagctcttcagtcagcttttcattcaagctgttcgtcagacgctgtctaccccagggactataatccttggcacaatcccagttcctaaaggaaagccactggctcttgtagaagaaatcagaaacagaaaggatgtgaaggtgtttaatgtcaccaaggaaaacagaaaccaccttctgccagatatcgtgacgtgcgtgcagagcagcaggaagtgaagacacgtgcattcctgccttccgtgaaggagtgcccagttcaagaggagcctgatggagccctgcctgtcgaggctgtatgcctatggggttatggaaccttgtgggcttttctagagaaaactcaacagctgtttcccataaaatgtttaaaagatcaaattagccttaatgctggattgtctgtacaagattaactatccattgtggcttatctatgcttaaagatttcttgtttatttcctcttgcagtcatgcacatgatttgggtaaactgtgagatgagaaatggttttcagagtattagatggaattcacccccgttgaagtttataaatgtgttcaggggaagcgggaggaaagagttcactgcctaatcagttttgcatgtcatgaaaattaaattcctctccaggtgcagcttcagcctcatgcaacttaaagtgataacagttatttgattttttaaaaaatattattccaaaagaaaaccattttaggtcatctcccccaactctgtttgcttactgcttaataaatataaaaataaatctgatggttacagacagga

SEQ ID NO: 5384 - DNA, 2044 bp, Homo sapiens
ctccttttgccatggcagctagtggggaaagccctttagcccgctactcttgccttccacggcttccgccaccccaggccagcttccacagcagctgtagctgcttcgttccgcctccgtcttagcacccccaggtgccggcggcccgggccaagccatcgcctacagttcggtgagtgtttccctgccaaaaagctaatgatggaagggctcggagaacacagcacagccggtgaaatgggcccattactcggcgctgtggcagccacagcctctccgcagtctttgatggagtactcctcagacgcagattttattgagagcctgcctctggtggttaagtaccgagtgtacactctcaaaaagcttcaggccaaatgtgccgtgctagaggccaagtacctgagggaatttcattctgtcgagaggaagtttgccaccatctatggacccttattggaaaagagacggcagatcaccaatgcactgtatgagcccacgaaagaggagtgtgagaggtgaagtccaaggttgaggactatgagtataatgaggtggccggtgattctaatgctcagatgtatggtgcagaggagaatccggagtatgaggacttggtggaggatcgtgaggaggatttcgaggatgtcggggaggtgtttggggagtatgaaggaatcgagggacataatgtggacggagaaaaagataatcctacagggatccccgatttctggctcacggctttatagaatgcccaggaggttgccccgctgattaagaaatatgacgaggccaggcgcagtggctcacgcctgtaatcccagcactttgggaggccgaggcaggtggatcacaagttcaggaaatcgagaccatcctggctaacacagtgaaaccccgtctctactaaaaatacaaaaaaaaaaaaaaaaaaaattagccgggggtggtggcacacacctatagtcccagctgcccaggaggctgaggcaggagaatcgcttgaacccaagaggcagaggttgcagtgaactgagatcgcaccactgcactccagcctgggcgacagagcgatattccgaaaaaacgaaacaacaacaacaaaaatatgacgagcccattctgaagctcttgcaagacgtgaaagtcaagttttcaaaatcaaactagccactcacttttacgctggaatttcactctgaacccaacgactacttcacaaatgaggtgctgaccgaaagaaacatacatcctcaagtctaagctcgattagtctgacccccaccccttcaggggatctgcggtagagcgttgctttggcagcatgatagaatggaagaagggaaagaacgtcactgtgcaaacggtcctgaagagagacacagtttttgggggctgatgtgtaccgccactcaggaatttccccaagagtcccttcttcaatgctctccagtggggcctagatgctaatgaggatgaggaagacttcttcatcgctcacaccttgcacacttttgtcatcccaagagctgtgttacactttacaggagaagcccttgaggcagagcaagatacgatgatcagggaatgtaataatccggtttatgacagaatgactcaggagaattgggtgactgcagtttatggtgctaaaggccaaaaccgaaactcccaggcagaagtcaatgattgttgaagcagaatggttggagtatgtgggcctccaggttaacaactggcttttacaataaccaaaacttaatcattcgttacttacagtcttaacgtgtctcttcttggtagtctcagtttaaaattatgtccaaatatatttaacaatgcatttcatctagcactccagtggtgtaaactttgtcaacaattttattaggcagtgaattctcaacgtatgtgaagaccttactattgtgaatccatggcttttgtcaggttgctactagtctgcatctatggaaaattaccagaacttgtaactaagatctatgtttgggtttgtaaaataaagtgagatagcatcctt

SEQ ID NO: 5385 - DNA, 3110 bp, Homo sapiens
gccggagccgggagtcgtggcccggagtgggccttggagtcggcgcgcaggcggctcgcggttgtgaaatgtgctcgcaggaggcttttcaggcacagaggagccagctggtcgagctgctggtctcagggtccctggaaggcttcgagagtgtcctggactggctgctgtcctgggaggtcctctcctgggaggactacgagggcttccacctcctgggccagcctctctcccacttggccaggcgccttctggacaccgtctggaataagggtacttgggcctgtcagaagctcatcgcggctgcccaagaagcccaggccgacagccagtcccccaagctgcatggctgctgggacccccactcgctccacccagcccgagacctgcagagtcaccggccagccattgtcaggaggctccacagccatgtggagaacatgctggacctggcatgggagcggggtttcgtcagccagtatgaatgtgatgaaatcaggttgccgatcttcacaccgtcccagagggcaagaaggctgcttgatcttgccacggtgaaagcgaatggattggctgccttccttctacaacatgttcaggaattaccagtcccattggccctgcctttggaagctgccacatgcaagaagtatatggccaagctgaggaccacggtgtctgctcagtctcgcttcctcagtacctatgatggagcagagacgctctgcctggaggacatatacacagagaatgtcctggaggtctgggcagatgtgggcatggctggacccccgcagaagagcccagccaccctgggcctggaggagctcttcagcacccctggccacctcaatgacgatgcggacactgtgctggtggtgggtgaggcgggcagtggcaagagcacgctcctgcagcggctgcacttgctgtgggctgcagggcaagacttccaggaatttctctttgtcttcccattcagctgccggcagctgcagtgcatggccaaaccactctctgtgcggactctactctttgagcactgctgttggcctgatgttggtcaagaagacatcttccagttactccttgaccaccctgaccgtgtcctgttaacctttgatggctttgacgagttcaagttcaggttcacggatcgtgaacgccactgctccccgaccgaccccacctctgtccagaccctgctcttcaaccttctgcagggcaacctgctgaagaatgcccgcaaggtggtgaccagccgtccggccgctgtgtcggcgttcctcaggaagtacatccgcaccgagttcaacctcaagggcttctctgaacagggcatcgagctgtacctgaggaagcgccatcatgagcccggggtggcggaccgcctcatccgcctgctccaagagacctcagccctgcacggtttgtgccacctgcctgtcttctcatggatggtgtccaaatgccaccaggaactgttgctgcaggagggggggtccccaaagaccactacagatatgtacctgctgattctgcagcattttctgctgcatgccacccccccagactcagcttcccaaggtctgggacccagtcttcttcggggccgcctccccaccctcctgcacctgggcagactggctctgtggggcctgggcatgtgctgctacgtgttctcagcccagcagctccaggcagcacaggtcagccctgatgacatttctcttggcttcctggtgcgtgccaaaggtgtcgtgccagggagtacggcgcccctggaattccttcacatcactttccagtgcttctttgccgcgttctacctggcactcagtgctgatgtgccaccagctttgctcagacacctcttcaattgtggcaggccaggcaactcaccaatggccaggctcctgcccacgatgtgcatccaggcctcggagggaaaggacagcagcgtggcagctttgctgcagaaggccgagccgcacaaccttcagatcacagcagccttcctggcagggctgttgtcccgggagcactggggcctgctggctgagtgccagacatctgagaaggccctgctccggcgccaggcctgtgcccgctggtgtctggcccgcagcctccgcaagcacttccactccatcccgccagctgcaccgggtgaggccaagagcgtgcatgccatgcccgggttcatctggctcatccggagcctgtacgagatgcaggaggagcggctggctcggaaggctgcacgtggcctgaatgttgggcacctcaagttgacattttgcagtgtgggccccactgagtgtgctgccctggcctttgtgctgcagcacctccggcggcccgtggccctgcagctggactacaactctgtgggtgacattggcgtggagcagctgctgccttgccttggtgtctgcaaggctctgtatttgcgcgataacaatatctcagaccgaggcatctgcaagctcattgaatgtgctcttcactgcgagcaattgcagaagttagctctattcaacaacaaattgactgacggctgtgcacactccatggctaagctccttgcatgcaggcagaacttcttggcattgaggctggggaataactacatcactgccgcgggagcccaagtgctggccgaggggctccgaggcaacacctccttgcagttcctgggattctggggcaacagagtgggtgacgagggggcccaggccctggctgaagccttgggtgatcaccagagcttgaggtggctcagcctggtggggaacaacattggcagtgtgggtgcccaagccttggcactgatgctggcaaagaacgtcatgctagaagaactctgcctggaggagaaccatctccaggatgaaggtgtatgttctctcgcagaaggactgaagaaaaattcaagtttgaaaatcctgaagttgtccaataactgcatcacctacctaggggcagaagccctcctgcaggcccttgaaaggaatgacaccatcctggaagtctggctccgagggaacactttctctctagaggaggttgacaagctcggctgcagggacaccagactcttgctttga

SEQ ID NO: 5386 - DNA, 624 bp, Homo sapiens
ggagtgggccttggagtcggcgcgcaggcggctcgcgcaaggaagtgatcctttctctacatgggcctcaccttggggaggacaatggtgtctttgaagttgtagtaactgaagtagagatcaaaaggcaatgcagatagactgacagatttcgcctgaagaggggaagcccgaccaggttgtgaaatgtgctcgcaggaggcttttcaggcacagaggagccagctggtcgagctgctggtctcagggtccctggaaggcttcgagagtgtcctggactggctgctgtcctgggaggtcctctcctgggaggactacgagggcttccacctcctgggccagcctctctcccacttggccaggcgccttctggacaccgtctggaataagggtacttgggcctgtcagaagctcatcgcggctgcccaagaagcccaggccgacagccagtcccccaagctgcatggctgctgggacccccactcgctccacccagcccgagacctgcagagtcaccggccagccattgtcaggaggctccacagccatgtggagaacatgctggacctggcatgggagcggggtttcgtcagccagtatgaatgtgatgaaatcaggttgccg

SEQ ID NO: 5387 - DNA, 4217 bp, Homo sapiens
cggacttagaccctcagtagctcgggcacctaagcacacagaaagctagaacacgcatttccggggcggggtctcgccaccctgcctataatgtgagaatttaaccagcgcgggccgcctcctggttgctagggcctctgggtaacagagttcagaccttgccgtcgcgcgcgcgttaagtaccaggagaactacatagcccagcatgcaacagtctcaactttttcacggacactacatttcccagaaggcagttcgcaccgcagtgttttctgggatgggaaccacgccgcttcccagtctctgtgcgaggcgtgaagcgcggacctttcaacaagggctttattaattctcacgctgcggccctggaaagcgatggaggtggcggctaattgctccctacgggtgaagagacctctgttggatccccgcttcgagggttacaagctctctcttgagccgctgccttgttaccagctggagcttgacgcagctgtggcagaggtaaaacttcgagatgatcaatatacactggaacacatgcatgcttttggaatgtataattacctgcactgtgattcatggtatcaagacagtgtctactatattgatacccttggaagaattatgaatttaacagtaatgctggacactgccttaggaaaaccacgagaggtgtttcgacttcctacagatttgacagcatgtgacaaccgtctttgtgcatctatccatttctcatcttctacctgggttaccttgtcagatggaactggaagattgtatgtcattggaacaggtgaacgtggaaatagcgcttctgaaaaatgggagattatgtttaatgaagaacttggggatccttttattataattcacagtatctcactgctaaatgctgaagaacattctatagctaccctacttcttcgaatagagaaagaggaattggatatgaaaggaagtggtttctatgtttctctggagtgggtcactatcagtaagaaaaatcaagataataaaaaatatgaaattattaagcgtgatattctccgtggaaagtcagtgccacattatgctgctattgagcctgatggaaatggtctaatgattgtatcctacaagtctttaacatttgttcaggctggtcaagatcttgaagaaaatatggatgaagacatatcagagaaaatcaaagaacctctgtattactggcaacagactgaagatgatttgacagtaaccatacggcttccagaagacagtactaaggaggacattcaaatacagtttttgcctgatcacatcaacattgtactgaaggatcaccagtttttagaaggaaaactctattcatctattgatcatgaaagcagtacatggataattaaagagagtaatagcttggagatttccttgattaagaagaatgaaggactgacctggccagagctagtaattggagataaacaaggggaacttataagagattcagcccagtgtgctgcaatagctgaacgtttgatgcatttgacctctgaagaactgaatccaaatccagataaagaaaaaccaccttgcaatgctcaagagttagaagaatgtgatattttctttgaagagagctccagtttatgcagatttgatggcaatacattaaaaactactcatgtggtgaatcttggaagcaaccagtaccttttctctgtcatagtggatcctaaagaaatgccctgcttctgtttgcgccatgatgttgatgccctactctggcaaccacactccagcaaacaagatgatatgtgggagcacatcgcaactttcaatgctttaggctatgtccaagcatcaaagagagacaaaaaattttttgcctgtgctccaaattactcgtatgcagccctttgtgagtgccttcgtcgagtattcatctatcgtcagcctgctcccatgtccactgtactttacaacagaaaggaaggcaggcaagtaggacaggttgctaagcagcaagtagcaagcctagaaaccaatgatcctattttaggatttcaggcaacaaatgagagattatttgttcttactaccaaaaacctctttttaataaaagtaaatacagagaattaattattctaacatattggcctctttgtactggaaaagtattcagtggtacctggaggtctggacagttatactgtaacctcttaagttttaatgtgctaaatatatcttgtatgattttttattttttaataacattggaaatatattcaagagattatgattctgtaaagctgtggaatgaagctgcagatttagagaacattggcttctgaaaaaaaaaaagagtgaagatagtactagcaagtatacttattttttaaaacaggctagaatctcatgttttatatgaaagatgtacaattcagtgtttaaaaataaaaatatttattgtgtactctgttcgttgattagttgctacaggctgtacctataagatgtacaggataatagttaaatgttgagtattgtacatatgtatttaagtggattgaataactgagtctacatggaggaggaaatgctagagaacagcaggtctaatattttttaagtttactgagagacctttattattattttcaaattaagtatagctttatgtaacttttagccagttgctctgccacagacatagacaaagagagataagatttcacattatccatcactgcataacaaaccacaccaaaactcagtggtttaaaacaaggacttttattatttttcacgattcagtgagttggctgtctctgctgtacagggcctctcagcctccagtagactagacgaatcttctttccatagtagagaaaacatcttaagagagcaagctccaatatgcaagagcttatcgatcctgtacatctatcatatttactaatgttccattggacaaagcaaatcacatggccaagtctagagtcagaatgaggggactacacaagctgacagcggatggtatgactcattgggggccattgatggaacaatcttaccacacaaggacaaattataatttatccttgtggctctctttatttttctaacaacttcaacaaaataatcctgtttatatgttatagtttcttgccacaaattttgttttttcaaacttacctttccaggtttgttttagtatgtatgtacctggaaatttttattactttttataccatttcaagatatgtatcttatataaacctcaagttggattttatattttaataaggaagttaagaccttcatttaagaggcagaagattaagataagaaatataagatagaaaagctttgttcctaacatatcttttgcctgtctgggcaagtatttgactcaactaaattttaatgaacgaatgaatgacagagaggaggaaaaaagatgaggattgcatacatgttctaaaccctttgtcagattgcagtttcctagagagtattgaggtgctaggtagaaagttaggaaaggtcctgaggactggtattgacaattggagtcctaatagtactctattcgtattaggaaagagagactagataccaaacatcacgagatcatagagatggaaaactgtatagtaaccaaaaaccaaaacagtgatatttccagaactttttagtattgttgtaaaacttcatgaaacaaaagaccatttaaatagtgaattattaaaaatctttatgatgggaaagtagatctaaattttctctaaaattttccccaaagataatatcctcttagggaacataagaaaaatgtataataaaaatgtggtgcttaattaaccatgactatgtatatattgccaattttagtaatcaatattctttgtgcatgtgatttttttgcatgattaatgttgaattgaaagctctcaggataattaatcctaaatattgtcgcatgttgacctacgttaaaagatgaataggtctagagccgtgatttcaagctattttcctgaaatgcttcagggattccataaacatttaaacaatgttctaaggtacatatacttagaacattgagatatatactacaagtgctaagaatatagtaccttgtatttttgttgatttttatcatgttttaaataggaatttataaaatatttatgatagtaataaagtagtattttatgtgttttgca

SEQ ID NO: 5388 - DNA, 2098 bp, Homo sapiens
agtacttcatagactttatcatacttcgtagcatccagtatgttttctttgctaagattattgattttgtattgaagggtcccatgtccatcgttttcaatgctttatctccagggttggagcatgcctgctgtggcagaggtaaaacttcgagatgatcaatatacactggaacacatgcatgcttttggaatgtataattacctgcactgtgattcatggtatcaagacagtgtctactatattgatacccttggaagaattatgaatttaacagtaatgctggacactgccttaggaaaaccacgagaggtgtttcgacttcctacagatttgacagcatgtgacaaccgtctttgtgcatctatccatttctcatcttctacctgggttaccttgtcagatggaactggaagattgtatgtcattggaacaggtgaacgtggaaatagcgcttctgaaaaatgggagattatgtttaatgaagaacttggggatccttttattataattcacagtatctcactgctaaatgctgaagaacattctatagctaccctacttcttcgaatagagaaagaggaattggatatgaaaggaagtggtttctatgtttctctggagtgggtcactatcagtaagaaaaatcaagataataaaaaatatgaaattattaagcgtgatattctccgtggaaagtcagtgccacattatgctgctattgagcctgatggaaatggtctaatgattgtatcctacaagtctttaacatttgttcaggctggtcaagatcttgaagaaaatatggatgaagacatatcagagaaaatcaaagaacctctgtattactggcaacagactgaagatgatttgacagtaaccatacggcttccagaagacagtactaaggaggacattcaaatacagtttttgcctgatcacatcaacattgtactgaaggatcaccagtttttagaaggaaaactctattcatctattgatcatgaaagcagtacatggataattaaagagagtaatagcttggagatttccttgattaagaagaatgaaggactgacctggccagagctagtaattggagataaacaaggggaacttataagagattcagcccagtgtgctgcaatagctgaacgtttgatgcatttgacctctgaagaactgaatccaaatccagataaagaaaaaccaccttgcaatgctcaagagttagaagaatgtgatattttctttgaagagagctccagtttatgcagatttgatggcaatacattaaaaactactcatgtggtgaatcttggaagcaaccagtaccttttctctgtcatagtggatcctaaagaaatgccctgcttctgtttgcgccatgatgttgatgccctactctggcaaccacactccagcaaacaagatgatatgtgggagcacatcgcaactttcaatgctttaggctatgtccaagcatcaaagagagacaaaaaattttttgcctgtgctccaaattactcgtatgcagccctttgtgagtgccttcgtcgagtattcatctatcgtcagcctgctcccatgtccactgtactttacaacagaaaggaaggcaggcaagtaggacaggttgctaagcagcaagtagcaagcctagaaaccaatgatcctattttaggatttcaggcaacaaatgagagattatttgttcttactaccaaaaacctctttttaataaaagtaaatacagagaattaattattctaacatattggcctctttgtactggaaaagtattcagtggtacctggaggtctggacagttatactgtaacctcttaagttttaatgtgctaaatatatcttgtatgattttttattttttaataacattggaaatatattcaagagattatgattctgtaaagctgtggaatgaagctgcagatttagagaacattggcttctgaaaaaaaaaaagagtgaagatagtactagcaagtatacttattttttaaaacaggctagaatctcatgttttatatgaaagatgtacaattcagtgtttaaaaataaaaatatttattgtgta

SEQ ID NO: 5389 - DNA, 1043 bp, Homo sapiens
agcggagaggccgaggcgtagcctaagcgtgggattccgcgcgtgcgctcggctccgcctggtgcggccgcggccgggagggactggattatgtcggccccgtttgaggagcggagtggggtggtaccgtgcgggaccccgtggggccagtggtaccagaccttggaggaggtgttcattgaagttcaggtgccgccaggcacgcgcgcccaggatatccagtgcggcctccagagccggcatgtggcgctgtcggtgggcggccgcgagatcctcaagggcaaactctttgattctacaatagctgatgagggaacatggactttggaggacagaaaaatggttcgtattgttcttacaaagacaaagagagatgcagcaaattgttggacttctctactagaatctgaatatgcagcggatccttgggtgcaagaccaaatgcagagaaagcttacattagagagattccaaaaagaaaatcctggttttgacttcagtggagcagaaatctcaggaaactacactaaaggtggaccagatttctcaaaccttgagaaataactgctttttttcctgcattctgtggatcctagcagatattgccaacttaatcagataaacagattatgtaatggaagaaaaatgcggatgcctacagttaacagattgcaaaatgtatcttaaaatggttctaaaaattgcattcaaacataatttacataggaaatgtactgtgggaactattctatggatatatggtaaagttgttttggacttgtttttgctcagcatgaagttttatatgctgcattttactaattccatatttaaccatatttttaatacaaaagaacattagagtatagatcatgtgaaatgaagggtgcctttggggaaaattaactttttcttttgataagtatgatattcaataaaattttctaaataggaattgtgtacccctttgtctaagtataacaattcacacaaaattatagtgctgaaaacaattttaataaaggaaaaagtccataaatgta

SEQ ID NO: 5390 - DNA, 5007 bp, Homo sapiens
gccctcgcagcgcagcagaagccacgggcttccttccgcgtaggaacctccttgctgcccttgtcgggctcttttgtctaagaccacctcaaggcaaagcccgtggggcagctgggtctggggaaaacagcccggggccgcgggggccgaacgagcacggaccggaagttccgcagccgcgccgtccggcggagccgttggctgcggacgccggaagtggccagtcggcaggtctgaggcggcgctgtgtgtgtgaagcgtacctagggcgggaggcgacatggagacaggggcggccgagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtattcaaaacctttgaccacatggcccgtcaggatgatgagaagagaaggcaggaacttgaagagaaaatcagaagaaaggaagaggaagaggccaagactgtgtcagctgctgcagctgagaaggagccagtcccagttccagtccaggaaatagagattgactccaccacagaattggatgggcatcaggaagtagagaaagtgcagcctccaggccctgtgaaggaaatggcccatggttcacaggaggcagaagctccaggagcagttgctggtgctgctgaagtccctagggaaccaccaattcttcccaggattcaggagcagttccagaaaaatcccgacagttacaatggtgctgtccgagagaactacacctggtcacaggactatactgacctggaggtcagggtgccagtacccaagcacgtggtgaagggaaagcaggtctcagtggcccttagcagcagctccattcgtgtggccatgctggaggaaaatggggagcgcgtcctcatggaagggaagctcacccacaagatcaacactgagagttctctctggagtctcgagcccgggaagtgcgttttggtgaacctgagcaaggtgggcgagtattggtggaacgccatcctggagggagaagagcccatcgacattgacaagatcaacaaggagcgctccatggccaccgtggatgaggaggaacaggcggtgttggacaggcttacctttgactaccaccagaagctgcagggcaagccacagagccatgagctgaaagtccatgagatgctgaagaaggggtgggatgctgaaggttctcccttccgaggccagcgattcgaccctgccatgttcaacatctccccgggggctgtgcagttttaatgaccagaaggaaaggaaaccctcgccggtggggaggcagagccttatcctcggctgcccttcttggctccctgcattccagggacttgctcgtcttgtttacccctagccatcctttctttcaagggtgaaccaggccttccaccctgaccttgcatctccagactgttccagagaaggtgcggggccagctgctatgtggtggccgctgtggctgacactgagtgaaggtgtttgaaatgcaggagaggatatcccagcaaattgggatcacatgcttttgtctccacagcaaccagccactgcaggcagcatgtctttcctcccctgctctctgcttgctgttgttttgacgctattctgcttgcatgtcttctggttgggatgtggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagcagttctgggtctgcgtgtgacatttgctgctgagacagttctgtctgtgcatggtcattattgttgcattctagccttgaggtcccaggccaacgtacacagcaaacaccagcatggggaattcttaggggttgtttcccatctggtctgaatgcactgggcaagatctcaatacagctttagaaatcctgtaagattttgaccagtggggagaaaaagaatgtagctatagatcttacatcctttcaaacaggttctggaattctgtagttactggaaagcttagggtgagtgcagagttgggaatgattccactgaagggccacctttgcccaccaggctccaaggccctccttggtctccaggtgcatacctgctgttaactttgctgagccctcgcaatgggcttcctccaggacataacgccgtgtctgacacagaagtctcccaggtggctggccacctgcttcttcctcagtcagatctttgactctccttctctgtgcccaccccatctccagcctcctctgaccctgctcacccctggggacaggacctaggggtgtgagaagtacttggctgaataaagactgtttcaaaggcaatccttagaattgcctagcatactcccagggccagaaataacccgccagaaaggagaggcgtatttgcccctgaagagtgcaggagggagaacagttgagaagtgttttgtgtggaaatgtgtccaagaggcgtcagctgctgcacagagaactcactgcccagaacactgcgcttggggaacagacctcacccccacctcaaatctgctctccactgggcctgttggcagccagctcagctggggaagggacagcatgactcgctttgtcgatgaaaagcacgaagttgtcagcacagaacctggccagtccttgagaaactccctccttggtggtcagaggtcaagcagcccatgtggcccacggtcctgaagaactgggctatgtccctgaggctcctctctaccgtctgactgtggggtctggggaacaggcatttaaaccaggctgctgccctggggagtgcccactggacgccagggtgccccatagggacagggtcacaaagccctggggcttcccctgccagtcctggtgaggacagtgtggtcactatctcagagagacgaaaaatgaatattctgtcatttcagactaaactactcacccagctcaca

SEQ ID NO: 5391 - DNA, 2001 bp, Homo sapiens
tgagtaagccagaatggttgatagtgggggaggatgatgacgacgctgcctttgcccctgtcttgtgtgaaacaactgcctgtgggtttcctgcagcgcagtggggagtgagaggagaaacgtcctgccgtgccacacacctcggctgctgcccggcagcggcagcagctgcgtcggcggcccacacagcagcgagaggcgagaggaggctgcctcgaggatgaagtgcaaacccaaccagacacggacctacgaccccgaggggttcaagaagcgggcggcgtgcctgtgcttccggagcgagcgcgaggacgaggtcctgttagtgagtagcagccggtacccggaccgctggatcgtgccgggcgggggcatggagcccgaggaggagccgggcggtgcggcggtccgagaggtgtacgaagaggcgggagtcaaggggaagttaggccggctcctgggcgtcttcgaacagaaccaggaccccaagcacagaacgtacgtgtatgtactgactgtcacggagctgctggaggattgggaagattcggttagcattgggaggaagcgagagtggttcaaagtcgaagatgccatcaaggttctccagtgccacaagcccgtgcacgccgaatatctggagaaactaaagctgggcggttccccaaccaatggaaactccatggccccatcctcgccagatagcgatccctagtgaatggcatagatgttgttcagatttactttgaaagaatcaagtatgtgaatggatggatgaatggaattgtgaagcacagatgagctctttcacactccaaggacacagctcatcctatgcttttggacacttcttccctgtttattacaatgactattctccaggttgttgcactaccgctgtatctgtacataattctaacttggcacctgtggccttttttgtgctcttatgtgtctgtatttcccggcagagtatacgcccttgaatgccaggaacttgtttccttagtcttttttatatatctagcatataagatattgcttagaatatggtagacatcactgaagatttgtttcagtagttcatattttgtaatgatactgaatggttaaacaatccctttctaatctgtctagcatatatgtgacttttgtttatcaagtgtcacacaactgcttcaaggcagctgtgagatactagaaagcaaaaattcttactcctatgtctgtgtcatcccagatgtgtgcctccagatggcagtatactacactatctgtaaaatatatttgcaaagccaggcacagtgttacgcgtctgcctcaggaggctgaggcagaagaatagcttgagcccaggagctttagtctagcctgagcaatataatgagactccgtctcttaaaatatttgcccaaacattgaacctaaatttgaccatgcccctagaaataattcctaatctttagaaaatagggcagagaaacattattttacaccatggagatgagatcagcagaatccagactataagaaactacaggacacatgacctagtttcttctgtaaataacttgcaaggatgaaagatggaggatgaacctatagatttaaagagacttaagagacatattaaccaattgttaattggatcttatttgaattgtgatttgaccgaactgtaaaacgaatacatttatgagacaatcggggtaatttgaacattggtggggtatttggtattagaataatggttttatcattatgttagaaagaagggtcctcatctacattctcaaacatctgtggctgatatgatatgattcttggaatttgcttcaaaataataagtctggatgttaagtgcattggaaatattgatgaaacgaaattggccttgataattgttgaagctgggtgatggctaaaatgatggttcattatatatgttcatctctatttttgtatgtttggcattttccgtaataaagtttataaaaataa

SEQ ID NO: 5392 - DNA, 2022 bp, Homo sapiens
attccccaacctgatagccctccgcgacgcattacgcaccgcggacagctggagaggccgaggcgctctcgctttgatttcggcgcctccgccctcgcggggagagattggctgcggccgcgggacggggtagtgagcgcgtcacttcctgccgctgccaggcgcgtcctcccgcgcgctatgacggccagcgcacagccgcgcgggcggcggccaggagtcggagtcggagtcgtggtgaccagctgcaagcatccgcgttgcgtcctcctggggaagaggaaaggctcggttggagctggcagtttccaactccctggaggtcatctggagttcggtgaaacctgggaagaatgtgctcaaagggaaacctgggaagaagcagctcttcacctgaaaaatgttcactttgcctcagttgtgaattctttcattgagaaggagaattaccattatgttactatattaatgaaaggagaagtggatgtgactcatgattcagaaccaaagaatgtagagcctgaaaaaaatgaaagttgggagtgggttccttgggaagaactacctcccctggaccagcttttctggggactgcgttgtttaaaagaacaaggctatgatccatttaaagaagatctgaaccatctggtgggatacaaaggaaatcatctctaggtggccgagaagatttgattttctttaaaaagacaagaataaggtctggttagggaatgaaaaatgtatacatttcggaacaactccattttatctaaaaaagttcttgtgattgccagtttatttgcagtctcttaatgtatcccccactctttcagccagtacttgagaaaatttttctgaaatatgtcattgaattgtattccagacacagaatacatgataaatactgatattatgggtaatctgctttccatatttacctatgatatttactgtgcagtttgtcattactagcttgcatggagtaggatgcagtcaaatttgccttagtgtttctgttcaaatagagacctgaattcaaatattgtagtttaggttcaaacagagtatggctgttgcaaaatttaccaaatttgttgattacctcttttattaaagaaatgttggggagagggtaatatattgtgacaatttttgcaacttacagggaataggacaggtcattagggtgtatttcccaggtttccaattgagaatctaaaccaagagaagtgagacaaaccatctaatatctgtatcatgctattaataggctgtgatgttgagtttctcacttactctttctgaggtccagggtccttatatgaagagattcatatatatgaagagattcgtctagagcagtggttgtcaaagtgtggtctgggggggcctcaagagcctttcaagggtattctaggtcaaagctgtttttataacactaagacatcatttcactatttatagcttttccttttttttatttgagaaggagtcttgctctgttgcccacattggagtgcagtggcacgatctcagctcattgcagcctccgccacctgggttcaagcaattctcctacctcagcttcccgagtagctgggattataggcacccaccaccacacctggctaatttttgtatttttagtggagacggggtttcaccatgttggccaggctggtctggaactcctgagctcaagtgatctgcccatctcagcctcccaaagtgctgggattacaggtatgagccacaacgcccagccatcatttatctttttcactcattttttcatgagtatgcagaggagttttcaagaggctatctggtgtgatattgtaataggctgaatgcaaaagcagatacaagattccagctttcgtctgtcatcagacattgaagagatttggagaaatgtaaagcagcagtactcttctcactaatttttgttgtggttagttagaaaaatggttatttttagtgggttttaatatgtgaaaaaaataaaattagctatttgcc

SEQ ID NO: 5393 - DNA, 1473 bp, Homo sapiens
cagagtcgcgttatggccgaggtgcgggtgcagctgctcctgtcccggcgtccggagtcggtgagcttcgcacggagtgtgtgtggcctcctgggagccggaccagggctcgggacgtggcccattcactgcagcttgaagcgaggacggcttgtcctctcgagcaggcccttcccaggcgcctccgctaggcttccgctccagcgaccccctttctgcccttttgcggccctggaggagcggcccagggtccctggggctgagctgcccacagatcgaggtgtggacctgggtgtggccgtcattctgcagtccagcgacaagactgtcttgctaacccgaagggcacgcaccctgagcgtttcccccaacctctgggtacccccgggtgggcacgtggaacttgaggaggagctgctggacggagggcttcgagaactttgggaggagagtggactacacctgccccagggccagttctcttgggtccctctgggtttatgggagtctgcctaccctcctaggctgagctggggtttacccaaataccatcacattgttctgtatctactcgtgatctcccaggaatcacagcagcagttgcaggcccggatccaaccaaacccaaatgaggtgagcgcccttatgtggctgacaccagatgtagctgctgcagtggctgccgcagaggatgggacagagacacccggacttctcccccaggacctaccaccctctgtccttgcagtggaactagaggaggatggaagagcccgacctctggtcctgcacatgtccaccctcctgcggatgatcccaaccatggcagaggacaaagagagagtcagcactggaaccaagtttgccctcaagctctggctgcaacatctgggcagaacacccccaccgtgtaaaagtgcagcttacctggacccagggccagcaaaggaagaatggaacatggaccctcttcccccaaaccaggggtctggaaagtgaagtgtaaaatcccctccctagcccatctccatgacactcacagaacattcacaacctttattatgggtgagagcttcactacaactttagaaataaaaagtaaaattacaacataggtcctaggccttggcgagcctgaaaaagaagattgggaaggagggcacagggtccttccacctccctggcaaggtgcagaatgagccaggcctaactacagggccatgagcctctagaagcttaggggggaataagaaacactgtgaacttagatatataaatggagagagacccaagcaataggccgggcctgactcccagacccctgcagatcatggctaaggccttacatcctcctctgtcatactggagtaggaggcaggggaagtcatctttggagtattttggtttttcttatttatgtacaaaaaagtccacatccacaatccaaaataaagttctctgtccatctctgaa

SEQ ID NO: 5394 - DNA, 743 bp, Homo sapiens
ggccgtcattctgcagtccagcgacaagactgtcttgctaacccgaagggcacgcaccctgagcgtttcccccaacctctgggtacccccgggtgggcttcgagaactttgggaggagagtggactacacctgccccagggccagttctcttgggtccctctgggtttatgggagtctgcctaccctcctaggctgagctggggtttacccaaataccatcacattgttctgtatctactcgtgatctcccaggaatcacagcagcagttgcaggcccggatccaaccaaacccaaatgaggtgagcgcccttatgtggctgacaccagatgtagctgctgcagtggctgccgcagaggatgggacagagacacccggacttctcccccgaactagaggaggatggaagagcccgacctctggtcctgcacatgtccaccctcctgcggatgatcccaaccatggcagaggacaaagagagagtcagcactggaaccaagtttgccctcaagctctggctgcaacatctgggcagaacacccccaccgtgtaaaagtgcagcttacctggacccagggccagcaaaggaagaatggaacatggaccctcttcccccaaaccaggggtctggaaagtgaagtgtaaaatcccctccctagcccatctccatgacactcacagaacattcacaacctttattatgggtgagagcttcactacaactttagaaataaaaagtaaaa

SEQ ID NO: 5395 - DNA, 1519 bp, Homo sapiens
ctcgtgagctcccggcccgctgccgcagggactgggagcgggctccgcagcgcactctagcccgcggctcggctcagtcggtctgcgaggatccggcccgccgccccccgggggacccgatggcctcggagggcctggcgggggcgctggcttccgtgctggctggccaggggtccagcgtgcacagctgcgactcggcgccggccggggagccgccggcgcccgtgcggctgcggaagaacgtgtgctacgtggtgctggccgtgttcctcagcgagcaggatgaggtgctactgatccaggaggccaagagggagtgccgggggtcgtggtacctgcctgcggggagaatggagccaggggagaccatcgtggaggcgctgcagcgggaggtgaaggaggaggcggggctgcactgtgagcccgagacactgctgtccgtggaggagcggggcccctcctgggtccgcttcgtgttcctcgctcgccccacaggtggaattctcaagacttccaaggaggccgatgcggagtccctgcaggctgcctggtacccacggacctccctgcccactccgctgcgagcccatgacatcctgcacctggttgaactagccgcccagtatcgccagcaagccaggcaccctctcattctgccccaagagctaccctgtgatctggtctgccagcggctcgtggctacctttaccagcgcccagacagtgtgggtgttagtgggcacagtggggatgcctcacttgcctgtcactgcctgtggcctcgaccctatggagcagaggggtggcatgaagatggccgtcctgcggctgctgcaggagtgtctgaccctgcaccacttggtggtggagatcaaggggttgcttggactgcagcacctgggccgagatcacagtgatggcatctgtttgaatgtgctggtgaccgtggcttttcggagcccagggatccaggatgaacccccaaaagttcggggtgagaacttctcttggtggaaggtgatggaggaagacctgcaaagccagctcctccagcggcttcagggatcctctgttgtcccagtgaacagatagagaggtgggggaggtgacagggagctaggcagccgtgctccctccagtgcggacttgtctccctctgagggaggcaagaggctggcgatcagggatcttgttgcattgggagcaggggcggctctcctggtccccaggagagatgctttgaggagcattcctctagattgcacaagggacagtgcctttaaccaagcgaggagtccaaagctcaggacctgactaccctgagggcacgctgacgcctcttcccagggggatggggagctttctgcacccccagtggcatctcctcatcacgttctgtgccgtccttgggaaaggcctgcattctgatccttccaggcccttcgagcatggaggggcactggggaaggtcccccgagggaggagcacgttgctgagtaaagaggtgttactcaccttgc

SEQ ID NO: 5396 - DNA, 1756 bp, Homo sapiens
ctcgtgagctcccggcccgctgccgcagggactgggagcgggctccgcagcgcactctagcccgcggctcggctcagtcggtctgcgaggatccggcccgccgccccccgggggacccgatggcctcggagggcctggcgggggcgctggcttccgtgctggctggccaggggtccagcgtgcacagctgcgactcggcgccggccggggagccgccggcgccccgtgcgggctgcggaagaacgtgtgctacgtggtgctggccgtgttcctcagcgagcaggatgaggtgctactgatccaggaggccaagagggagtgccgggggtcgtggtacctgcctgcggggagaatggagccaggggagaccatcgtggaggcgctgcagcgggaggtgaaggaggaggcggggctgcactgtgagcccgagacactgctgtccgtggaggagcggggcccctcctgggtccgcttcgtgttcctcgctcgccccacaggtatggcccacctggaggcagtgtgaacagggccagttgacacctttcccccagctcctcggtgaggtgagcccctctacagccagtcctgttatggctggcacagcctggcatgggcagattccagcctttgggctgggggcctctctcctgggtcagggatgtctgttgactctgccagagctgcacttctctccacacagaccctccctgccccatcccccacatctcccccaggtggaattctcaagacttccaaggaggccgatgcggagtccctgcaggctgcctggtacccacggacctccctgcccactccgctgcgagcccatgacatcctgcacctggttgaactagccgcccagtatcgccagcaagccaggcaccctctcattctgccccaagagctaccctgtgatctggtctgccagcggctcgtggctacctttaccagcgcccagacagtgtgggtgttagtgggcacagtggggatgcctcacttgcctgtcactgcctgtggcctcgaccctatggagcagaggggtggcatgaagatggccgtcctgcggctgctgcaggagtgtctgaccctgcaccacttggtggtggagatcaaggggttgcttggactgcagcacctgggccgagatcacagtgatggcatctgtttgaatgtgctggtgaccgtggcttttcggagcccagggatccaggatgaacccccaaaagttcggggtgagaacttctcttggtggaaggtgatggaggaagacctgcaaagccagctcctccagcggcttcagggatcctctgttgtcccagtgaacagatagagaggtgggggaggtgacagggagctaggcagccgtgctccctccagtgcggacttgtctccctctgagggaggcaagaggctggcgatcagggatcttgttgcattgggagcaggggcggctctcctggtccccaggagagatgctttgaggagcattcctctagattgcacaagggacagtgcctttaaccaagcgaggagtccaaagctcaggacctgactaccctgagggcacgctgacgcctcttcccagggggatggggagctttctgcacccccagtggcatctcctcatcacgttctgtgccgtccttgggaaaggcctgcattctgatccttccaggcccttcgagcatggaggggcactggggaaggtcccccgagggaggagcacgttgctgagtaaagaggtgttactcacctt

SEQ ID NO: 5397 - DNA, 1499 bp, Homo sapiens
ccgcagggactgggagcgggctccgcagcgcactctagcccgcggctcggctcagtcggtctgcgaggatccggcccgccgccccccgggggacccgatggcctcggagggcctggcgggggcgctggcttccgtgctggctggccaggggtccagcgtgcacagctgcgactcggcgccggccggggagccgccggcgccccgtgcgggctgcggaagaacgtgtgctacgtggtgctggccgtgttcctcagcgagcaggatgaggtgctactgatccaggaggccaagagggagtgccgggggtcgtggtacctgcctgcggggagaatggagccaggggagaccatcgtggaggcgctgcagcgggaggtgaaggaggaggcggggctgcactgtgagcccgagacactgctgtccgtggaggagcggggcccctcctgggtccgcttcgtgttcctcgctcgccccacaggtggaattctcaagacttccaaggaggccgatgcggagtccctgcaggctgcctggtacccacggacctccctgcccactccgctgcgagcccatgacatcctgcacctggttgaactagccgcccagtatcgccagcaagccaggcaccctctcattctgccccaagagctaccctgtgatctggtctgccagcggctcgtggctacctttaccagcgcccagacagtgtgggtgttagtgggcacagtggggatgcctcacttgcctgtcactgcctgtggcctcgaccctatggagcagaggggtggcatgaagatggccgtcctgcggctgctgcaggagtgtctgaccctgcaccacttggtggtggagatcaaggggttgcttggactgcagcacctgggccgagatcacagtgatggcatctgtttgaatgtgctggtgaccgtggcttttcggagcccagggatccaggatgaacccccaaaagttcggggtgagaacttctcttggtggaaggtgatggaggaagacctgcaaagccagctcctccagcggcttcagggatcctctgttgtcccagtgaacagatagagaggtgggggaggtgacagggagctaggcagccgtgctccctccagtgcggacttgtctccctctgagggaggcaagaggctggcgatcagggatcttgttgcattgggagcaggggcggctctcctggtccccaggagagatgctttgaggagcattcctctagattgcacaagggacagtgcctttaaccaagcgaggagtccaaagctcaggacctgactaccctgagggcacgctgacgcctcttcccagggggatggggagctttctgcacccccagtggcatctcctcatcacgttctgtgccgtccttgggaaaggcctgcattctgatccttccaggcccttcgagcatggaggggcactggggaaggtcccccgagggaggagcacgttgctgagtaaagaggtgttactcaccttgc

SEQ ID NO: 5398 - DNA, 2966 bp, Homo sapiens
atgagcagctccctgcggccgggccccagccgctggcggcgggcggccagcatcgtcctggcggctggctggtcgcgcccggagaccgccaccccgccgtcgcgcccgccgccggccgagggcttccggctgctgctgctgcagcgctccccgcaccaaggcttcatgccgggcgcgcacgtcttctccggcggagtgctggatgcggccgaccgctcggcggactggctgggcctcttcgcgccgcaccacgggccgccgcgcttcggcctgggcccggcgccattcagccgcaccgctttcccgtcgctgcccgacaccgatgaccacaagaccgacaacactgggacgctgcctgaggacgtagccttccgcatctgcgccgtgcgggaggcctttgaggaggcgggcgtgctgctgctgcggcccaggacttccccaccaggcccagcacccgggcctggcctcgccctggagccaccgccgggcctggcctcctggcgcgaccgcgtgcgccaggacccgcgccacttcctgcggctgtgcgcccacctcgactgcacacccgacatctgggcgctgcacaactggagcgcctggctcacccctttcttgcggggcaccactcgccgctttgacacggccttcttcctgtgctgcctgcgcgagccgccgcccgtctaccccgacttggcggaggtggtgggctaccagtggtcatctccatcagaggcaactgaaagtttcttatcaaaagaaatttggttgccacccccacagttctacgaagtgagaagacttgcaaactttgcctctctctctgacttgcacaaattttgtttgggtcgtgcattagaaggactggaaaggtggctgccgatcatcttgttaactgctgatgggatggtccatcttttaccaggtgatgagctatatttagaagattcagactttttggaaaatcttatgtctactgaaaaaaagactgaggaaatcatgaaggaaggcaagcagtttcaccggatagtgacataccatcgccacctttatgatatccacgtgactgttcagccaaagtataaacacgtttatcctaagaactctgtagtaagaaaaagccatttgtagggtgcttaagcttgtttgtaaaatggcctacttgaagtcctcatgaataatgagggttgactttcatttgcttgaaacttaaggaagtttgtgcctataaaagttactgcaattcagtatttctttatttttttcgagacagagtctcaatctgtcgcccaggctggagtgcagtggcatgatataggctcactggaagctctgcctcaggggttcatgccattctcctgcctcagcctcccgagtagctgggactacaggcgcccgccaccatgcccagctaatttttttttgtatttttagtagagacgggttttcaccgtgttagccaggatggtctcaatctcttgacctcgtgatacgcccgccttggcctcccaaagtgctgggattacaggtgtgggccaccacacccagcctttttttttttttttttttttttttttgagacagagtgtctcactcttgcccagaacccaggctggagtgcagtggcccaatctcggctcactgcaacctccacctcccaggttccagcgattctcatgcctcagcctcctgagtagctgggactataggcatgcaccaccatgccccactaaattttgtatttttagtagaaacagagtttcaccatgttggccaggctggtctcgatctcctgacctcatgatctgcccgccttggcctcccaaagtgtgggattacaggcgtgagccactgtgcccagcatggtgtttcttatatcaggtgttttagggagctcgcttgcttattccattctttaatccttacagtgtgccacacgtataaagtttataacgtattaatgatctcattacccaaaaccagaacataatttcacaagggttcctacttctgtattgttttattatctcaaaaatttaaataacatgttctgctgtttattgttcttgttatccactgtattagcaccttccctgatgtgctttggaggttgatcaatgaatttctgagactttctgctggaattactttaagggtgtcttattagatgatgaaaagttggctgagacacccttcaagtgaccatgtcattgttttcttgctatgtctttagcttaatgattaagatacaattctttttaaaatcaaatggtattagttattatgtttcccaaattagaaatcgattttagttaacattttattttattttattctattttatttatttttgagacagagtctcgctctgttgcccaggctggagtacaatggcgcaatctcagctcactccaatctccgcctcccaggttcaagcgatttttctgcctcagcctcccgagtagctgggattacaggcacccactaccatgcccagctaatctttgtatttttagtagagacggggtttcaccatgttggccagtccggtctcgaacttctgacctgaggtgatctgcccaccttggcctcacaaagtgctgagattacaggcttgagccaccacgcctggcctagttagcattttaaagaaacacaaagccataacaaaaaccatcattgtttgtattccacactgttaatgaatgtaaagaggttagaaatgtagtgtttgattaatgatgtttatttttactgtatttaatatgagtaatttttcatcatctttcaagaggaataatgtttattgattaaaggtgagaaatgatagttaagacaccaattccatgtccagatctttgactgtatcatgcattgtacaattgatttcatattttatgaaatgccttaattttcctactataacataaagacaatgatgaataaagtttatgtgtatgattaaatcc

SEQ ID NO: 5399 - DNA, 1094 bp, Homo sapiens
ggcggctggtgagcgcccgctggaggctggagcttccgggccctggaaaggggtccccgcgcgccccgggtcggaggcagacccctgggtttgggggacatgggcatttggggcgcctgaacccaagacctctggatgagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtgggcgctgcactagccacagccgatgacttccttgtcttcctgcgccgctcccggcaggtggctgaggcccctgggctggtggacgtacctggtgggcaccctgagcctcaggccctgtgccctggtggcagcccccagcaccaggacctcgctgggcagctggtggtacatgaactcttttccagtgtccttcaggagatctgtgatgaggtgaacctgccgctgctcaccctgagccagcccctgctgttgggcatcgcccgaaatgagaccagtgctggccgagccagtgccgagttctatgtccagtgcagcctgacttctgagcaggtgaggaagcactacctgagtgggggacccgaggcccacgagtctacaggaatcttctttgtggagacacagaacgtgcagagattgctcgagacggagatgtgggctgaactctgcccctcggccaaaggcgccatcatcctctacaaccgggttcagggaagtcccactggagcggccctagggtccccagccctactcccgccgctctgaaaataataaacgactttattcttgga

SEQ ID NO: 5400 - DNA, 986 bp, Homo sapiens
ggcggctggtgagcgcccgctggaggctggagcttccgggccctggaaaggggtccccgcgcgccccgggtcggaggcagacccctgggtttgggggacatgggcatttggggcgcctgaacccaagacctctggatgagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtgggcgctgcactagccacagccgatgacttccttgtcttcctgcgccgctcccggcaggtggctgaggcccctgggctggtggacgtacctggtgggcaccctgagcctcaggtgaacctgccgctgctcaccctgagccagcccctgctgttgggcatcgcccgaaatgagaccagtgctggccgagccagtgccgagttctatgtccagtgcagcctgacttctgagcaggtgaggaagcactacctgagtgggggacccgaggcccacgagtctacaggaatcttctttgtggagacacagaacgtgcagagattgctcgagacggagatgtgggctgaactctgcccctcggccaaaggcgccatcatcctctacaaccgggttcagggaagtcccactggagcggccctagggtccccagccctactcccgccgctctgaaaataataaacgacttt

SEQ ID NO: 5401 - DNA, 639 bp, Homo sapiens
atggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtgggcgctgcactagccacagccgatgacttccttgtcttcctgcgccgctcccggcaggtggctgaggcccctgggctggtggacgtacctggtgggcaccctgagcctcaggtgagattccaggctgggcacaaagacccagacagctcaagggagctgcagctctccaccctcccaatcctcccagctttggtttcctccttaaagggaaaattggcctggtatttctctggaagtttgctcagggcagtccacctgcctccccactga

SEQ ID NO: 5402 - DNA, 746 bp, Homo sapiens
caaagcctcaggaagtgagcgctgggtgggagtatacggctcattaagttcaccacccccaagtccctgctgcagagagggaaactaaggcccagcaggccagacttgcccaaggtcacacggtcagccaggagcgcagggaggccgagccccgcaccccagatcgctggtgcgccccgcagggtggtccgggaggcagggccgacgtgccgacggaccgggcggaagcgtcggggcggcggggacaaacctccaggatcctcgaccgcggcggacccgccaatgaaaagccgcgtggaaagggggcgggcacttccgcttcggggaaggggcggagcctgagggacccggcggctgagctgccccgttcagaccatggatcctgaggtgaccttgctgctgcagtgccctggcgggggcctgccccaggagcagatacaggccgagctgagccccgcccatgaccgtcgcccactgccaggtggggacgaggccatcactgccatctgggagacccggctaaaggcccaaccctggctcttcgacgcccccaagttccgcctgcactcagccaccctggcgcctattggctctcgggggccacagctgctcctgcgcctgggccttacttcctaccgagacttcctgggcaccaactggtccagctcagctgcctggctgcgacagcagggtgccaccgactggggtgacacgcaggcctatctggcggacccactgggggtggg

SEQ ID NO: 5403 - DNA, 4855 bp, Homo sapiens
gcatgtgggcttcatttaaacagagcagagggggcggcgcgcggtcgccgcggtgctgctgctcagtgggagcgggtcttcgcaactgtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcctcgccgcacctcccgcaccgactagcgctcccgggcgctcctgcgcccgactcgccctcgcccccactccccggcggggtggcggcggccgggcccccacggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagcagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaaacacacacacatgaactcagatttgcaaaccaggtttctgaaactttgggtaaggtgtatgcttttaactttgaaatgtataaacacccagcggaaacgtatacctttcagtgcatagtgcattgtgtgcttaccctgggttgtttaaacttgtgttcaaatattccccctccaagtgaaagcctgtcgggaattccacagtaacacctttactgttctcccattgatgatcatatacgttacctcttcctagcggtacatttgtatgatccttactactggaattaccgggttaaaaggaaatgcttaccactaagatgtcagtattctcctcatggatattttcagtctcaatgttgccagtctaatagtatagtatgtggttgctttactgctgttctccccacccccgtggagttgtgtcattattttaatgaatgtgagctcttgacttactctagaattctaatacagatactttctgcactagtatcacttttattattgcagttccatttaaaagcataactggctaagtcaccgccccacccgccgcattacatttcctaaaacatactgctgccaaagaccaactgtagaatccttaagtcctgttcaagtgtcacttcattttttattaggggtttcttagttggagggcatgagaaacttggccctttccaatgttgtcttcacattggagtataagaattctctataggactctttaatttttttttttttttggtagagatggggtcttgctgtgttgcccaggctggtctcaaactcctaggcttaagcagtcctccagcctcagccttctcaaagtgctaggatgattggcatgagccacctcgtctggcctgcaggtctttttaagcatttgctgttcaataataagcatcttctttatgcctagtatttgtgataagagcacaaaacaa

SEQ ID NO: 5404 - DNA, 4839 bp, Homo sapiens
atttaaacagagcagagggggcggcgcgcggtcgccgcggtgctgctgctcagtgggagcgggtcttcgcaactgtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcctcgccgcacctcccgcaccgactagcgctcccgggcgctcctgcgcccgactcgccctcgcccccactccccggcggggtggcggcggccgggcccccacggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaaacacacacacatgaactcagatttgcaaaccaggtttctgaaactttgggtaaggtgtatgcttttaactttgaaatgtataaacacccagcggaaacgtatacctttcagtgcatagtgcattgtgtgcttaccctgggttgtttaaacttgtgttcaaatattccccctccaagtgaaagcctgtcgggaattccacagtaacacctttactgttctcccattgatgatcatatacgttacctcttcctagcggtacatttgtatgatccttactactggaattaccgggttaaaaggaaatgcttaccactaagatgtcagtattctcctcatggatattttcagtctcaatgttgccagtctaatagtatagtatgtggttgctttactgctgttctccccacccccgtggagttgtgtcattattttaatgaatgtgagctcttgacttactctagaattctaatacagatactttctgcactagtatcacttttattattgcagttccatttaaaagcataactggctaagtcaccgccccacccgccgcattacatttcctaaaacatactgctgccaaagaccaactgtagaatccttaagtcctgttcaagtgtcacttcattttttattaggggtttcttagttggagggcatgagaaacttggccctttccaatgttgtcttcacattggagtataagaattctctataggactctttaatttttttttttttttggtagagatggggtcttgctgtgttgcccaggctggtctcaaactcctaggcttaagcagtcctccagcctcagccttctcaaagtgctaggatgattggcatgagccacctcgtctggcctgcaggtctttttaagcatttgctgttcaataataagcatcttctttatgcctagtatttgtgataagagcacaaaacaa

SEQ ID NO: 5405 - DNA, 1419 bp, Homo sapiens
acttcttccttcctttctctgggctgatagatgagacaaagggggctcgcccagccccagtttctccatctgggcactcgagaaggcgcctggtccccgggaaggtcccgggccgcgtaagtctcgcctagcgggagtcaccatcttaacgtgcgaattgagttgaaagccggataaacctcgagtgctcagcgagaggagggtggaaatggcgtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagcagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaa

SEQ ID NO: 5406 - DNA, 1258 bp, Homo sapiens
tgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggaggtatgttctgcaactcctggtggccgagcgtgtatgacttagtgtagtggtgatggctgcagacattttgggttgttttggtaggctcttgacgttagctttgttttcacttgcactttgtctgtttagagtttgtggaagtcatttctttacccaagaatgacctgctgcagagacttgatggtaagcattctccagaccgccacccagtttctccagttctccccgtccccatcccagcaaactgggtactaaatataactccatttctttatcttttttgtatcactaaagtcaaatgcctagcaacttgtaaaactgcaggtgaccactactaattttcctttctgggtggcacagagtttgaaaataagagcaaagcattctgggtcaagtgcaaacttttggtagaggctttttctcctacagaatggcccagatgacattcctgctgagtagccaaaacgattctacactttaaaccttcagtccatagcaatgcaaaggtgtgggtagataagctgttagcttttcctcaagtatgctagtatgagggatggtcctttgtggaggctgtatgttcaaggagaaattgatgatgctccttcaacaaatacttgaggtatttcctgtatactccgtgtgatatgcttttcacataataaacc

SEQ ID NO: 5407 - DNA, 919 bp, Homo sapiens
tgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaagaaataaagagaaaacaacaacattgctaattttgagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgctctggtagctgaagaacatctcacagtggacgccagggtctattcctacgctctagcactgaaacatgcaaatgcaaagccatttgaagtgcccttcttgaaattttaagcccaaatatgacactggccatttttgtaaacgagaccaccaggccttcttcactaagactttgtattcaacttagtttaatgtagatttgccattagctttttcgtaaaataaaagcacagaaca

SEQ ID NO: 5408 - DNA, 1126 bp, Homo sapiens
gaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgagactttgtaaacagtaagcttatggggagaaaagtcctttgataaaaccacgagaggagatactgtatggagacatgaggagatactgtgtggagacgaggagatactgtatggagacataccatgggcccttcaaggagcacctctgtatgggctggcaaatccctttcactcatctagaaagaagcagacacttgtcatcatgggaatattttattgggtataagtgttttaggtaattgataactgatttttctactgtttttaagtgattacttcaaatgtgatttgaagcattgtttggcctgaagctttaagaccagtttcttaagcttttccctgagtttcagcagcttacggtttcagtgaataagcagagcgcctggttttgaattgtctgttgtttgtttgaaaatctgaatgtgtctttcaaa

SEQ ID NO: 5409 - DNA, 410 bp, Homo sapiens
gcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtaggagtgcaaacctattccaaccctttagaaaggaagttagcacttgtgatcgtgtcgcggtcatccccgtgctgcagagaacacttcactatgagtgtatcgttctggt

SEQ ID NO: 5410 - DNA, 3433 bp, Homo sapiens
gcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgctctggtagctgaagaacatctcacagtggacgccagggtctattcctacgctctagcactgaaacatgcaaatgcaaagccatttgaagtgcccttcttgaaattttaagcccaaatatgacactggccatttttgtaaacgagaccaccaggccttcttcactaagactttgtattcaacttagtttaatgtagatttgccattagctttttcgtaaaataaaagcacagaacagatgtggtggtggtatggaattgtaattacaggtaggttgtgaccttcctttaaatttgttataactccagctaaaattaacaaagaatataaatgcaagtatgtttactccaatttttttaaagctcaacagcagttaactacagctcagttacttttctagtccagtctggtagacaggggtatttgtatagagaaatagacctgagttctcaattaggtcatttccactctcaacccccaatataaaattctaagctgggtatgcaaataaccatgtactccgttagtgtttaaaacagcgttaaaaagaaaaaaaaggctttttggcctcttctaattgaatttttactatgcaaaatttatctagggtagttgaatccaactagggtagggttcgatagaatcctctactagttttcagttcatctatttactgaggctgaaccagcttttaagtaaggaaaacggttgactccattcactacaccaaggctaggagactaatgaaaattcaggtccatcccgcaagcatctgcacgtgcttgaggatctcttttcctattcttacctcaaagagtacttgaagtttctgaaaacaaatctgtaagactgacatgtttggggcagtaatatcttgatgttaaaccatgaacagaaccagcaagatcagccagtacctgaaacccaatacagagtagttcacagcaagaagtacagattgatctggttcccatgcctgaaaccctgtcatctagcagttctaccagtgttcctgggccattttcttagcttcttgagtgagtttagctctttttgtgttgacttttagggcctccagcagctccatgattttccaggactttccagtctggcccccacggaattctcaggatgattctcatccagccctaagtcatgtttctagcctggctccagcgggtaagccaggccctgagaaccatatgaaagggctctccagataaaatcagagtgctaatgccagaatgctgcagtagcctccgtttgtccacaggctcactgtctgagcccaggatatttttatgagtgaaactgtaagatctttacactggacttcctaaagataaaacaattatggaaatacagaactttacagatgaagctgtctagccctatacatgtgaaaattaagatccaactacttcctgtaatggtagccttcccctatgcctctaacccttttttaaatcctgatttcaatcacaggcattgtgattctccaaagctctaactcttccttaggtctgaaagccacatgctatcaatcattgaaatcaagagagaaggcatccgtagacgggcgcagcccagtctttccacatagcccagttcctccccagccactccccatgggaatgacctctgcagctgacctaagcttatcctctccttcttcctaagagtgcaacttagaagtcagagccaaatcctagaatgtatccctaaatgccatttctattttttataaacatgaaaaggttgtgctttggaaattcagtctgtttgagaactggcagtctggctggcactgtttaaaaatgtttatttgccctgcatttaaaaactgaaggtttcctatgtattaaaagccatatttccaccttcttaagggaaaaaaaaatcggacgtcataacactgggtggatgtttttatggtaacagtggtctgaggcccttggcggatgctcaccgagccactgtcactatcctgcctgcctttatctgccttgccctgcgattatttggctttgtaagcataagctacgtaagacataccacacctaagaaactaaacagcaatgaaaacccatacttctgaaaagggtgtcttttaaaaattaagtttgatcttttgggaaataaagcacatagttttcaaaatgatttaccaagatctatgctctttcaaatggagactgggatattgttgttttgagaccactgttttcctgtttcctcccaaatgttagtcacatatatgattacccttaagttggtcactatctatctatctgtcaataatttaggattaaagtttgaagtgtaattacatttgacttttacaggcatctcagggtggacttcttatgaatacactgaacctatacaaatgatcttagaaaacgtttaatatcagatttctttattttttccaacacaactgaatcagttttcttaaataaaagtttattgtctactgtttacactc

SEQ ID NO: 5411 - DNA, 1201 bp, Homo sapiens
ggactcttccggtccctaaagcaagaaggaagaccgagaaaaggaagcggaggagaatcccggggcatacgcttgacacacacgcatacaaaaagagctttagtctcgaaagaggaattaccgaagtgtcgagagaggaattttaagaagtttacaactccgtcttcgccctaaacgcacgctgacccggaaagtaatctcctgaagctaggtcaaaggcgggggttctacggatgccggaaggagggtgcgcgcccatccttttagcaccgcgagaggcgccggtgtttcgagccgtggcaccggcatcggctgacactgctgcctccagctagttatttcgtcctcttccgttcttcacccctacaccttggaggtgaacttctcacctgagggctgtaaagactcgtttgaaaatggagagccaagaaccaacggaatcttctcagaatggcaaacagtatatcatttcagaggagttaatttcagaaggaaaatgggtcaagcttgaaaaaacaacgtacatggatcctactggtaaaactagaacttgggaatcagtgaaacgtacaaccaggaaagagcagactgcggatggtgtcgcggtcatccccgtgctgcagagaacacttcactatgagtgtatcgttctggtgaaacagttccgaccaccaatggggggctactgcatagagttccctgcaggtctcatagatgatggtgaaaccccagaagcagctgctctccgggagcttgaagaagaaactggctacaaaggggacattgccgaatgttctccagcggtctgtatggacccaggcttgtcaaactgtactatacacatcgtgacagtcaccattaacggagatgatgccgaaaacgcaaggccgaagccaaagccaggggatggagagtttgtggaagtcatttctttacccaagaatgacctgctgcagagacttgatgctctggtagctgaagaacatctcacagtggacgccagggtctattcctacgctctagcactgaaacatgcaaatgcaaagccatttgaagtgcccttcttgaaattttaagcccaaatatgacactggccatttttgtaaacgagaccaccaggccttcttcactaagactttgtattcaacttagtttaatgtagatttgccattagctttttcgtaaaataaaagcacagaac

SEQ ID NO: 5412 - DNA, 1090 bp, Homo sapiens
gctctgcgcaagcgcgaccgaccgagcagctccgaggagtccgcccggaaacaaacattccccagggcaatgtcacgacttggtcttcccgaggagccagtcagaaacagtttgctagatgatgctaaggcccgcttaagaaagtatgatattggaggcaaatattctcacttgccatataacaaatactccgtccttttgccattggtggctaaagaaggaaaactccatttgttgttcaccgtccggtcagagaagctaagaagggcccctggagaagtttgcttccctggaggtaagcgtgaccctacagacatggatgatgcagccacagctctccgggaagcccaggaggaagtgggtctccgtcctcaccaagtggaagttgtctgctgcctggtgccatgtcttattgatacagatacattgataactccatttgtgggtttaatagaccacaacttccaggcccagccgaatcctgctgaagttaaggatgtattcctggtgcctctggcctatttcctgcatccacaggtccatgaccagcattacgtcacacgtcttggtcaccgttttattaatcatatctttgagtacacaaaccctgaagacggtgtcacttaccagatcaagggaatgacggcaaaccttgcagtgttggtggcctttatcattttggaaaaaaaacccacctttgaggttcaatttaatcttaatgatgtattagcatcctctgaagagttattcctgaaggttcataaaaaagctacaagcaggttatgatttactagagcaagagacaaagaactattcacgaggattctgtgtgtgcttattcgtagaacaacaacaatgccagctgttggaatttgacaggtgtgaatattttttctgcagtatgtagttagaatccttgcctcttttccagttgccttctattgtctgaaaaagtaaaagccattcaaaaatgaaaactatgttcatagtgttgcatattttcacccacaatatgttaataatatttttcttacacatataataaagaatatctggcacatactaggcccttaataaagattttttgaat

SEQ ID NO: 5413 - DNA, 558 bp, Homo sapiens
atgtcacgacttggtcttcccgaggagccagtcagaaacagtttgctagatgatgctaaggcccgcttaagaaagtatgatattggaggcaaatattctcacttgccatataacaaatactccgtccttttgccattggtggctaaagaaggaaaactccatttgttgttcaccgtccggtcagagaagacagatacattgataactccatttgtgggtttaatagaccacaacttccaggcccagccgaatcctgctgaagttaaggatgtattcctggtgcctctggcctatttcctgcatccacaggtccatgaccagcattacgtcacacgtcttggtcaccgttttattaatcatatctttgagtacacaaaccctgaagacggtgtcacttaccagatcaagggaatgacggcaaaccttgcagtgttggtggcctttatcattttggaaaaaaaacccacctttgaggttcaatttaatcttaatgatgtattagcatcctctgaagagttattcctgaaggttcataaaaaagctacaagcaggttatga

SEQ ID NO: 5414 - DNA, 899 bp, Homo sapiens
gctctgcgcaagcgcgaccgaccgagcagctccgaggagtccgcccggaaacaaacattccccagggcaatgtcacgacttggtcttcccgaggagccagtcagaaacagtttgctagatgatgctaaggcccgcttaagaaagtatgatattggaggcaaatattctcacttgccatataacaaatactccgtccttttgccattggtggctaaagaaggaaaactccatttgttgttcaccgtccggtcagagaagctaagaagggcccctggagaagtttgcttccctggaggtaagcgtgaccctacagacatggatgatgcagccacagctctccgggaagcccaggaggaagtgggtctccgtcctcaccaagtggaagttgtctgctgcctggtgccatgtcttattgatagatgggggtctcgctatgttgatgaggctggtctcgagctcctggcctcaagtgatcctcccacctcagcctcccaaagtgctgggattacagacagatacattgataactccatttgtgggtttaatagaccacaacttccaggcccagccgaatcctgctgaagttaaggatgtattcctggtgcctctggcctatttcctgcatccacaggtccatgaccagcattacgtcacacgtcttggtcaccgttttattaatcatatctttgagtacacaaaccctgaagacggtgtcacttaccagatcaagggaatgacggcaaaccttgcagtgttggtggcctttatcattttggaaaaaaaacccacctttgaggttcaatttaatcttaatgatgtattagcatcctctgaagagttattcctgaaggttcataaaaaagctacaagcaggttatgatttactagagcaagagaca

SEQ ID NO: 5415 - DNA, 2485 bp, Homo sapiens
aaacttctgactccgcctgggtcgctgactccgcgcggccgggcgggagggaggtcgaggaggccgctcgcacaaagccgcggagccgctgccccctctccccgccccctgcccggccaacgccgaagtgcggagagcagccgcgggccctttaagggccgcgaggtgcgcggtctctttaaggcgggtcctggtggtttctgttttctgaaggaagtgacggggggtgggattgaatgaaaagtgcaaaacacaggctcgcagcgctggagcccggggccgcggagccgggccggggcagcgccgtctccgcctcggggccgccgggggcgccctgctgagcgctacccacgtgcgtccgcgccacctcgcgggcgaccccgcggccaaggcccccggcggagcggctcccgggcgccccgaactagcccccaactttgggcgaagtttgcctgcgcctctccccgcccccacgcggcgcgccggggccgcggacggcagcggcccccggggatgcgccttcccggggtacccctggcgcgccctgcgctgctgctgctgctgccgctgctcgcgccgctgctgggaacgggtgcgccggccgagctgcgggtccgcgtgcggctgccggacggccaggtgaccgaggagagcctgcaggcggacagcgacgcggacagcatcagcctcgagctgcgcaagcccgacggcaccctcgtctccttcaccgccgacttcaagaaggatgtgaaggtcttccgggccctgatcctgggggagctggagaaggggcagagtcagttccaggccctctgctttgtcacccagctgcagcacaatgagatcatccccagtgaggccatggccaagctccggcagaaaaatccccgggcagtgcggcaggcggaggaggttcggggtctggagcatctgcacatggatgtcgctgtcaacttcagccagggggccctgctgagcccccatctccacaacgtgtgtgccgaggccgtggatgccatctacacccgccaggaggatgtccggttctggctggagcaaggtgtggacagttctgtgttcgaggctctgcccaaggcctcagagcaggcggagctgcctcgctgcaggcaggtgggggaccacgggaagccctgcgtctgccgctatggcctgagcctggcctggtacccctgcatgctcaagtactgccacagccgcgaccggcccacgccctacaagtgtggcatccgcagctgccagaagagctacagcttcgacttctacgtgccccagaggcagctgtgtctctgggatgaggatccctacccaggctagggtgggagcaacctggcgggtggctgctctgggcccactgctcttcaccagccactagagggggtggcaacccccacctgaggccttatttccctccctccccactcccctggccctagagcctgggcccctctggccccatctcacatgactgtgaagggggtgtggcatggcagggggtctcatgaaggcacccccattcccaccctgtgccttccttgcgggcagagagggagagaagggctccccagatctacacccctccctcctgcatctcccctggagtgttcacttgcaagctgccaaaacatgatggcctctggttgttctgttgaactccttgaacgtttagaccctaaaaggagtctatacctggacacccacctccccagacacaactcccttccccatgcacacatctggaaggagctggcccctcagtcccttcctactccccaacaaggggctcactatccccaaagaaggagctgttggggacccacgacgcagcccctgtactggattacagcatattctcatctctggccccgaggctgcctgtggggcgagtggagacctcccatcactgagacagatcacagaccacgagtgcctttcccggacctggacgttgcctccagagcaggcaccagctctttccctctctacacagaaatatttttgtaaggttctggggcagggagggagcatgaagtacgaggaaaacttgaattccagatttttagtgcaaagtatttatcatttctaccagaaataaacgttttaagtttttacttgactaatgagacccagagtttggagaaaacttttggccaatgctgccacctgatgtcagaaagtgtccccacaccctagcagtggcctatcttggaacaagaacttcgaaagcacctactgtgtgctcagccatttgaggaaggaaggaggagaaggaagatgttactagggaaggatgagataaaacttctgcacccaagacaatgagacagacatagctgcaaccgtagtaagccagtcagaaatagccagcgcgaaggcaagagatggggtggagattggaaccccgcttcagatctgggctcggctacttacctgctgtgcagccatgggtcaagttgcttgacctctc

SEQ ID NO: 5416 - DNA, 1090 bp, Homo sapiens
aaatgcacaacccggacggaagtgcctctccgacagcagatccaggctcggagctccagacgctgggacaggccgcccgcagaccacccccgccgcgcgcgggacacgacgccccccgcaggacccgcccatcagcccggaaacccctgagctgcttctcccggaggccgatgcccacccgggagcccccaaagactcgcggctcccgggggcacctgcatactcacccgcctgggcctgggcccccgctgcagggactggcgccccgaggcctcaaaaccagcgccccccgccctccgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagcttaagtacccgccagtgagcagtgagagggaacggagccgctatgtcgcagtgttccaggaccagtacggagagttcttggagctccagcacgaggtggggtgtgcacaggcaaagctcaggcagctggaggccctgctgagctccctgcccccaccccaaagccagaaggaggcccaagttgcagcccgggtttggagggagtttgagatgaagcgaatggatcctggcttcctggacaagcaggctcgctgccactacctgaagggtaaactgaggcatctcaagactcagatccagaaattcgatgaccaaggagacagcgagggctccgtgtacttctaagtgcccctgcagatgggcagagggatgcatggggatgcaggtcccttgcatttcttggtatctctcagcttttcctcttgcagctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagacacct

SEQ ID NO: 5417 - DNA, 884 bp, Homo sapiens
gcccagcccacattagcttttgaagggaatatttttatgttcataggaaaaaaagcatagctcctctatataaccaacttcttttagtactactgatagctagtatgttaagtttgatggactaattataatcttttttttatattcctagtatgctggattctatgattggcagatttaacatttatccttctcgtaattcacaaccctaaagttccatttactaataatttataattttgctggaacatgaatttgaatcttacatgcaacaattggattgagagttttgggagggcagtatgtgggacctgttcacatagtccatcagtctagcagccccatctcagtgtggctttgtttttgcaatttgactttgagtttgtggtaactcctgtggtgtaaatcattgcttcaggttctgagcaacagtgtatattatagctgcattgcaggtttcaggatttgcagggtatggggatgtatccaccattattgttaaagatttaccttagcagacacattagtatactcttctatttaaaaatcctttataaaagtggtattatatggctatcctggtattctttcatattgttagtactttgaaatttttgctgatgttcaattagtaaaattaatggcccctaacagcagttgtactgtttgtatgttaaacttgatacatttagaagttaatgttaaagcctaatcctaaatttttaaaaggtgaaaaagtttttactggcaattgggtggccttgggacctgtgtgaagagcatagactgtagtttggtggaaagagcaaagactttgaagttctcggattctgtgtgtattctgctcctagcagagtgacctcaggcaaatgactttataggca

SEQ ID NO: 5418 - DNA, 1767 bp, Homo sapiens
agagttcatctcaaagcctggcaaggattggagaggtcaataagagtcagcgcctttaaaaagaaatctactcactcttctgtgtgcataaggccgagcagaggttcttcgtctcaagaggaactgacttctgttgagcactcaacacgccacagagaccagccatcttgcaacctcacctcacagcatggagagaggagaccaacctaagagaaccaggaatgaaaacattttcaactgcttatacaaaaaccctgaggcaacttttaagctgatttgctttccctggatgggaggtggctccactcattttgccaaatggggccaagatactcatgatttgctggaagagacagcatctcaccatgttgccaaggctggtctcaaactccggcgctcaagtgatcctcctgcttcagcctacccatgtgctggcgtgagccaccgtaggcgtgagccaccgtgcctggccaaaattcttggtctattctggattctaattttttttatgcactccttaaggcttcctggaagagaaagcagagttgaagaacctcttgaaaatgacatctcccagttagttgatgaagttgtttgtgctctgcagccagtcatccaggataaaccatttgcattttttggccacagtatgggatcctacattgcttttaggactgcactaggtctaaaagaaaacaatcaaccagaaccattgcatttatttttgtcaagtgcaactcctgtacattcaaaggcctggcatcgcattcccaaagatgatgaattgtcagaagaacaaataagtcattaccttatggaatttggaggcacccccaagcattttgctgaagccaaggaatttgtgaaacaatgtagtcccatcataagggcagatctgaacattgttagaagttgcacctctaacgtaccatctaaggctgttctttcctgtgacttgacatgttttgttggatctgaagacatagcaaaggacatggaagcctggaaagatgtaaccagtggaaatgctaaaatttaccagcttccagggggtcacttttatcttctggatcctgcgaacgagaaattaatcaagaactacataatcaagtgtctagaagtatcatcgatatccaatttttagatattttccctttcacttttaaaataatcaaagtaatatcatactcttctcagttattcagatatagctcagttttattcagattggaaattacacattttctactgtcagggagattcgttacataaatatatttacgtatctggggacaaaggtcaagccagtaaagaatacttctggcagcactttgggaggccaaggcgggcggatcacgaggtcaggagatcgagaccgtcctggctaacaccgtgaaaccccatctctactaaaaatacacaaaattagccgggcgtggtggtgggcacctgtagtcccagctactcgggaggctgaggcaggagaatggtgtgaacctgggaggtggagcttgcagtgaaccgagatcgctccactgcactccagcctgggtgacagatccagactctgtctcaaaaaaaaaaaaaaaaaaaatacttctggcagagtcttttatcttcctattaaaatctcacttgattctcctttatgggaagtttgtcgacaaaattcatgattagtaaattatccattttttccttcagttagtttaatggtgaagatgattaacaggggaaatgcttgaagtaaatgattgtttcaatggc

SEQ ID NO: 5419 - DNA, 810 bp, Homo sapiens
caatccaaagaaagtcatctttcagattgtctgctcagagttcatctcaaagcctggcaaggattggagaggtcaataagagtcagcgcctttaaaaagaaatctactcactcttctgtgtgcataaggccgagcagaggttcttcgtctcaagaggaactgacttctgttgagcactcaacacgccacagagaccagccatcttgcaacctcacctcacagcatggagagaggagaccaacctaagagaaccaggcaggccaccccttgtgccaccaggctcttcctccatcccaggggctccgataccctgcctttgaatgaaaacattttcaactgcttatacaaaaaccctgaggcaacttttaagctgatttgctttccctggatgggaggtggctccactcattttgccaaatggggccaagatactcatgatttgctggaagtgcactccttaaggcttcctggaagagaaagcagagttgaagaacctcttgaaaatgacatctcccagttagttgatgaagttgtttgtgctctgcagccagtcatccaggataaaccatttgcattttttggccacaggtatttgatatctgttttaaaagacttcaggggagtttcttctatctgaagtttgaggttaatgttattctttgtgttttgtaagatgcatacctttgtattggttagacagcatgttaggtaattatggccatcacaacttttacaattcaccagtttgtatggtaagtatacctattttttttccttttaggcaaataaagtcaacacttgtaaaaccaa

SEQ ID NO: 5420 - DNA, 1675 bp, Homo sapiens
acctcatttcctgtgtcctctctttctttggcaatccaaagaaagtcatctttcagattgtctgctcagagttcatctcaaagcctggcaaggattggagaggtcaataagagtcagcgcctttaaaaagaaatctactcactcttctgtgtgcataaggccgagcagaggttcttcgtctcaagaggaactgacttctgttgagcactcaacacgccacagagaccagccatcttgcaacctcacctcacagcatggagagaggagaccaacctaagagaaccaggaatgaaaacattttcaactgcttatacaaaaaccctgaggcaacttttaagctgatttgctttccctggatgggaggtggctccactcattttgccaaatggggccaagatactcatgatttgctggaagtgcactccttaaggcttcctggaagagaaagcagagttgaagaacctcttgaaaatgacatctcccagttagttgatgaagttgtttgtgctctgcagccagtcatccaggataaaccatttgcattttttggccacagtatgggatcctacattgcttttaggactgcactaggtctaaaagaaaacaatcaaccagaaccattgcatttatttttgtcaagtgcaactcctgtacattcaaaggcctggcatcgcattcccaaagatgatgaattgtcagaagaacaaataagtcattaccttatggaatttggaggcacccccaagcattttgctgaagccaaggaatttgtgaaacaatgtagtcccatcataagggcagatctgaacattgttagaagttgcacctctaacgtaccatctaaggctgttctttcctgtgacttgacatgttttgttggatctgaagacatagcaaaggacatggaagcctggaaagatgtaaccagtggaaatgctaaaatttaccagcttccagggggtcacttttatcttctggatcctgcgaacgagaaattaatcaagaactacataatcaagtgtctagaagtatcatcgatatccaatttttagatattttccctttcacttttaaaataatcaaagtaatatcatactcttctcagttattcagatatagctcagttttattcagattggaaattacacattttctactgtcagggagattcgttacataaatatatttacgtatctggggacaaaggtcaagccagtaaagaatacttctggcagcactttgggaggccaaggcgggcggatcacgaggtcaggagatcgagaccgtcctggctaacaccgtgaaaccccatctctactaaaaatacacaaaattagccgggcgtggtggtgggcacctgtagtcccagctactcgggaggctgaggcaggagaatggtgtgaacctgggaggtggagcttgcagtgaaccgagatcgctccactgcactccagcctgggtgacagatccagactctgtctcaaaaaaaaaaaaaaaaaaaatacttctggcagagtcttttatcttcctattaaaatctcacttgattctcctttatgggaagtttgtcgacaaaattcatgattagtaaattatccattttttccttcagttagtttaatggtgaagatgattaacaggggaaatgcttgaagtaaatgattgtttcaatggc

SEQ ID NO: 5421 - DNA, 551 bp, Homo sapiens
gaacatcagactccaatttcttcagttctgggactctgactggcttccttgctcctcagcctgcagatggcctattgtgagacctcacgttgtcatatggattggagaggtcaataagagtcagcgcctttaaaaagaaatctactcactcttctgtgtgcataaggccgagcagaggttcttcgtctcaagaggaactgacttctgttgagcactcaacacgccacagagaccagccatcttgcaacctcacctcacagcatggagagaggagaccaacctaagagaaccaggaatgaaaacattttcaactgcttatacaaaaaccctgaggcaacttttaagctgatttgctttccctggatgggaggtggctccactcattttgccaaatggggccaagatactcatgatttgctggaagagacagcatctcaccatgttgccaaggctggtctcaaactccggcgctcaagtgatcctcctgcttcagcctacccatgtgctggcgtgagccaccgtaggcgtgagccaccgtgcctggccaaaat

SEQ ID NO: 5422 - DNA, 717 bp, Homo sapiens
tcccatgctggatgcttcccgcccttgaacatcagactccaatttcttcagttctgggactctgactggcttccttgctcctcagcctgcagatggcctattgtgagacctcacgttgtcatatggattggagaggtcaataagagtcagcgcctttaaaaagaaatctactcactcttctgtgtgcataaggccgagcagaggttcttcgtctcaagaggaactgacttctgttgagcactcaacacgccacagagaccagccatcttgcaacctcacctcacagcatggagagaggagaccaacctaagagaaccaggaatgaaaacattttcaactgcttatacaaaaaccctgaggcaacttttaagctgatttgctttccctggatgggaggtggctccactcattttgccaaatggggccaagatactcatgatttgctggaagtgcactccttaaggcttcctggaagagaaagcagagttgaagaacctcttgaaaatgacatctcccagttagttgatgaagttgtttgtgctctgcagccagtcatccaggataaaccatttgcattttttggccacagtatgggatcctacattgcttttaggactgcactaggtctaaaagaaaacaatcaaccagaaccattgcatttatttttgtcaagtgcaactcctgtacattcaaaggcctggcatcgcattcccaaag

SEQ ID NO: 5423 - DNA, 768 bp, Homo sapiens
atgtgacttgcttctccttgccttccaccatgattgtgaggcctccccagctatgtggcactggattggagaggtcaataagagtcagcgcctttaaaaagaaatctactcactcttctgtgtgcataaggccgagcagaggttcttcgtctcaagaggaactgacttctgttgagcactcaacacgccacagagaccagccatcttgcaacctcacctcacagcatggagagaggagaccaacctaagagaaccaggaatgaaaacattttcaactgcttatacaaaaaccctgaggcaacttttaagctgatttgctttccctggatgggaggtggctccactcattttgccaaatggggccaagatactcatgatttgctggaagtgcactccttaaggcttcctggaagagaaagcagagttgaagaacctcttgaaaatgacatctcccagttagttgatgaagttgtttgtgctctgcagccagtcatccaggataaaccatttgcattttttggccacagtatgggatcctacattgcttttaggactgcactaggtctaaaagaaaacaatcaaccagaaccattgcatttatttttgtcaagtgcaactcctgtacattcaaaggcctggcatcgcattcccaaagatgatgaattgtcagaagaacaaataagtcattaccttatggaatttggaggcacccccaagcattttgctgaagccaaggaatttgtgaaacaatgtagtcccatcataagg

SEQ ID NO: 5424 - DNA, 6430 bp, Homo sapiens
gcaggcgcggggcgcggggcaggcagagcgggcgaaggcgcggagctcgcagtgcagcccgcgcttcccagcgtccgtgcccggccgcctgtgcctaccgtgcccgtggcgccatggccgctgccgccctcccgccccggccgctgctccttctgccgctagtgctgctgctgagcggccgccccacgcgcgccgacagtaaggtgtttggggacctggaccaggtgaggatgacctcggagggctccgactgccgttgcaagtgcatcatgcggcccctgagcaaggacgcgtgtagccgagtgcgcagtgggcgggcacgcgtggaggacttctacacggtggagactgtgagctcgggcactgactgccgctgctcctgtaccgcacctccctcctctctcaacccctgtgagaacgagtggaagatggagaaactcaaaaagcaggcgcccgagctcctcaagagcatcaaggccaacctgagccgggagaatgaggtggtgaaggacagcgtgcgccacctcagtgagcagttgaggcactatgagaatcactctgccatcatgctgggcatcaagaaggagctgtcccgcctgggcctccagctgctgcagaaggatgccgccgccgcccctgccacccctgccacgggcactggtagcaaggcccaggacacagctagaggaaaaggcaaggacatcagcaagtatggcagtgtgcagaaaagctttgcagacagaggcctcccaaaacctcccaaggagaagctgcttcaggtggagaagctgagaaaggagagcggcaagggcagtttcctccagcccacagccaagccccgcgccctggcccagcagcaggctgtgatccggggcttcacctactacaaggcaggcaagcaggaggtgaccgaggcggtggcagacaacaccctccagggcacttcctggctggagcaactgccgcccaaggtggagggcaggtccaactccgcagagcccaactccgcagagcaggatgaggctgagcccaggtcctccgagcgagtggacctggcttctggcacccccacttcaatccctgccaccaccaccaccgccaccaccaccccaacccccaccaccagtctcctgcccaccgagccaccttcaggtccagaagtctccagccaaggcagagaggcgagctgtgagggcaccctccgggctgtggacccccctgtgaggcaccacagctatgggcgccacgagggagcctggatgaaggaccctgcagctcgagacgacaggatctatgtcaccaactactactatggaaacagcctggtggagttccgcaacctggaaaacttcaagcaaggccgctggagtaacatgtacaagctaccctacaactggatcggcacaggccacgtggtgtaccagggcgccttctactacaaccgcgccttcaccaagaacatcatcaagtacgacctacggcagcgcttcgtggcctcctgggcgctgctgcccgacgtggtatatgaggacaccacaccttggaagtggcgcggacactcggacattgactttgccgtggacgagagcggcctgtgggtcatctaccccgccgtggacgaccgcgatgaggcccagcccgaggtgatcgtcctgagtcgcttggaccccggcgatctctccgtgcaccgggagaccacgtggaagacacggctgcggcggaactcctacgggaactgcttcctggtgtgcggcatcctgtatgccgtggacacgtacaaccagcaggaaggccaggtcgcctacgctttcgacacgcacacgggcaccgacgcacgcccccagctgccgttcctcaacgagcacgcctacaccacccagatcgactacaaccccaaggagcgggtgctgtacgcctgggacaatggccaccagctcacctacaccctccacttcgtggtctgagtggagacctgtgctccccggagaggggcagcagtgcgggaggggctttgcacagcagctcctgcaactgacccagtccgcaaatatttattgggggccagcccagggctgggactgggcatgaggtggtcaccaggattgagcttcctcagcacccagtgggtaatacttgcttccacttgcagagcaccgtgccaagcacttcccacacacttacccgtttgattctcctagcacctcccttggaggtagagatcatgaacccatttaacagacgaggagacaggctcagagaggcaccgtcccttgcctaacacctcagttgtgatcaggcaggctgtgctctcaggacagccccattttagggatgaggagacttcaccacgccctcccctccctgccctcccccatctccccggtctcccttgttctctcaacccagtctcccttcccagggccactcagaaccagaggtctttagggccagtgtactggtgtggggtggaggccctggctctgcctgccatcctagggccctgttctggctgagctgttggtggccctgggctttgggccccttagccaatgtccttgtctcttgtctttggccagccccctcagcccagcccaccccacccgctgtccggccacattccaaacctctaccgtcacctagctgctgagcagaaaccgcaccccgagagaaaatcccatcctctgttccaaggcccctgtctgctctatgctcatttttattttctcttattcttcatcagtgccgtcatttgtttctgcagcagcagctgagaaggcagccggcagctctgccagggtggggagctgagctgaggctccctctccacccagaagcactggcgttgttcacatagtcaggccttgggtcccctccctggttcatcccagagcctttgggcctggagtccgccttgtcctttttctctgggctttcaaacccacaacctttacacactcagggatacctccgggtctgccatgaataagaccctaggcccaagtctggtgtggtgccaggatggcacagtttccctcttccttgccagccctgacctggtcactgggcaggctggcccagcagcctgggggctgcagaagacatggtgtgagtagttgggtccaggggaggcatcaggccttcttctggttgcaggagagaaccagagggtgggaacggggagggaagaactgagggtctgcagactggacttttcctggctcgacccaggacttgggttgaggatgcacgggggccaccttgcccggggccactggtggctccccagagcctcagacccacacagcccagaggacgaggccttcaagcctgcccctcttctgcttttttagacagtatttttagagctggaaagaaattttctagcccaactccctgtttcatgaaagagaaaagaggctcagaaaagtttagagagcagctcagtgtcacactgggagctgggcacagccgatctccttccagaagggttctgtctgtatcctttattctccgcacatggaggctgccctacctgggaaggcaccccagcacctgtgaaggacatttactgctcatcctcacctgccccctggcccttgctgccttcattctgtcccaatgccagctccctggatgtctgtatgtttgaataccagttgccatgttaggaaggtcagctgcacagccaagagtgtaagagtgtaaagaaatgcctttttttttttttttgagttggagttttgctcttgtcgcccaggctggagtgcagtggcgcgatctcggctcactgcaacctctgccccctgggttcaagcgattctcctgcctcagcctccctagtagctgggactacagcacccaccaccacacccagctaatttttgtatttttagtagagacaggggtttcaccacgttggccaggctggtctcgaactcctgaccttaggtgatccgcccgcctcagcctcccaaagtgttgggattacaggcatgagccactgcgcctggccagcaaatgctttttgtgcagaatacacttctttcaggcattgtcaggtgctgttttgtttaagctctaactcacccctggaatacaggggaatgatgacaaccagcccagccaggcctgactcatcatggtcacatccagcccccacccccggccaactaaccactgcaggctcctcttccagactcaccagggggcctcgaggccccggcatctcccttggccctgggtgtgggttttacaagactgtgtctttcatgacatcatagcccaaccatgtgagaagaaggagaaggcccccctttcttcattaatctgaaaaaaaggaaagtgagaataggctgatttttaaaagttaaggggcaagcagcattgcattctgggggaacgatcctggccacagccgccaaacaaacattcactaggcctcttctgttttcatacccttgtaagtgggttatgtggtgggtatggtcagttttttcttttttcttttcttttcttttttttgagacagagtttcgcttttgttgcccgggctggaatgcaatggcgcgattcagctcactgcaatctccgcctcccgggttcaagtgattctcctgccttagcctcctgaaaagctgggattacagggccctgccaccaagcccagctaattgtatttttagtagagacaggatttcaccatgttggccaggccagtctcaaactcctgacctcaggtgatccacctgcctcagcctcccagactgttgggattacaggcatgagccaccacgcctggccagtttcttcattttacatatggtcacattggcgcctagaacagttaggtcgctcgtcacataggcagttaagtggagaaccaggtttcaaaatcaggtaagaaaaccatcatcattaactgagcaccagctgtgctaagcctgccacgggcgtatccttgcagcctcacaacagtgggaggtctgtatcctgaatgtcctcattttacagatgaggacattgaggagaagagacttacccaggctcacacagcagctcagcctgttccaggcgctggtcagtgcgtgttctttgccaccagcctgtcactccagtggcagctccagaaacggaggctgttgcttttatccctaaactgcatccacagagaagccccaagaaggaggttggggccagctcataaaaagcctgaatgccaagccaaggagtggatgcctccagtcatatttagaacaaagtcaagtataaatttacagagaaaaaattctaagacagttggatgttgtcctgttggtgaggaagggaaaggtttttcttgtagggaactggaaccagcccacaactgcacacttgtgagctgtcatggaaacctgatccccaacagcttttgaggttgtttgtttgtttgtttgtttacctgtcttgggctttgttgcttttggcaaaaggtacttcaaacaagggagggcctggactgagggggaccaggtcttcttgctgacctcgtctacaaaggcaaaggaaggcaaaggaagctgtctcgggtgtttctgaacaacgtgactcatgaggggctttggctacctcttgcgttccccctagagatgtccaggccttacatttaatcggctttctctgcggtggggtagagaatggagctcccgccttgcgggcagtgctaaaggtggagctgggggattttcctgggaatgatttgagggctcttgaaagcccatgtgttccaaagcgtctttaactctgggatagcattggaagccgctgtcatgacaggacatggcactggatggctggcagagagccctggctgggagttagggagccctgggttggaatccagccccacctcttttatgccacaggtttggtcaagttctctcccgctcagggtagggctgtgaactccctcttacagctaagaacatgcagcttagtgaggacaagacccttctagagctttacccctaatccccccccaggagccccgaggccggcattattcctccccattacaggtgatgagcctcaaattcagagagcttaagcaacctgctcagggtcacgtctccaacaggcagtagagtcaaggtataaaccaggtctgtttttgtaccagagtcccagactaactgttggtaggaatcttgtaaccagtcatgttttcttccttgttttggccgctgggaagctcaaagtcaaattcgagacccttttttttccaattgtgctgagtctcctactagactcgcttcattctagctttctgcttttacctttaccctaatctttttatttttatgctattgtactttatttttgtaagttgctgagatatctgttttgcaacaagatgggctatatctaaataaagacatgatcaaaggtttgattt

SEQ ID NO: 5425 - DNA, 2078 bp, Homo sapiens
actatattgaatagaagcgaagagacagagtatacttgtcttgttcctaatccagaagaaaagtttgaatcttttaccattgagtaagcttgagtgcccaagggtttgataaatgtggaaaataaccgctgttcgaatatcctgttggcctgctgaagaaatgactggctgaggctgtaaagaaatcttgtggtcattctcatggaaagaggattggagccccgattctttgatctcattattgaccagttgattgagaagactgtcctcctgtccccacccaatcacaataagtggctctgaaatcacatgaagctgtggatggagagtcacctgatagtcccagaaacccgtcccagcccaaggatgatgagtaaccagacgttggtaaccgagttcatcctgcagggcttttcggagcacccagaataccgggtgttcttattcagctgtttcctcttcctctactctggggccctcacaggtaatgtcctcatcaccttggccatcacgttcaaccctgggctccacgctcctatgtactttttcttactcaacttggctactatggacattatctgcacctcttccatcatgcccaaggcgctggccagtctggtgtcggaagagagctccatctcctacgggggctgcatggcccagctctatttcctcacgtgggctgcatcctcagagctgctgctcctcacggtcatggcctatgaccggtacgcagccatctgccacccgctgcattacagcagcatgatgagcaaggtgttctgcagcgggctggccacagccgtgtggctgctctgcgccgtcaacacggccatccacacggggctgatgctgcgcttggatttctgtggccccaatgtcattatccatttcttctgcgaggtccctcccctgctgcttctctcctgcagctccacctacgtcaacggtgtcatgattgtcctggcggatgctttctacggcatagtgaacttcctgatgaccatcgcgtcctatggcttcatcgtctccagcatcctgaaggtgaagactgcctgggggaggcagaaagccttctccacctgctcttcccacctcaccgtggtgtgcatgtattacaccgctgtcttctacgcctacataagcccggtctctggctacagcgcagggaagagcaagttggctggcctgctgtacactgtgctgagtcctaccctcaaccccctcatctatactttgagaaacaaggaggtcaaagcagccctcaggaagcttttccctttcttcagaaattaacttgtgtcttctgaagtttttgtccttggagactgcagttttagtggagtctgatgagcaagtttctggactgggaggtaaatagacttgttttttctaacccagcagaacctgtgcatggatgagctgggagtgctggttccctgagacttggtgatggggggattgcggtaggtgtgacccaccagcctctgagacaccagatctcttggtctgactccaaggtggtgtcagtgctgagttggcagagaaacacagggcctaggaggagaaaagtgttccttgtgttttcaactcatagccacatcaaacattttccttttgtatgtacaacactcagggtgtaaattctaaaatcacacctagaattcagctgtgtgggtctaaaaagttaggcagaattgtggaccccacagcccctgaagggttgtcagactgaagctttgttttaaggtgaccactggcctctaggaaaccttctacccccattatcttacctcaactgtttcctctggagccacttggacttcaaaaatagtttgattttaatgcaaactgttgtttctgcttttgtcttttcttcttactaacacttcagattctgagtatctgacctacctaattggcctggagcgaggacagctgccatgagtcagctctaataagttaaacggcattgtagtaaggcattgctatccttccattgtttcagataaaactgggtgaacgaatcctctgtgtctaataaagacaggtcttgtgcttgtgctccatgctattac

SEQ ID NO: 5426 - DNA, 900 bp, Homo sapiens
atgggacaaaatcaaaccagcatctcagacttcctgctcctgggcctgcccatccaaccagagcagcaaaacctgtgctatgccctgttcttggccatgtatcttaccaccctcctggggaacctcctcatcattgtcctcattcgactggactcccatctccacacgcctgtgtatttgtttctcagcaacttgtccttctctgacctctgcttttcctcagtcacaatgcccaaattgctgcagaacatgcagaaccaagacccatccatcccctatgcagactgcctgacccaaatgtacttcttcttgtatttttcggatctagagagcttcctccttgtggccatggcctatgaccgctatgtggccatctgcttccccatgcactacaccgccatcatgagccccatgctctgtctctccgtggtggcgctgtcctgggtgctgaccaccttccatgccatgttacacactttactcatggccaggttgtgtttttgtgcagacaatgtgatcccccactttttctgtgatatgtctgctctgctgaagctggcctgctctgacactcgagttaatgaatgggtgatatttatcatgggagggctcattcttgtcatcccattcctactcatccttgggtcctatgcaagaattgtctcctccatcctcaaggtcccttcttctaagggtatctgcaaggccttctctacttgtggctcccacctctctgtggtgtcactgttctatgggaccgttattggtctctacttatgcccatcagctaatagttctactctaaaggacactgtcatggctatgatgtacactgtggtgacccctatgctgacccccttcatctacagcctgaggaacagagacatgaagggagccctg

SEQ ID NO: 5427 - DNA, 2482 bp, Homo sapiens
caactcttaattggccctcaaaacttagcctacttgcttctatcttcagaaagccttccccgaccttgatcccacaccttctgccccacaaccccaggctgggtttggtccttctctgctcccatggcacctacttccttccctattaccatttaccacattttcactaccaactcctgaatgacttgatgaaactactatttaaggaaggcaataagtgaagaatatataagaattatccgaggaacagttgctctaataacgttaggcttggtatagaagatgcagagacatgctaaaatttctcccccaattattgccaagcagaaacttggacgatcgacatggaaattgtctccacaggaaacgaaactattactgaatttgtcctccttggcttctatgacatccctgaactgcatttcttgttttttattgtattcactgctgtctatgtcttcatcatcatagggaatatgctgattattgtagcagtggttagctcccagaggctccacaaacccatgtatattttcttggcgaatctgtccttcctggatattctctacacctccgcagtgatgccaaaaatgctggagggcttcctgcaagaagcaactatctctgtggctggttgcttgctccagttctttatcttcggctctctagccacagctgaatgcttactgctggctgtcatggcatatgaccgctacctggcaatttgctacccactccactacccactcctgatggggcccagacggtacatggggctggtggtcacaacctggctctctggatttgtggtagatggactggttgtggccctggtgacccagctgaggttctgtggccccaaccacattgaccagttttactgtgactttatgcttttcgtgggcctggcttgctcggatcccagagtggctcaggtgacaactctcattctgtctgtgttctgcctcactattccttttggactgattctgacatcttatgccagaattgtggtggcagtgctgagagttcctgctggggcaagcaggagaagggctttctccacatgctcctcccacctagctgtagtgaccacattctatggaacgctcatgatcttttatgttgcaccctctgctgtccattcccagctcctctccaaggtcttctccctgctctacactgtggtcacccctctcttcaatcctgtgatctataccatgaggaacaaggaggtgcatcaggcacttcggaagattctctgtatcaaacaaactgaaacacttgattgaaggagagtaatgaagatgttattttggacttcggacacctccactggggactcttccaggatgggttggagaggagtaactttgtcttattcgaccattctctttgaactcttctgcagttatactaaaaatgaaaatgatagggcaacaattttttaacttttattttaagttcaagggtacatgtgcaggtttgttacataggtaaacttgtgtcatgggggtttactgtacagattatttcatcacccaggtattaagcctagtactcattaatcatttttcctgatcttctccctcctcccaacctccaccctcaagtaggattcagtgtgttgttcccctctatgtatccatatgttttcataatttagctcccacttatgagtgaagacatacggtatttgattttctgttcctgtgttagtttgcgaaggatagtagcctccaattccatccatgtcaaataatcaaaattatttaaactttgattagttctttattaaatatgtcataaatatttaaaaataatacagcaataccaaaataaacctagaaatattgttttttatattattgttgtatgacatttaaaaatttctttctatgtgtatttatatttatacatacaagttggatcatggagtttgtaatctggttttccactgaacactgtgtcacgaacaactttttctattaacaagcatctatttctttattcttctgggcttcatcgtatggctaaacatgatttgttattctattttgggaatttttagttgtattctattcttttactgtacattgtttacatctggattttcctgtaataaacttttagcacctaaattgcaagatctaaggatatgtgtttttaaaaatctaaagctgaattccttttcttttaaacttcttttcttgtagaacatttcaaacatacataaaagagaagagcacagtgaacccccatgtactccatgtagccaccatccagcttcaacatcaacattttgctaatcttattttaattagctacagctccttgtttgttagttttcatggaaaattttagggcaaattccagatgttgtataactattatgttgtgtaagttatgtatgtacatattccacatatgtatttagtataatctgtgactaataaagacattttaaaaaaccatgcccaca

SEQ ID NO: 5428 - DNA, 2611 bp, Homo sapiens
catcctagcagtgaatggaaacacacatatggggagaaactaaggctccctactaaaaacgtgcaacatgtgactgggacatcttgttgagctcaagcagggagggagctgaaggtaggaaattccaacattctgaagtcttcagcaaatcttagcagatcatctcctcctcacagtcctgtctttagagaacagggtcgatatttcgggaatcctatagaaagactccaagcctcagaatgagtttggaccagataaaataatctagagttaaagatggcccacatagggagtgccagattcactcacaaggaaatgcagatgggatcaaaggttaataaacacatattgctttgaatagcatatgaaaaccttccagcagctctaataacgttaggcttggtatagaagatgcagagacatgctaaaatttctcccccaattattgccaagcagaaacttggacgatcgacatggaaattgtctccacaggaaacgaaactattactgaatttgtcctccttggcttctatgacatccctgaactgcatttcttgttttttattgtattcactgctgtctatgtcttcatcatcatagggaatatgctgattattgtagcagtggttagctcccagaggctccacaaacccatgtatattttcttggcgaatctgtccttcctggatattctctacacctccgcagtgatgccaaaaatgctggagggcttcctgcaagaagcaactatctctgtggctggttgcttgctccagttctttatcttcggctctctagccacagctgaatgcttactgctggctgtcatggcatatgaccgctacctggcaatttgctacccactccactacccactcctgatggggcccagacggtacatggggctggtggtcacaacctggctctctggatttgtggtagatggactggttgtggccctggtgacccagctgaggttctgtggccccaaccacattgaccagttttactgtgactttatgcttttcgtgggcctggcttgctcggatcccagagtggctcaggtgacaactctcattctgtctgtgttctgcctcactattccttttggactgattctgacatcttatgccagaattgtggtggcagtgctgagagttcctgctggggcaagcaggagaagggctttctccacatgctcctcccacctagctgtagtgaccacattctatggaacgctcatgatcttttatgttgcaccctctgctgtccattcccagctcctctccaaggtcttctccctgctctacactgtggtcacccctctcttcaatcctgtgatctataccatgaggaacaaggaggtgcatcaggcacttcggaagattctctgtatcaaacaaactgaaacacttgattgaaggagagtaatgaagatgttattttggacttcggacacctccactggggactcttccaggatgggttggagaggagtaactttgtcttattcgaccattctctttgaactcttctgcagttatactaaaaatgaaaatgatagggcaacaattttttaacttttattttaagttcaagggtacatgtgcaggtttgttacataggtaaacttgtgtcatgggggtttactgtacagattatttcatcacccaggtattaagcctagtactcattaatcatttttcctgatcttctccctcctcccaacctccaccctcaagtaggattcagtgtgttgttcccctctatgtatccatatgttttcataatttagctcccacttatgagtgaagacatacggtatttgattttctgttcctgtgttagtttgcgaaggatagtagcctccaattccatccatgtcaaataatcaaaattatttaaactttgattagttctttattaaatatgtcataaatatttaaaaataatacagcaataccaaaataaacctagaaatattgttttttatattattgttgtatgacatttaaaaatttctttctatgtgtatttatatttatacatacaagttggatcatggagtttgtaatctggttttccactgaacactgtgtcacgaacaactttttctattaacaagcatctatttctttattcttctgggcttcatcgtatggctaaacatgatttgttattctattttgggaatttttagttgtattctattcttttactgtacattgtttacatctggattttcctgtaataaacttttagcacctaaattgcaagatctaaggatatgtgtttttaaaaatctaaagctgaattccttttcttttaaacttcttttcttgtagaacatttcaaacatacataaaagagaagagcacagtgaacccccatgtactccatgtagccaccatccagcttcaacatcaacattttgctaatcttattttaattagctacagctccttgtttgttagttttcatggaaaattttagggcaaattccagatgttgtataactattatgttgtgtaagttatgtatgtacatattccacatatgtatttagtataatctgtgactaataaagacattttaaaaaaccatgcccaca

SEQ ID NO: 5429 - DNA, 2229 bp, Homo sapiens
ctctaataacgttaggcttggtatagaagatgcagagacatgctaaaatttctcccccaattattgccaagcagaaacttggacgatcgacatggaaattgtctccacaggaaacgaaactattactgaatttgtcctccttggcttctatgacatccctgaactgcatttcttgttttttattgtattcactgctgtctatgtcttcatcatcatagggaatatgctgattattgtagcagtggttagctcccagaggctccacaaacccatgtatattttcttggcgaatctgtccttcctggatattctctacacctccgcagtgatgccaaaaatgctggagggcttcctgcaagaagcaactatctctgtggctggttgcttgctccagttctttatcttcggctctctagccacagctgaatgcttactgctggctgtcatggcatatgaccgctacctggcaatttgctacccactccactacccactcctgatggggcccagacggtacatggggctggtggtcacaacctggctctctggatttgtggtagatggactggttgtggccctggtgacccagctgaggttctgtggccccaaccacattgaccagttttactgtgactttatgcttttcgtgggcctggcttgctcggatcccagagtggctcaggtgacaactctcattctgtctgtgttctgcctcactattccttttggactgattctgacatcttatgccagaattgtggtggcagtgctgagagttcctgctggggcaagcaggagaagggctttctccacatgctcctcccacctagctgtagtgaccacattctatggaacgctcatgatcttttatgttgcaccctctgctgtccattcccagctcctctccaaggtcttctccctgctctacactgtggtcacccctctcttcaatcctgtgatctataccatgaggaacaaggaggtgcatcaggcacttcggaagattctctgtatcaaacaaactgaaacacttgattgaaggagagtaatgaagatgttattttggacttcggacacctccactggggactcttccaggatgggttggagaggagtaactttgtcttattcgaccattctctttgaactcttctgcagttatactaaaaatgaaaatgatagggcaacaattttttaacttttattttaagttcaagggtacatgtgcaggtttgttacataggtaaacttgtgtcatgggggtttactgtacagattatttcatcacccaggtattaagcctagtactcattaatcatttttcctgatcttctccctcctcccaacctccaccctcaagtaggattcagtgtgttgttcccctctatgtatccatatgttttcataatttagctcccacttatgagtgaagacatacggtatttgattttctgttcctgtgttagtttgcgaaggatagtagcctccaattccatccatgtcaaataatcaaaattatttaaactttgattagttctttattaaatatgtcataaatatttaaaaataatacagcaataccaaaataaacctagaaatattgttttttatattattgttgtatgacatttaaaaatttctttctatgtgtatttatatttatacatacaagttggatcatggagtttgtaatctggttttccactgaacactgtgtcacgaacaactttttctattaacaagcatctatttctttattcttctgggcttcatcgtatggctaaacatgatttgttattctattttgggaatttttagttgtattctattcttttactgtacattgtttacatctggattttcctgtaataaacttttagcacctaaattgcaagatctaaggatatgtgtttttaaaaatctaaagctgaattccttttcttttaaacttcttttcttgtagaacatttcaaacatacataaaagagaagagcacagtgaacccccatgtactccatgtagccaccatccagcttcaacatcaacattttgctaatcttattttaattagctacagctccttgtttgttagttttcatggaaaattttagggcaaattccagatgttgtataactattatgttgtgtaagttatgtatgtacatattccacatatgtatttagtataatctgtgactaataaagacattttaaaaaaccatgcccaca

SEQ ID NO: 5430 - DNA, 1033 bp, Homo sapiens
gccggaaggattctgattgcgattagtgttccatagattattttgtcttttgtctgaagtgatgctgaatacaacctcagtcaccgaatttctcctcttgggagtgacagacattcaagaactgcagccttttctcttcgtggttttcctcaccatctacttcatcagtgtgactgggaatggagccgttctgatgattgtcatctccgatcctagactccattcccttatgtatttcttcctgggaaacctgtcctacctggatatctgttactctacggtgacactgccaaaaatgctgcagaactttctctctacacacaaagcaatttctttcttgggatgcataagccagcttcatttcttccacttcctgggcagcacggagtccatgttgttcgccgtgatggcatttgacctctctgtggctatctgcaagccacttcgctacactgtcatcatgaaccctcagctctgtacccagatggccatcacaatctgggtcattggttttttccatgccctgctgcactccgtaatgacttctcgcttgaacttctgtggttccaaccgtatccatcattttctctgtgatattaagccattgctaaagctggcctgtgggaacactgagcttaatcagtggctactcagtactgtcacggggacaattgccatgggccccttctttctgacacttctctcctatttctacattatcacttatctcttcttcaagacccgttcttgtagcatgctctgtaaagcactgtccacttgtgcctcccacttcatggtagttattcttttctatgcacctgttcttttcacctatatccatcctgcgttagagagcttcatggaccaggaccggattgttgccatcatgtacactgtggtcactcctgtactaaacccactgatctatactttgaggaacaaggaagtgaagggggccttgggtagagtgatcagaaggctttgatttgaataaaccagagaactctactgaggcataaataaccagcaatga

SEQ ID NO: 5431 - DNA, 1033 bp, Homo sapiens; identical to SEQ ID NO: 5430

SEQ ID NO: 5432 - DNA, 1033 bp, Homo sapiens; identical to SEQ ID NO: 5430

SEQ ID NO: 5433 - DNA, 2011 bp, Homo sapiens
aaactgtgctgccacaggcccatttttcggtgagaaagctagaaaagttggaggacttattctaagtcacgctgttaccagcctagaggggcatctcagtgttttgagcagcttctcgttttgtgagctttgtggatgagtgagcaatggagaatgtcactacaatgaatgagtttcttctacttggcctgactggtgttcaggagctgcagcctttcttctttgggattttcttaatcatttacctgataaacttgattggaaatggatctatattggtgatggttgttttggaaccacaactccactcccctatgtatttttttctgggaaacctttcttgtctggatatttcttattcttcagtgacactgcccaagctgctcgtaaacctcgtgtgcagtcgcagggctatatcttttctaggctgtatcatccagctacacttcttccactttttgggaagcacagaggccattttactggctatcatggcctttgaccgttttgttgccatctgcaatcctcttcgctacactgtcatcatgaacccccaggtgtgtattctgttggcagctgcggcctggctcatcagcttcttttacgctctgatgcattctgtcatgactgcacacctgagtttttgtggctctcagaaactcaatcacttcttctacgatgtcaagccgctcttagaattggcctgtagtgacacattactcaatcaatggcttctttccattgtcacaggcagcatatccatgggagctttctttctgactcttctctcctgcttctatgtaattggcttccttctgtttaagaacaggtcctgcagaatactccacaaggctctgtccacttgtgcctcccattttatggtggtatgtcttttctatggacctgtgggcttcacatatattcgtcctgcttcagccacctccatgattcaggaccggataatggccatcatgtatagcgccgtcacccctgtactgaatccactaatctacacccttaggaacaaagaagtgatgatggctctgaagaaaatctttggtaggaagttgtttaaagactggcagcaacaccactaggactaatgagggatatctgatttctattaagactgatttccatcacttcactgtaagaaatgatttgtttacctggtttatatttttctttcaaaaattttgagcacatattatattaggcagtgtagtaggttcaagaaacacaggagcaagcaaaacaaattccataatgtcatcaaacataaagtttaatgtgatggaggccccaaataaccaaacgcgtaagtacatatgtcaggataattcggtggcaaggagaactaaggaggtaggaagtatggggagggttagagtaggaatctgctgtgtaaaaaagaatgtggcatttctcctaggacaaaaacctttggaattttccaagtaatagaagtatcttactgaaattccatatgagataatctttatttttgcctattttttttccttttgtgtttccttcagcaggaatgtactgatgataatttttctcacaacagtttttatctagaatatcatttttgttaatcttaattcttgaagagaatttttaatgggtatttaattttagggagagatttttctagccattgaaaatatcttgtttttccccagcttattgaagtataattaacaaataaaaattgcatatatttaggcttcacaacatgatgctttagtatatgtatacattgtgaagagactaccacaatcaagctaaacctacattactgtccctgcattagtttactgttgaatactagaagttcttcgttctatctaactgcattttcatacccattaagccaatgtgacaagctctttgttttagttggagtgtttgcacaatttaaatttgataaatttttgatagaattaaatttaaatttatcctccaactaaatttttgatagaattaaatttaaatttgtcctcca

SEQ ID NO: 5434 - DNA, 2011 bp, Homo sapiens
aaactgtgctgccacaggcccatttttcggtgagaaagctagaaaagttggaggacttattctaagtcacgctgttaccagcctagaggggcatctcagtgttttgagcagcttctcgttttgtgagctttgtggatgagtgagcaatggagaatgtcactacaatgaatgagtttcttctacttggcctgactggtgttcaggagctgcagcctttcttctttgggattttcttaatcatttacctgataaacttgattggaaatggatctatattggtgatggttgttttggaaccacaactccactcccctatgtatttttttctgggaaacctttcttgtctggatatttcttattcttcagtgacactgcccaagctgctcgtaaacctcgtgtgcagtcgcagggctatatcttttctaggctgtatcatccagctacacttcttccactttttgggaagcacagaggccattttactggctatcatggcctttgaccgttttgttgccatctgcaatcctcttcgctacactgtcatcatgaacccccaggtgtgtattctgttggcagctgcggcctggctcatcagcttcttttacgctctgatgcattctgtcatgactgcacacctgagtttttgtggctctcagaaactcaatcacttcttctacgatgtcaagccgctcttagaattggcctgtagtgacacattactcaatcaatggcttctttccattgtcacaggcagcatatccatgggagctttctttctgactcttctctcctgcttctatgtaattggcttccttctgtttaagaacaggtcctgcagaatactccacaaggctctgtccacttgtgcctcccattttatggtggtatgtcttttctatggacctgtgggcttcacatatattcgtcctgcttcagccacctccatgattcaggaccggataatggccatcatgtatagcgccgtcacccctgtactgaatccactaatctacacccttaggaacaaagaagtgatgatggctctgaagaaaatctttggtaggaagttgtttaaagactggcagcaacaccactaggactaatgagggatatctgatttctattaagactgatttccatcacttcactgtaagaaatgatttgtttacctggtttatatttttctttcaaaaattttgagcacatattatattaggcagtgtagtaggttcaagaaacacaggagcaagcaaaacaaattccataatgtcatcaaacataaagtttaatgtgatggaggccccaaataaccaaacgcgtaagtacatatgtcaggataattcggtggcaaggagaactaaggaggtaggaagtatggggagggttagagtaggaatctgctgtgtaaaaaagaatgtggcatttctcctaggacaaaaacctttggaattttccaagtaatagaagtatcttactgaaattccatatgagataatctttatttttgcctattttttttccttttgtgtttccttcagcaggaatgtactgatgataatttttctcacaacagtttttatctagaatatcatttttgttaatcttaattcttgaagagaatttttaatgggtatttaattttagggagagatttttctagccattgaaaatatcttgtttttccccagcttattgaagtataattaacaaataaaaattgcatatatttaggcttcacaacatgatgctttagtatatgtatacattgtgaagagactaccacaatcaagctaaacctacattactgtccctgcattagtttactgttgaatactagaagttcttcattctatctaactgcattttcatacccattaagccaatgtgacaagctctttgtttcagttggagtgtttgcacaatttaaatttgataaatttttgatagaattaaatttaaatttatcctccaactaaatttttgatagaattaaatttaaatttgtcctcca

SEQ ID NO: 5435 - DNA, 1869 bp, Homo sapiens
agcaatggagaatgtcactacaatgaatgagtttcttctacttggcctgactggtgttcaggagctgcagcctttcttctttgggattttcttaatcatttacctgataaacttgattggaaatggatctatattggtgatggttgttttggaaccacaactccactcccctatgtatttttttctgggaaacctttcttgtctggatatttcttattcttcagtgacactgcccaagctgctcgtaaacctcgtgtgcagtcgcagggctatatcttttctaggctgtatcatccagctacacttcttccactttttgggaagcacagaggccattttactggctatcatggcctttgaccgttttgttgccatctgcaatcctcttcgctacactgtcatcatgaacccccaggtgtgtattctgttggcagctgcggcctggctcatcagcttcttttacgctctgatgcattctgtcatgactgcacacctgagtttttgtggctctcagaaactcaatcacttcttctacgatgtcaagccgctcttagaattggcctgtagtgacacattactcaatcaatggcttctttccattgtcacaggcagcatatccatgggagctttctttctgactcttctctcctgcttctatgtaattggcttccttctgtttaagaacaggtcctgcagaatactccacaaggctctgtccacttgtgcctcccattttatggtggtatgtcttttctatggacctgtgggcttcacatatattcgtcctgcttcagccacctccatgattcaggaccggataatggccatcatgtatagcgccgtcacccctgtactgaatccactaatctacacccttaggaacaaagaagtgatgatggctctgaagaaaatctttggtaggaagttgtttaaagactggcagcaacaccactaggactaatgagggatatctgatttctattaagactgatttccatcacttcactgtaagaaatgatttgtttacctggtttatatttttctttcaaaaattttgagcacatattatattaggcagtgtagtaggttcaagaaacacaggagcaagcaaaacaaattccataatgtcatcaaacataaagtttaatgtgatggaggccccaaataaccaaacgcgtaagtacatatgtcaggataattcggtggcaaggagaactaaggaggtaggaagtatggggagggttagagtaggaatctgctgtgtaaaaaagaatgtggcatttctcctaggacaaaaacctttggaattttccaagtaatagaagtatcttactgaaattccatatgagataatctttatttttgcctattttttttccttttgtgtttccttcagcaggaatgtactgatgataatttttctcacaacagtttttatctagaatatcatttttgttaatcttaattcttgaagagaatttttaatgggtatttaattttagggagagatttttctagccattgaaaatatcttgtttttccccagcttattgaagtataattaacaaataaaaattgcatatatttaggcttcacaacatgatgctttagtatatgtatacattgtgaagagactaccacaatcaagctaaacctacattactgtccctgcattagtttactgttgaatactagaagttcttcgttctatctaactgcattttcatacccattaagccaatgtgacaagctctttgttttagttggagtgtttgcacaatttaaatttgataaatttttgatagaattaaatttaaatttatcctccaactaaatttttgatagaattaaatttaaatttgtcctcca

SEQ ID NO: 5436 - DNA, 1869 bp, Homo sapiens
agcaatggagaatgtcactacaatgaatgagtttcttctacttggcctgactggtgttcaggagctgcagcctttcttctttgggattttcttaatcatttacctgataaacttgattggaaatggatctatattggtgatggttgttttggaaccacaactccactcccctatgtatttttttctgggaaacctttcttgtctggatatttcttattcttcagtgacactgcccaagctgctcgtaaacctcgtgtgcagtcgcagggctatatcttttctaggctgtatcatccagctacacttcttccactttttgggaagcacagaggccattttactggctatcatggcctttgaccgttttgttgccatctgcaatcctcttcgctacactgtcatcatgaacccccaggtgtgtattctgttggcagctgcggcctggctcatcagcttcttttacgctctgatgcattctgtcatgactgcacacctgagtttttgtggctctcagaaactcaatcacttcttctacgatgtcaagccgctcttagaattggcctgtagtgacacattactcaatcaatggcttctttccattgtcacaggcagcatatccatgggagctttctttctgactcttctctcctgcttctatgtaattggcttccttctgtttaagaacaggtcctgcagaatactccacaaggctctgtccacttgtgcctcccattttatggtggtatgtcttttctatggacctgtgggcttcacatatattcgtcctgcttcagccacctccatgattcaggaccggataatggccatcatgtatagcgccgtcacccctgtactgaatccactaatctacacccttaggaacaaagaagtgatgatggctctgaagaaaatctttggtaggaagttgtttaaagactggcagcaacaccactaggactaatgagggatatctgatttctattaagactgatttccatcacttcactgtaagaaatgatttgtttacctggtttatatttttctttcaaaaattttgagcacatattatattaggcagtgtagtaggttcaagaaacacaggagcaagcaaaacaaattccataatgtcatcaaacataaagtttaatgtgatggaggccccaaataaccaaacgcgtaagtacatatgtcaggataattcggtggcaaggagaactaaggaggtaggaagtatggggagggttagagtaggaatctgctgtgtaaaaaagaatgtggcatttctcctaggacaaaaacctttggaattttccaagtaatagaagtatcttactgaaattccatatgagataatctttatttttgcctattttttttccttttgtgtttccttcagcaggaatgtactgatgataatttttctcacaacagtttttatctagaatatcatttttgttaatcttaattcttgaagagaatttttaatgggtatttaattttagggagagatttttctagccattgaaaatatcttgtttttccccagcttattgaagtataattaacaaataaaaattgcatatatttaggcttcacaacatgatgctttagtatatgtatacattgtgaagagactaccacaatcaagctaaacctacattactgtccctgcattagtttactgttgaatactagaagttcttcattctatctaactgcattttcatacccattaagccaatgtgacaagctctttgtttcagttggagtgtttgcacaatttaaatttgataaatttttgatagaattaaatttaaatttatcctccaactaaatttttgatagaattaaatttaaatttgtcctcca

SEQ ID NO: 5437 - DNA, 1002 bp, Homo sapiens
tcagatcacagatttccctgccaaatggacaatctcacaaaagtgacagaattcctgctgatggagttttctggtatctgggagctgcaggtgctgcacgccgggctgtttctgctgatttatctggcagtgctggtggggaacctgctcatcattgcagtcatcactctcgatcagcatcttcacacacccatgtacttcttcctgaagaacctctccgttttggatctgtgctacatctcagtcactgtgcctaaatccatccgtaactccctgactcgcagaagctccatctcttatcttggctgtgtggctcaagtctattttttctctgcctttgcatctgctgagctggccttccttactgtcatgtcttatgaccgctatgttgccatttgccaccccctccaatacagagccgtgatgacatcaggagggtgctatcagatggcagtcaccacctggctaagctgcttttcctacgcagccgtccacactggcaacatgtttcgggagcacgtttgcagatccagtgtgatccaccagttcttccgtgacatccctcatgtgttggccctggtttcctgtgaggttttctttgtagagtttttgaccctggccctgagctcatgcttggttctgggatgctttattctcatgatgatctcctatttccaaatcttctcaacggtgctcagaatcccttcaggacagagtcgagcaaaagccttctccacctgctccccccagctcattgtcatcatgctctttcttaccacagggctctttgctgccttaggaccaattgcaaaagctctgtccattcaggatttagtgattgctctgacatacacagttttgcctcccttcctcaatcccatcatatatagtcttaggaataaggagattaaaacagccatgtggagactctttgtgaagatatattttctgcaaaagtagaacatcctggtctttactatagaagatctgcaacaaaacccc

SEQ ID NO: 5438 - DNA, 1117 bp, Homo sapiens
gcattttcttcctactgtctttggcttcctaaacagagtcacacttggtatcttcagagagactatggtcaatttgacttcaacgagtggattccttcttatggggttttctgatgagcgtaagcttcagattttacatgcattggtatttctggtgacatacctgctggccttgacaggcaacctcctcattatcaccatcattaccgtggaccgtcgtctccattcccccatgtattactttttaaagcacctctctcttctggacctctgcttcatctctgtcacagtcccccagtccattgcaaattcacttatgggcaacggttacatttctcttgttcagtgcattcttcaggttttcttcttcatagctctggcctcatcagaagtggccattctcacagtgatgtcttatgacaggtacgcagcaatctgtcaaccacttcattatgagactattatggatccccgtgcctgtaggcatgcagtgatagctgtgtggattgctgggggcctctctgggctcatgcatgctgccattaacttctccatacctctctgtgggaagagagtcattcaccaattcttctgtgatgttcctcagatgctgaaactagcctgttcttatgaattcattaatgagattgcactggctgcattcacaacgtctgcagcatttatctgtttgatctccattgtgctctcctacattcgcatcttctctacagtgctgagaatcccatcagctgagggccggaccaaggtcttctccacctgcctaccacacctatttgtagccaccttctttctttcagctgcaggctttgagtttctcagactgccttctgattcctcatcgactgtggaccttgtattctccgtattctatactgtgatacctccaacactcaatccagtcatttatagcttacggaatgattccatgaaggcagcactgaggaagatgctgtcaaaggaagagcttcctcagagaaaaatgtgcttaaaagccatgtttaaactctgaagaaccatacaaatgaaaggcattgttattatgtttcagattggaagagaggtgaatcttatttctacccagaatgctcttccaagc

SEQ ID NO: 5439 - DNA, 1117 bp, Homo sapiens
gcattttcttcctactgtctttggcttcctaaacagagtcacacttggtatcttcagagagactatggtcaatttgacttcaacgagtggattccttcttatggggttttctgatgagcgtaagcttcagattttacatgcattggtatttctggtgacatacctgctggccttgacaggcaacctcctcattatcaccatcattaccgtggaccgtcgtctccattcccccatgtattactttttaaagcacctctctcttctggacctctgcttcatctctgtcacagtcccccagtccattgcaaattcacttatgggcaacggttacatttctcttgttcagtgcattcttcaggttttcttcttcatagctctggcctcatcagaagtggccattctcacagtgatgtcttatgacaggtacgcagcaatctgtcaaccacttcattatgagactattatggatccccgtgcctgtaggcatgcagtgatagctgtgtggattgctgggggcctctctgggctcatgcatgctgccattaacttctccatacctctctgtgggaagagagtcattcaccaattcttctgtgatgttcctcagatgctgaaactagcctgttcttatgaattcattaatgagattgcactggctgcattcacaacgtctgcagcatttatctgtttgatctccattgtgctctcctacattcgcatcttctctacagtgctgagaatcccatcagctgagggccggaccaaggtcttctccacctgcctaccacacctatttgtagccaccttctttctttcagctgcaggctttgagtttctcagactgccttctgattcctcatcgactgtggaccttgtattctccgtattctatactgtgatacctccaacactcaatccagtcatttatagcttacggaatgattccatgaaggcagcactgaggaagatgctgtcaaaggaagagcttcctcagagaaaaatgtgcttaaaagccatgtttaaactctgaagaaccatacaaatgaaaggcattgttattatgtttcagattggaagagaggtgaatcttatttcttcccagaacgctcttccaagc

SEQ ID NO: 5440 - DNA, 1117 bp, Homo sapiens; identical to SEQ ID NO: 5438

SEQ ID NO: 5441 - DNA, 1117 bp, Homo sapiens; identical to SEQ ID NO: 5438

SEQ ID NO: 5442 - DNA, 1063 bp, Homo sapiens
tgacagcctcatccctccaggtacaaacaagaacaggccatggttaaccaaagctccacaccgggcttcctccttctgggcttctctgaacacccagggctggaaaggactctcttcgtggttgtcttcacttcctacctcctaaccctagtgggcaacacactcatcatcctgctgtctgtgctggaccccaagctccactctccaatgtactttttcctctccaacctctccttcttggacctctgtttcaccacgagttgtgttccccaaatgctggtcaacctctggggcccaaagaagaccatcagcttcctggactgctctgtccagatcttcatcttcctgtccctggggacaactgagtgcatcctcttgacagtgatggcttttgatcgctacgtggctgtctgccagcccctccactatgccaccatcatccacccccgcctgtgctggcagctggcatctgtggcctgggtcattgggctagtggagtcagtggtccagacaccatccaccctgcacctgcccttctgccccgatcggcaggtggatgattttgtctgtgaggtcccagctctaattcgactctcctgtgaagacacctcctacaatgagatccaggtggctgttgccagtgtcttcatcttggttgtgcctctcagcctcatccttgtctcttacggagccattacctgggcagtgctgaggattaactctgcaaaagggcggaggaaagcttttgggacctgctcctcccatctcactgtggtcaccctcttctacagctcagtcattgctgtctacctccagcccaaaaatccctatgcccaagagaggggcaagttctttggtctcttctatgcagtgggcactccttcacttaaccctctcatatacaccctgaggaacaaggaggtaaccagggcattcaggagattgctggggaaggaaatggggctcacacaaagctgagggagagctgcttaatgtgctttaaaagagaggagattctatgtgcttttatcagaaagtttgagttccctgcccctctgccttc

SEQ ID NO: 5443 - DNA, 1063 bp, Homo sapiens
tgacagcctcatccctccaggtacaaacaagaacaggccatggttaaccaaagctccacaccgggcttcctccttctgggcttctctgaacacccagggctggaaaggactctcttcgtggttgtcttcacttcctacctcctaaccctagtgggcaacacactcatcatcctgctgtctgcgctggaccccaagctccactctccaatgtactttttcctctccaacctctccttcttggacctctgtttcaccacgagttgtgttccccaaatgctggtcaacctctggggcccaaagaagaccatcagcttcctggactgctctgtccagatcttcatcttcctgtccctggggacaactgagtgcatcctcttgacagtgatggcttttgatcgctacgtggctgtctgccagcccctccactatgccaccatcatccacccccgcctgtgctggcagctggcatctgtggcctgggtcattgggctagtggagtcagtggtccagacaccatccaccctgcacctgcccttctgccccgatcggcaggtggatgattttgtctgtgaggtcccagctctaattcgactctcctgtgaagacacctcctacaatgagatccaggtggctgttgccagtgtcttcatcttggttgtgcctctcagcctcatccttgtctcttacggagccattacctgggcagtgctgaggattaactctgcaaaagggcggaggaaagcttttgggacctgctcctcccatctcactgtggtcaccctcttctacagctcagtcattgctgtctacctccagcccaaaaatccctatgcccaagagaggggcaagttctttggtctcttctatgcagtgggcactccttcacttaaccctctcatatacaccctgaggaacaaggaggtaaccagggcattcaggagattgctggggaaggaaatggggctcacacaaagctgagggagagctgcttaatgtgctttaaaagagaggagattctatgtgcttttatcagaaagtttgagttccctgcccctctgccttc

SEQ ID NO: 5444 - DNA, 1063 bp, Homo sapiens; identical to SEQ ID NO: 5442

SEQ ID NO: 5445 - DNA, 1063 bp, Homo sapiens; identical to SEQ ID NO: 5442

SEQ ID NO: 5446 - DNA, 1273 bp, Homo sapiens
aatcaatttaactttttaaaataaaaaattattttcttaaatattgtctttctgattatggaatatcttagtcttcatttatccaaatgttaactcaaggatgtatataaaagaactcagtaacttgaaaagctattacttgtatccacagctggacaaatatctcaatgaagcatacaaaggaaactgtataaaaattctactgccataatggtgcacattatctggaattgggatacttttttctccaatctgtttgcaagtgagcagttggcaatgcatggacagactttgagtttatgcgattctttctttaggtacaggaaaaataagaatgttgatgaaaaaaaatgcaagttttgaagacttctttattctacttggattttctaactggcctcatctggaagtagttctctttgtggttatcttgatcttctacttgataacactgataggaaacctgttcatcatcatcctgtcatacctggactcccatctccacactcccatgtacttcttcctttcaaatctctcatttctggatctctgctacaccaccagctctatccctcagttgctggtgaatctctggggcccggaaaagaccatctcttatgctggttgtacggttcaactttactttgttctcgcactgggaaccgcagagtgtgtcctactggtggtgatgtcctatgatcgttatgcagctgtgtgtagacctttgcattacactgtcctcatgcaccctcgtttctgccgcttgttggctgcggcttcttgggtaagtggttttacaacctcagcacttcattcctcctttactttctggatacccctatgtagacatcgcctagtggatcacttcttctgtgaagttccagcacttctgcgattatcatgtgttgatacccaggcaaatgagctgaccctcatggtcatgagctccatttttgttctcatacctctcatcctcatcctcacttcctatggtgccattgcccgggctgtactgagcatgcaatcaaccactgggcttcagaaagtgcttaggacatgtggagcccatcttatggttgtatctctctttttcattccagtcatgtgcatgtatctccagccaccatcagaaaattctcaagatcaaggcaagttcattgccctcttttacactgttgtcacacctagtcttaaccctctaatctacactttcagaaacaaggatgtaagaggggcagtgaagagactaatggggtgggaatgggggatgtga

SEQ ID NO: 5447 - DNA, 1041 bp, Homo sapiens
gggatacttttgtcttcaatctgtttgcaagtgagcggttgacaatgcatggacagactttgagtttatgtggttctttctttaggtataagaaaaagatgaatgatgattaaaaaaaatgcaagttcggaagacttctttattctacttggattttctaattggcctcagctggaagtagttctctttgtggttatcttgatcttctacctgatgacactgacaggaaacctgttcatcatcatcctgtcatacgtggactcccatctccacacaccaatgtacttcttcctttcaaacctctcatttctggatctctgctacaccaccagctctatccctcagttgctggtgaatctccggggcccggaaaagaccatctcgtatgctggttgcatggttcaactttactttgttcttgcactgggaatcgcagagtgtgtcctactggtggtgatgtcgtatgatcgttatgtagctgtgtgtagacctttgcattacactgtcctcatgcaccctcgtttctgccacttgttggttgcggcttcttgggtaattggttttactatctcagcacttcattcctcctttactttctgggtacccctttgtggacatcgcctagtggatcacttcttctgtgaagttccagcacttctgcgtttatcatgtgttgacacccatgcaaatgagctgaccctcatggtcatgagctccatttttgttctcatacctctcattctcattctcactacctatggtgccattgcccgggctgtactgagcatgcaatcaaccactgggcttcagaaagtgtttaggacatgtggagcccatcttatggttgtatctctctttttcattccagtcatgtgcatgtatctccagccaccatcagaaaattctcctgatcagggcaagttcattgccctcttttatactgttgtcacaccgagtcttaatcctctaatctacactctcagaaacaagcatgtaaaaggggcagcgaagagactattggggtgggagtgggggaagtga

SEQ ID NO: 5448 - DNA, 1041 bp, Homo sapiens
gggatacttttgtcttcaatctgtttgcaagtgagcggttgacaatgcatggacagactttgagtttatgtggttctttctttaggtataagaaaaagatgaatgatgattaaaaaaaatgcaagttcggaagacttctttattctacttggattttctaattggcctcagctggaagtagttctctttgtggttatcttgatcttctacctgatgacactgacaggaaacctgttcatcatcatcctgtcatacgtggactcccatctccacacaccaatgtacttcttcctttcaaacctctcatttctggatctctgctacaccaccagctctatccctcagttgctggtgaatctccggggcccggaaaagaccatctcgtatgctggttgcatggttcaactttactttgttcttgcactgggaatcacagagtgtgtcctactggtggtgatgtcatatgatcgttatgtagctgtgtgtagacctttgcattacactgtcctcatgcaccctcgtttctgccacttgttggttgcggcttcttgggtaattggttttactatctcagcacttcattcctcctttactttctgggtacccctttgtggacatcgcctagtggatcacttcttctgtgaagttccagcacttctgcgtttatcatgtgttgacacccatgcaaatgagctgaccctcatggtcatgagctccatttttgttctcatacctctcattctcattctcactacctatggtgccattgcccgggctgtactgagcatgcaatcaaccactgggcttcagaaagtgtttaggacatgtggagcccatcttatggttgtatctctctttttcattccagtcatgtgcatgtatctccagccaccatcagaaaattctcctgatcagggcaagttcattgccctcttttatactgttgtcacaccgagtcttaatcctctaatctacactctcagaaacaagcatgtaaaaggggcagcgaagagactattggggtgggagtgggggaagtga

SEQ ID NO: 5449 - DNA, 1041 bp, Homo sapiens; identical to SEQ ID NO: 5447

SEQ ID NO: 5450 - DNA, 936 bp, Homo sapiens
atgaatgatgatggaaaagtcaatgctagctctgaggggtactttattttagttggattttctaattggcctcatctggaagtagttatctttgtggttgtcttgatcttctacttgatgacactgataggaaacctgttcatcatcatcctgtcatacctggactcccatctgcacacaccaatgtacttcttcctttcaaacctctcatttctggatctctgctacaccaccagctctatccctcagttgctggtcaatctctggggcccggaaaagaccatctcttatgctggttgcatgattcaactttactttgttctcgcactgggaaccacagagtgtgtcctactggtggtgatgtcctatgaccgttatgcagctgtgtgtagacctttgcattacactgtcctcatgcaccctcgtttctgccacctgctggctgtggcttcttgggtaagtggttttaccaactcagcacttcattcctccttcaccttctgggtacctctgtgtggacaccgccaagtagatcactttttctgtgaagttccagcacttctgcgattatcgtgtgttgatacccatgtcaatgagctgaccctcatgatcacaagctccatatttgttctcatacctctcatcctcattctcacttcttatggtgccatcgtccgagctatactgaggatgcagtcaaccactgggcttcagaaagtgtttggaacatgtggagctcatcttatggctgtatctctctttttcattccggccatgtgcatgtatctccagccaccatcaggaaattctcaagatcaaggcaagttcattgccctcttttatactgttgtcacacctagtcttaaccctctaatctacaccctcagaaacaaagttgtaagaggggcagtgaagagactaatggggtgggaatga

SEQ ID NO: 5451 - DNA, 939 bp, Homo sapiens
atggaaaatgggagctatacctcttatttcattctcctaggactctttaaccacaccagagcccaccaagtcctcttcatgatggttctgagtatcgttttgacctccctgtttggcaattccctcatgattctcctgattcactgggaccaccggctccacacgcccatgtacttcctcctgagccaactttccctcatggacgtgatgctggtttccaccactgtgcccaaaatggcggctgactacttgaccggaagtaaggccatctcccgcgctggctgtggtgcgcagatcttcttcctccccacactgggtggtggagagtgcttcctcttagcagccatggcctatgaccgctatgcggctgtctgccacccactccgatatcccactctcatgagctggcagctgtgcctgaggatgaacctgtcgtgttggctcctgggtgcagctgacgggctcctgcaggctgttgctaccctgagcttcccatattgcggtgcacacgagatcgatcacttcttctgcgagacccccgtgctggtgcgtttggcttgtgctgacacttcagtcttcgaaaacgccatgtacatctgctgtgtgttaatgctcctggtccccttttccctcatcctgtcctcctatggtctcatcctcgctgctgttctgcacatgcgctctacagaagcccgcaagaaggcctttgccacctgctcttcacatgtggctgtggtgggactcttttatggagctgccatttttacctatatgagacccaaatcccacaggtccactaaccacgacaaggttgtgtcagccttctatactatgttcacccctttactaaaccccctcatctacagtgtgaagaacagtgaggtgaagggagccctgacaaggtgtatgggtcggtgtgtggccttaagtcgtgaataa

SEQ ID NO: 5452 - DNA, 931 bp, Homo sapiens
atggagaatagcacagaagtgacagagtttatcctcttgggattaacagatgaccccaatcttcagatacccctcctcctggcatttttattcatctacctcatcaccctgcttgggaatgggggaatgatggtgatcatccactcagactcccatctccacactccaatgtactttttcctcagtaacctctcccttgtagacttgggttactcatcagctgtagcccccaaaacggtggctgcattgcggtcaggggacaaggccatctcctacgatggatgtgcagctcagttcttcttctttgtggggtttgccactgttgagtgctacctcctggcctccatggcctatgatcgccatgcagcggtatgtaggcctcttcattacaccaccaccatgacagcaggtgtgtgtgccctccttgctactggttcctatgtctctggcttcctcaatgcctctatccatgcagcaggcaccttcagactctccttctgtggttctaatgagattaatcatttcttctgtgacattcccccactcctggctctctcatgctctgacacacgcatcagcaagttggtggtctttgtggcaggcttcaacgtctttttcaccctcctggtcatccttatttcttacttcttcatatgcatcaccattcagaggatgcattctgctgaagggcagaagaaagtcttctccacctgtgcttcccatctcactgctttgtccatcttctatggcacaatcatcttcatgtacttacagcccaactccagccagtccgtggacacagacaaaatagcctctgtgttttacacagtggtgattcccatgctgaatcccttgatatacagccttaggaacaaagaagtgaaaagtgctctctggaaaatactcaacaaactttacccccaatattaaa

SEQ ID NO: 5453 - DNA, 942 bp, Homo sapiens
atggaagaggaaaatgcaacattgctgacagagtttgttctcacaggatttttatatcaaccacagtggaaaatacccctgttcctggcattcttggtaatatatctcatcaccatcatggggaatcttggtctgattgctgtcatctggaaagaccctcaccttcatatcccaatgtacttactccttgggaatttagcttttgtggatgcttggatatcatccacagtgaccccaaagatgctgaataacttcttagctaagagtaagatgatatctctctctgaatgcaagatacagtttttttcgtttgcaatcagtgtaaccacggaatgttttctcttggcaacgatggcatatgatcgctatgtagccatatgcaaacctttactttatccagccattatgaccaatggactgtgcatccggctattaatcttgtcatatgtaggtggtattcttcatgctttaatccatgaaggatttttattcagactaaccttctgtaactccaacatagtacatcacatttactgtgacactatcccattgtctaagatttcttgtactgattcttctattaattttctaatggtttttattttctcaggttcaattcaggtattcagcattgtgactattcttgtatcttatacatttgttctcttcgcaatcttaaaaaagaaatctgataaaggtgtaaggaaagccttttccacctgtggagcccatctcttctctgtctctttatactatggaccccttctcttcatttatgtgggccctgcatctccgcaagcagatgatcaagatatggtggagcctctattctacactgtcatcattcctttgttaaatcctatcatctacagtctgagaaataagcaagtcacagtttcattcacaaaaatgttaaaaaaacatgttaaggtttcatactaa

SEQ ID NO: 5454 - DNA, 942 bp, Homo sapiens
atggaagaggaaaatgcaacattgctgacagagtttgttctcacaggatttttatatcaaccacagtggaaaatacccctgttcttggcattcttggtaatatatctcatcaccatcatggggaatcttggtctgattgctgtcatctggaaagaccctcaccttcatatcccaatgtacttactccttgggaatttagcttttgtggatgcttggatatcatccacagtgaccccaaagatgctgaataacttcttagctaagagtaagatgatatctctctctgaatgcaagatacaatttttttccattgcaattggcgtaaccacagaatgttttctcttggcaacaatggcatatgatcgctatgtagccatatgcaaacctttactttatccagccattatgaccaatggactgtgcatccggctattaatcttgtcatatatagctggtattcttcatgctttaatccatgaaggatttttattcagactaaccttctgtaactccaacatagtacatcacatttactgtgacactatcccattgtctaagatttcttgtactgattcttctattaattttctaatggtttttattttctcaggttcaattcaggtattcagcattgtgactattcttatatcttacacatttgttctcttcacagtcttagaaaagaaatctgataagggtgtaaggaaagccttttccacctgtggagcccatctcttctctgtctgtttatactatggcccccttctcttaatgtatgtgggccctgcatctccgcaagcagatggtcaaaatatggtggagcctctattctacactgtcatcattcctttgttaaatcctatcatctacagtctgagaaataagcaagtcatagtttcattcataaaaatgttaaaaagaaatgttaaggtttcatactaa

SEQ ID NO: 5455 - DNA, 930 bp, Homo sapiens
atggaagaggaaaatgcaacattgctgacagagtttgttctcacaggatttttatatcaaccacagtggaaaatacccctgttcttggcattcttggtaatatatctcatcaccatcatggggaatcttggtctgattgctgtcatctggaaagaccctcaccttcatatcccaatgtacttactccttgggaatttagcttttgtggatgcttggatatcatccacagtgaccccaaagatgctgaataacttcttagctaagagtaagatgatatctctctctgaatgcaagatacaatttttttccattgcaattggcgtaaccacagaatgttttctcttggcaacaatggcatatgatcgctatgtagccatatgcaaacctttactttatccagccattatgaccaatggactgtgcatccggctattaatcttgtcatatatagctggtattcttcatgctttaatccatgaaggatttttattcagactaaccttctgtaactccaacatagtacatcacatttactgtgacactatcccattgtctaagatttcttgtactgattcttctattaattttctaatggtttttattttctcaggttcaattcaggtattcagcattgtgactattcttatatcttacacatttgttctcttcacagtcttagaaaagaaatctgataagggtgtaaggaaagccttttccacctgtggagcccatctcttctctgtctgtttatactatggcccccttctcttaatgtatgtgggccctgcatctccgcaagcagatggtcaaaatatggtggagcctctattctacactgtcatcattcctttgttaaatcctatcatctacagtctgagaaataagcaagtcatagtttcattcataaaaatgttaaaaagaaatggtata

SEQ ID NO: 5456 - DNA, 966 bp, Homo sapiens
atgaataaggagaatcactccttgatagctgagttcatcctcacaggatttacatatcatccaaagctgaagactgttctgtttgtggtgttctttgccatctatctgatcaccatggtggggaacattggtttggtggcattgatttatatagagcaacgtcttcacacaccaatgtacatatttttaggcaacctagttctgatggattcctgctgttcctctgctattactcccaagatgttagagaacttcttttctgaggacaaaaggattaccctgtatgaatgtatggcacaattttattttctctgtcttgctgaaactacagactgctttcttctggcggcaatggcctatgactgctatgtggccatatgcaacccactgcagtaccacaccatgatgtccaagacactctgcattcagatgactgcaggagcctacctagctggcaacctgcatcccatgattgaagtagagtttctgttgaggttaactttctgtgggtctcatcaaatcaatcattttttctgtgatgttcttccattatatagactttcttgtattaacccttatatcaatgaattggtgttatttatcttggcaggatcaattcaaatctttactatagtcttagtttcttatttctacatccttttcacaatatttacaatgaaatccaaggagggaagaggcaaagctttatctacttgtgcatctcactttctctctgtgtcaatattctgtgattcccttctcttcatgtatgctcgaccaggtgcagttaatgaaggggataaagatatacctgttgctatattttatactttagttattcctttattaaatccttttatttatagcctaagaaataaggaagtaataaatattatgaaaaaaattatgaagaagagaaaattttgtcacattctgaaacaaatgtcatcccctctggcaacttga

SEQ ID NO: 5457 - DNA, 1048 bp, Homo sapiens
gtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaatggcagtttttactattcaccatcttctttctgacttatttctgtactttgggaggaaatatattaattatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcatttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttttctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaagctgtcaaaactatagggagcaagtggcagccaccaatttcctctttggatagtaaactcacttattga

SEQ ID NO: 5458 - DNA, 1266 bp, Homo sapiens
gagctgaaggtaggaaattccaacattctgaagtcttcagcaaatcttagcagatcatctcctcctcacagtcctgtctttagagaacagggtcgatatttcggcttctgcgaactcagatgtcatcttttcttccctaaagtttttaaagttcctattgatatattcccctgcctagagggtttggtggtcgttttcttcctcttaactttattaaggtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaatggcagtttttactattcaccatcttctttctgacttatttctgtactttgggaggaaatatattaattatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcatttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttttctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaagctgtcaaaactatagggagcaagtggcagccaccaatttcctctttggatagtaaactcacttattga

SEQ ID NO: 5459 - DNA, 1117 bp, Homo sapiens
gaaatacgttgtgaacttcccagcacatctgttagaaaggaggtccagaaaaagagcacaaagagaatggtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaattgcagtttttactattcaccatcttctttctgacttatttctgtactttgggaggaaatatattaatgatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcatttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttttctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaggctgtcaaaactatagggagcaagtggcagccaccaatttcctctttggatagtaaactcacttattga

SEQ ID NO: 5460 - DNA, 1266 bp, Homo sapiens
gagctgaaggtaggaaattccaacattctgaagtcttcagcaaatcttagcagatcatctcctcctcacagtcctgtctttagagaacagggtcgatatttcggcttctgcgaactcagatgtcatcttttcttccctaaagtttttaaagttcctattgatatattcccctgcctagagggtttggtggtcgttttcttcctcttaactttattaaggtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaattgcagtttttactattcaccatcttctttctgacttatttctgtactttgggaggaaatatattaatgatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcatttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttttctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaggctgtcaaaactatagggagcaagtggcagccaccaatttcctctttggatagtaaactcacttattga

SEQ ID NO: 5461 - DNA, 1048 bp, Homo sapiens
gtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaattgcagtttttactattcaccatcttctttctgacttatttctgtactttgggaggaaatatattaatgatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcatttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttttctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaggctgtcaaaactatagggagcaagtggcagccaccaatttcctctttggatagtaaactcacttattga

SEQ ID NO: 5462 - DNA, 939 bp, Homo sapiens
atggaaatcctaagcaactcaacatctaaatttccaaccttcttgttgaccggcattcctggcctagagtctgcccatgtctggatctccattcctttctgttgtttttatgccattgccctctctgggaacagcgtgatcctgtttgtcatcattacccagcagagtctccatgaacccatgtattatttcctcttcaggctatcagccactgatctgggcttgactgtttcttcattgtcaacaacattaggtatcctctggtttgaggcacgtgaaatcagtctatatagctgcattgtccagatgttttttcttcatggattcacttttatggaatctggagtgctggtggctacagcctttgaccgttatgtggccatctgtgaccctctgaggtacactaccattctcactaattccagaatcattcaaatgggtcttctgatgattacacgtgctatagtactaatattgccactacttttgctccttaagcctctctatttctgtagaatgaatgccctttctcactcctattgttaccatccagatgtgattcaattagcatgttcagacattcgggcaaatagcatctgtggattaattgatctcatcctgaccactggaatagatacaccatgcattgtcctgtcatatatcttaattattcactctgtcctcagaattgcctcccctgaagaatggcacaaggtcttcagcacctgtgtctcccatgtgggagcagttgctttcttctacatccacatgctgagcctgtccttggtgtatcgctatggtcggtcagcccccagagtagtccattcagtgatggctaatgtatacctgcttttaccccctgtgctcaaccccatcatcgacagtgtaaaaacaaaacaaatccgcaaggctatgctcagtctgctgcttacaaaatga

SEQ ID NO: 5463 - DNA, 960 bp, Homo sapiens
atgctgcaaaaccaggacaccatggaaatcctaagcaactcaacatctaaatttccaaccttcttgttgaccggcattcctggcctagagtctgcccatgtctggatctccattcctttctgttgtttttatgccattgccctctctgggaacagcgtgatcctgtttgtcatcattacccagcagagtctccatgaacccatgtattatttcctcttcaggctatcagccactgatctgggcttgactgtttcttcattgtcaacaacattaggtatcctctggtttgaggcacgtgaaatcagtctatatagctgcattgtccagatgttttttcttcatggattcacttttatggaatctggagtgctggtggctacagcctttgaccgttatgtggccatctgtgaccctctgaggtacactaccattctcactaattccagaatcattcaaatgggtcttctgatgattacacgtgctatagtactaatattgccactacttttgctccttaagcctctctatttctgtagaatgaatgccctttctcactcctattgttaccatccagatgtgattcaattagcatgttcagacattcgggcaaatagcatctgtggattaattgatctcatcctgaccactggaatagatacaccatgcattgtcctgtcatatatcttaattattcactctgtcctcagaattgcctcccctgaagaatggcacaaggtcttcagcacctgtgtctcccatgtgggagcagttgctttcttctacatccacatgctgagcctgtccttggtgtatcgctatggtcggtcagcccccagagtagtccattcagtgatggctaatgtatacctgcttttaccccctgtgctcaaccccatcatcgacagtgtaaaaacaaaacaaatccgcaaggctatgctcagtctgctgcttacaaaatga

SEQ ID NO: 5464 - DNA, 1058 bp, Homo sapiens
ttttcagctcaatccccgaggaatgtcagtccaatattcgctcagtcctcaattcatgctgctatccaacattactcagtttagccccatattctatctcaccagctttcctggattggaaggcatcaaacactggattttcatcccctttttctttatgtacatggttgccatctcaggcaattgtttcattctgatcattattaagaccaaccctcgtctgcacacacccatgtactatctactatccttgctggccctcactgacctggggctgtgtgtgtccacgttgcccaccactatggggatcttctggtttaactcccatagtatctactttggagcgtgtcaaatccagatgttctgcatccactctttttccttcatggagtcctcagtgctcctcatgatgtcctttgaccgccttgtggccatctgccaccctctgaggtattcggtcattatcactggccagcaagtggtcagagcaggcctaattgtcatcttccggggacctgtggccactatccctattgtcctcctcctgaaggcttttccctactgtggatctgtggtcctctcccactcattttgcctgcaccaggaagtgatacagctggcctgcacagatatcaccttcaataatctgtatggactgatggtggtagttttcactgtgatgctggacctggtgctcatcgcactgtcctatggactcatcctgcacacagtagcaggcctggcctcccaagaggagcagcgccgtgcctttcagacatgcaccgctcctctctgtgctgtgctagtattctttgtgcccatgatggggctgtccctggtgcaccgttttgggaagcatgccccacctgctattcatcttcttatggccaatgtctacctttttgtgcctcccatgcttaacccaatcatatacagcattaagaccaaggagatccaccgtgccattatcaagttcctaggtcttaaaaaggccagtaaatgagtcctggggctaaaactccccctagaggcctataagaaggccccaaattggactg

SEQ ID NO: 5465 - DNA, 945 bp, Homo sapiens
atgaagaacaaatcaatggaaatagagttcattctcctaggattgacagatgacccacagttgcaaattgtgattttcctgtttctatttctcaactacaccttgagcctgatggggaacttaatcatcatcatcctcaccctgctggatccccggctcaagacgccaatgtatttctttctccgtaatttctcctttttggaagtaatattcacaacagtgtgtattcctagattcttgataaccattgtgactagagacaaaaccatttcttataataattgtgcaactcaattattttttatccttttaccgggagttactgagttttacctcctggctgccatgtcctatgaccgctacgttgccatctgcaaaccactgcattatccaatcattatgagcagcaaagtctgctaccaacttgtacttagctcttgggtaactggattcttaatcatatttcccccattggtcatgggactcaagctggatttttgtgcttccaaaactattgaccactttatgtgtgaaacttctcctattctgcagatctcctgcacagatacccatgtcctagaattgatgtcttttaccttagctgtggtgacacttgtggtcacactggtattagtgattctctcttacacttgcattattaagaccattctgaaattctcttctgcacagcaaaggaacaaagcattttccacctgtacttcccacatgattgttgtctccatgacatacggtagctgtatctttatgtatattaaaccatctgcaaaagaaagagtgactgtatccaaaggtgtagctttgctctatacctcaattgcccctttactaaatcccttcatttatactctcagaaaccagcaggtgaaagaagtcttctgggatgtattacaaaagaatttgtgtttttctaaaagaccattttaa

SEQ ID NO: 5466 - DNA, 939 bp, Homo sapiens
atgaaaaatagaacatcagtgacagatttcatccttctgggtctgacggataatccgcaactgcaggttgtgattttctcgttcctatttcttacgtatgtactgagtgttactggaaatctaactatcatctcccttaccctgctggattcccacctgaagacccccatgtatttcttcctcaggaatttctccttggaaatttcatttacttctgtctgtaatcctagatttctgatcagcattctaacaggggacaaatccatatcttataatgcttgtgcagctcagctatttttctttatcttccttggctcaacggagtttttcctcctggcctctatgtcctatgattgctatgtggctatatgtaagcctctgcattatacaaccatcatgagtgacaggatctgttatcagcttataatcagctcttggctggctggtttcttggtaatttttccaccactggccatgggcttacagctggatttctgtgactccaatgtcattgaccactttacctgtgactctgctcctttgctgcaaatctcttgcacagacacaagtactctagagctcatgagctttattttagctctgtttactcttatatccactttgatattagtaattctctcctatacttacatcatcagaactattctgagaatcccctcagcacagcaaagaaaaaaagccttttcaacctgctcctcacatgtgattgttgtctctatctcttatggaagctgcatcttcatgtatgtgaaaacatcagcaaaggaaggagttgctttgacaaaaggagtagctatactcaatacctctgtcgctcctatgctgaatccatttatttacactctaagaaaccagcaggtgaaacaagcatttaaggatgttctgagaaagatttcccacaaaaaaaaaaaacactga

SEQ ID NO: 5467 - DNA, 561 bp, Homo sapiens
cgtaacgcgccgcgcggagccgacgagacggcggggctagagaggccgtcccgaccgcgccccccgccggaagcggcttgttcgggcctgagctggcgctacgaagttccggtccaggtctctgacttcgggcttgttcgctggtggcgtcggagccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttttttttgtggtcccaaaa

SEQ ID NO: 5468 - DNA, 696 bp, Homo sapiens
cagtgggcctgggaagatgtgtttcccctggatgtgcacgttcctgtttgtggcttatcgcctctcgtttattctgtgtgagtaggtagaaaatgagcatcacggacgtgctcagtgctgatgacattgcagcagcgctccaggaatgccaagacccagacacttttgaaccccaaaaattcttccagacgtcaggcctctccaagatgtcagccagtcaggtgaaggatgttttccggttcatagacaacgaccagagcgggtatctggatgaagaagagcttaagtttttcctccagaagtttgagagtggtgccagagaactgaccgagtcagaaaccaagtccttgatggctgcggcggataatgatggagatgggaaaattggagcagaggaattccaggaaatggtgcattcttaaaagccccagtctctggagaaaagagagaaagggataatcacctggaaggattccaaagccctgggaatggggaaccccacatcccatccctacctaatttgttaattttccctgaaaaccttctgcagtttgctcattgttttagcgaggtcacgagagagtcactcatgactttcttggtggtgggtatatgccctgacaacttctgtaagccccccttcccccaacaggcaatgcctctaaaaatcacccaataaagacaggcttctcaaca

SEQ ID NO: 5469 - DNA, 369 bp, Homo sapiens
atgaagaccattctggggttcaaagggctcttttatctgcattccttgatatggacctgcgctggggactggtcagctattcaagtacactgcacccagttttggttctttgccaggattaaacccacgatattttacaatttgtatgtgaaccccgatgaagtgtttctaggagatggctgccatgtaacccatgttttgccaaatgtctactatgagtttttctaccatcctcatgactgtggtattgtaactcaacctctccaggaagttcttctgcttaaaactaaaatcaggtatatctcaagagactctactgtccgatctgaaatgcctctgtcgtgtgtcgtccacaaacaaaaatgccaa

SEQ ID NO: 5470 - DNA, 1711 bp, Homo sapiens
gctgaggcagtgcggggcgggcgcgcctaggctgccgcccagcgccctcgccgcggccatgcccgggccctagagcgcctgccgcagcttgcgccccgcagccccgcagccccgcgcccgccgccgcctcttcaatgggcaacctgctcggcggggtcagcttccgcgagcccaccaccgtggaggactgcgactccacctggcagaccgactcggagcccgagcccgaagaaccagggccgggcggcggcagcgagggcccggggcaggagtccgagcagcccgcgcagcccccggagcaagccggcgggcggcccggcgccagccccgcgccggacgaggacgccgaggcggcgggcgccgagcagggtggtgattccactgaagcaactgccaaaccaaagagaagtttttatgctgccagggatttgtacaagtaccgacaccagtacccaaacttcaaagatatccgatatcaaaatgacttgagcaatcttcgtttttataagaataaaattccattcaagccagatggtgtttacattgaagaagttctaagtaaatggaaaggagattatgaaaaactggagcacaaccacacttacattcaatggcttttccccctgagagaacaaggcttgaacttctatgccaaagaactaactacatatgaaattgaggaattcaaaaaaacaaaagaagcaattagaagattcctcctggcttataaaatgatgctagaattttttggaataaaactgactgataaaactggaaatgttgctcgggctgttaactggcaggaaagatttcagcatctgaatgagtcccagcacaactatttaagaatcactcgtattcttaaaagccttggtgagcttggatatgaaagttttaaatctcctcttgtaaaatttattcttcatgaagctcttgtggagaatactattcccaatattaagcagagtgctctagagtattttgtttatacaattagagacagaagagaaaggagaaagctcctgcggttcgcccagaaacactacacgccttcagagaactttatctggggaccgcctcgaaaagaacagtcggagggaagcaaagcccagaaaatgtcttcccctctcgcctccagtcataacagtcaaacttctatgcacaaaaaagccaaggactccaaaaattcctcctcagctgttcatttaaatagcaaaacagctgaagacaaaaaagtggcaccaaaagagcctgtggaagagacagacaggcccagcccagagcccagcaatgaagctgccaagccaagaaatacagagaaggacagtaatgctgagaacatgaattctcaacctgagaaaacagttactactcccacagaaaaaaaggagagtgtatctcctgagaataacgaagaaggtggaaatgataaccaagacaatgaaaatcctggaaatacaaattgccatgatgttgtactagtacagtgaattatcagaaaacccagaagccagtttaggctagagaggaaaaaactactgtatcatttatcctaaagaacagagatgaggtcaatttcaaattttagccatctgtttgtgatttctgtcataagcattttgttgtttgtttttttattttggatgacaatgaattgaatatctaataaggagatttaagataagacccaataaatgaatgtattctgtaa

SEQ ID NO: 5471 - DNA, 1934 bp, Homo sapiens
atgcagatgaggcactcgggggcggggcggcggcggcggcggcggcggtggcggccggggagggtcagttggaggcaggcgctcgctgaggcaaaaggaggcgctcggcccgcggcctgacagggacttagcccgcagagatcgaccccgcgcgcgtgaccccacacccacccactcatccatctatccactccctgcgccgcctcctcccaccctgagcagagccgccgaggatgataaacacccaggacagtagtattttgcctttgagtaactgtccccagctccagtgctgcaggcacattgttccagggcctctgtggtgctccgatgcccctcacccactgtcgaagatccccggtgggcgagggggcggcagggatccttctctctcagctctaatatataaggacgagaagctcactgtgacccaggacctccctgtgaatgatggaaaacctcacatcgtccacttccagtatgaggtcaccgaggtgaaggtctcttcttgggatgcagtcctgtccagccagagcctgtttgtagaaatcccagatggattattagctgatgggagcaaagaaggattgttagcactgctagagtttgctgaagagaagatgaaagtgaactatgtcttcatctgcttcaggaagggccgagaagacagagctccactcctgaagaccttcagcttcttgggctttgagattgtacgtccaggccatccctgtgtcccctctcggccagatgtgatgttcatggtttatcccctggaccagaacttgtccgatgaggactaatagtcatagaggatgctttacccaagagccacagtgggggaagaggggaagttaggcagccctgggacagacgagagggctcctcgctgtctagggaaggacactgaggggctcagggtgagggttgcctattgtgttctcggagttgactcgttgaaattgttttccataaagaacagtataaacatattattcacatgtaatcaccaatagtaaatgaagatgtttatgaactggcattagaagctttctaaactgcgctgtgtgatgtgttctatctagcctaggggaggacattgcctagagggggagggactgtctgggttcaggggcatggcctggagggctggtgggcagcactgtcaggctcaggtttccctgctgttggctttctgttttggttattaagacttgtgtattttctttctttgcttcctgtcaccccaggggctcctgagtataggcttttcagtccctgggcagtgtccttgagttgttttttgacactcttacctgggcttctctgtgtgcatttgcgtctggcctggagtaagcaggtccgacccctccttctttacagcttagtgttattctggcatttggttaagctggcttaatctgtttaatgttatcagtacattttaaataggggcattgaaatttactcccaccaccagggcttttttgggggatgcctgggcctttaaaacactagccaaactctaattaattctcaaatcactgccaggagttcttgctcctggctgcaggcccaggccccaaggtctccttcttggggtcacaaacagcagtaaggaagaggaatatatagcaactcagggcctgggaattgtggggcaatccgttcttagggactggatacttctggctggctgagtatagtactagctgcctccccaccaggttccgagtagtgtctgagactctgctctgcagggcctagggtagcgctgggagtgtagaagtggcctgcccttaactgttttcactaaacagctttttctaaggggagagcaagggggagagatctagattgggtgagggggacggggatgtcagggaggcaagtgtgttgtgttactgtgtcaataaactgatttaaagttgtgg

SEQ ID NO: 5472 - DNA, 8083 bp, Homo sapiens
aatttaatgataccttggagtatattcttgcttcatgtactgctgttttcattacaagaatatatttgtgcatcgtctatattgatgggaacatcaaaaaacgggtttaatgaaaatcgacagaaaagagctcttttagcagcacagtttgaagctacttctccgagatactttttccatgatgctattaattggggtgagagcaaaataaaaggttcttgtccttatgaatgccttaatggagctttctgttctaagactggaacatgtgactgtcaaatatttcaggctcttgggacaagatgccagatcatcccaaacatgggcaacggcagagatgggatttgtaaaacctggggacagtatcattttgaaacattcgatggcatctactattacttcccaggaaactgttcttacatttttgcaaaggactgtggtgatttggagcctcggtacactgtatgggttcataacagccctaaatgccttggttcggtgtattcttgttatcggtcaatcagcttgttcttttcaaaccaagaggaaattcgaatttatggtcatgaaataaaaaagaatggaatcagtttaacattgcctcagacaattggacagattttcattgagaaactagctgactacattcttgtgaaaacaacctttggcttttcattggcttgggacgggatatctgggatctacctcaagctgtctgaggaccataaggggaaatcatgtggcctatgtggaaactacaatgacattcaatctgatgatttcataattctgcaagaggactatacagaagacatcgctatgtttgcaaatagttggtcggtgcaaactccagatgacaccaaatgtgtactcacaccctcagattttccaaatccgtgctccagtggaatgccagcatttgaggcaatcttcttcaagtgtcagatactgttgcagtttccttttctgagctgccatgagtatatcgatccatacttatatattgccagctgtgttaatgatctttgcaaaactgatgatgatgaaacctattgccgagcagccactgagtatgctagagcctgctctcatgctggctaccctattcaagactggagagatgactttccagcatgcactgataaatgtgatgatagctttgtccatcgggactgtatcagttgttgtccaccaacctgcacatttgagaagcaatgtcttgggagcaatctccattgtcttgatggatgttactgcccagatggcctcgtaatggacaatgggacttgcatctccttggaaaattgcccatgcggttttcatggattagcttattcagttggttcaaaaattgaacaagaatgtactgaatgtgtgtgtgttggtggagtttggaactgcactgagcaagactgtccagttcaatgctcagttgtaggtgattctcactttacaacttttgatggtcgacattattcttttattggcatgtgccaatacatcctcgtgaaaggaactggaaaagataaattcacgattactttacagaaagctccctgtgagcagaatcttggcttggtctgccttcagtctataactctgattctggaggatgattttaacaaacaagtgacccttggtaggggaggacaaattctcactagtcctaaccaaggcttcaacctgaatggtattgttgaaattcaaactctgtcatccttatttatacttctaaaaaccacatttggtttaaagattctgtttgctatagatggggaaagaatttatattcagcttactagcgcatggaaaagaagaacattaggtctgtgtggcacttttaatggcaacataagggatgattttctttctccatcaggcatgatagaaggtacaccacaacttcacgcaaatgcgtggagagtttcttctacctgttttgcacctgttcatgtcccagtggtggacccctgtaacatcaatcaacaaaacattgggtatgcagcacactgtgatgtcatccaccaggagctctttgctccttgccacatctatattagccctgggctgtactatcagctatgccgccacgatgcatgcaagtgtggaagctcctgcctgtgcaatgctcttgcccactatgcctacctctgcggccagcacggtgttcccattgatttcagaactcagatttctttctgtgctgtggtgtgccagaagggcatgctgtaccatcactgttcctcgttctgcctccattcctgcatttctctctcttccccggagcagtgcagtgatgactgtgctgaaggctgtaattgtccggaaggcaaattctatgaagacactcttaacttttgtgtacccatattccactgccgttgtcattataggggcagtgtttatcaacctggagagctcatccccacaccctcgggcttatgccagtgttcaaatgggactgtgaaatgtgatgaattagcaacgccctctgctgttcacatctgcccagagggaaaagagtatttcgactgcaggtttcctgaccctgaattaccagctggtggtgttaattgtgagactacatgtgcaaacctagccatgaacttcacctgcaccccatcctcaccctgtataagtggctgtgtttgtgctccaggaatggcagagcacagaggaaagtgttatgttcctgaaagctgcccatgtatttggaaagattgggagtatctctcaggagaagtgattgctacaccgtgttacacctgcgtttgtcgacgaggaatgttcaattgcacatattatccatgcccagcagtgtgcacaatatacggggaccgacattattattcttttgatggactagaatatgactatatcagtgattgccaggtgtttttgataaagagtgcagatgattcagatatatctgtcattgcccagaacaagaaatgctttgacaacgatattgtttgttctaaaagtgttttgatttcagttggggacactgaaatttacctgaatgatactccttacaaacagaaacaatcaggtttttttctggaaaacaaatctacctaccagctttggaaggctggttactatatagtagtatactttccagagaaagatatcactattctttgggataggaagacaactattcatatcaaagttgggccacagtggaagaacaagctatcaggattgtgtggaaactttgacaaatgcacttcaaatgatatgaccacatctaataacttggaagtgagaaatgctcgggtatttggagatagttgggcattaggacagtgtgaaagtccagatgaaacaattaaaccctgtgaggcacatcaaaacaaatttccttatgccaagaaagaatgctccattttgtacagtgatatttttgcttcttgtcgcaatgtgattgacgttacttcttttgccaaaaattgtcatgaagatacatgtaactgcaatcttggtggcgactgtgagtgtttgtgcactagtatagctgcatatgcatacaagtgttgtcaggaaggaatatcaattcattggagatcatctactgtttgttcacttgattgtgaatactacaatgaaggacttggagaaggaccatatatgctggcaagctatgggcagagtggccttgttctgggggccaatatgaccagcagaagcgttttctgtttgccgagaagcagtgttcataccagtttatttttttattttatgatcactccaggccttttcaaagagaaggtatcatcattagcacttgtttccttggaatctgctgaaaggccaaactactttctctatgtccatgacaatgatactcttagcttggagctgtgggaggcgaattcagcctttcatcggagagcaacatttttccaccatcagggcctctggattcctggttacagtgcatttgagttatacagcaagaaaggctttttcatcatattcacagattctagtgtcaaagcatcaaaatatgatgattctgaagaatttaaacattcaagtagcttcagcatagaagaaatccaggcagcagtgccttacaggaagatgtgtgaatggagatatgaaccttgtgctacaccctgttttaaaacatgtagtgaccctgaagcactagcatgtaaatttcttccaccggttgaaggatgcttgccctactgccctaaaaatatgatccttgatgaggtcaccctcaagtgtgtttatccacgagactgtatacctgtgattcccacagaaccaacattaatgccaccagctaagccaactgtgcccatgtttacagtttgggaaatgattactccatcagacatcactgtgtttgatatgctaacaccaactacaggcttggaatgtgagcctcagaaatttgatcctgtttatgattgtagccaatacatatgccttaatatggaatggcagttatacaactggtcccttaattgcccaaaggacgtggaaatgcctgactgtggtttccgaggaaggccagttcaagtgaacagtgatatctgctgccctgagtgggaatgtccttgtcggtgttccatgttgtcagaactgagcattattacatttgatggaaacaacgcagcattatatagcatggcttcttatatcttagtaagaattcctggtgaaattatagttgctcatatcgaaaaatgttccatgaatcagaatggaaactccttaaaaaagctagctccctctggaagaatctctggactttgttttaagaagttaaatgtgacaacacccatacataaaataattgtcaatcggttggcaagaaaggtagaagtggattccattgttgtgcctttgcccttttcaagtcaggaactgtccatagaggattctggttcaatgtatgtaattactactccagctggactaatcataaagtggtctcatcttacaggaatcatagacattcattttggcttccgatttaacttgtcatcctacacagaaggactctgtggaatttgcaatgaagatccggatgatgatctaaggatgcaaaatggcacaattattacaaatatggaagacataggattatttattgagagctgggaaattgagaaatcatttgaagtaacaatgagaagacctgttaggaattgtactgagcatgattgcagccagtgcattgatttattaaatagaagaattttcattccatgtcatgataaagtttcaccggaagacttttgtgaaaagatgtggatcaattatacctatttttggaactatgaatgtgatgcactttctgcatatgtggctctgtgcaacaagtttgatatctgtattcagtggagaacacctgattactgctccctgagttgcccagaggggaaggaatatcaaccctgtgtgcgaccttgtgaagcaagaacatgcctgaaccaatggttctatggacacacttcctgtttgaatctaagagaagactgtgtgtgcaaagttggaactattcttcacaggccacattcagcccagtgcattccagagaaagagtgtgcatgcactgatagtgaagaccaaccccgcactgctggggagatttggaatgggggcattgatgaatgcactctatacaaatgtttggagaatggaagcattatccctatagaacctgactgtgatgaagagcccacgccagtttgtgaacgagaagctgaagttgtcatgggcatcattgataaatggacctgctgttcaaaggaagtttgtggatgtgacacgactttgtgtgaaactagcattccaacatgtacaaatagtcaaaaattgattgttggccacagtcctctttcttgctgtccacagtacaaatgtgaatgtgacccattgaaatgccccagtatttcaacaccagaatgcagagaagatcaattcatgattcaagttcgacaggaagaaccttgttgtttttcccctttttgtgtttgtgaatcttgcaccaaacctgttccactatgtcatgatggggaatttctcacagtagatcttaatagcacacacttctgttgtcctcagtattactgtgtatgtgaaccaaacctttgtcctatgccattactcaactgtgcagaagatatgaatcttgtgaaagaaaatgtatctggtcaatgttgcccaacatggcactgtgaatgtaactgtgaaaaccttattatgccaacttgtgaagtgggagaatttactgcaatagaccataacttccagagtgattgtggatgcatacagtatctctgtgaaaaggatgatgtgtgtgtatttcaagaagtatcagtattgaatcctggacaatccatgataaagtatttggaagaagacttttgttatgctatagagtgtctggaagaaaaagataaccatacgggctttcacactctgaattttacactggtgaattgttcaaaaaaatgtgatgttcaccaggtatatactccatccccaagtgattatggttgttgtggtacctgcaaaaatgtatcctgcaaatttcacatggaaaatggaacatcagttgtatacgcggtagggagtacctggcactacaattgcaccacatatgaatgtgttaaaactgatgaaggagcaataattctgaactacacaatggtctgtcccccttttaatgagactgaatgcaaaatgaatgaagggattgtgaagctttataatgaaggctgttgcaagatctgcaaacgagaagaaagaatatgccagaaagtgatcattaaatcggtcataaggaaacaggactgtatgagccaaagccctataaatgttgcatcttgtgacggcaaatgcccatcagctaccatatataacatcaatattgaaagtcacctaagattctgcaagtgttgtcgtgaaaatggagtacgaaacttgtctgtgcctctgtattgctcaggaaatggcactgaaattatgtacactctccaggaacccatagactgtacgtgccagtggaattaaacccttgggttccaagagctctatacaacatcataacgtcagatagaattaacttttattgctattacttaggcatgtggcagatttatgctgtttaacaatactgtatttttcagacttggaatgtggaaatttagcaatttgtacaaaatatatacagtttcaatagcaaaattaaatttattgctttactctattttagaaaatcaaatgactgtaagttgttcagctgaaatgctgttatgtatttaattacaacttggtgcagatacagtatattctcatcaactggaaggttattttgcaaaattccttcaatttcactcagtagctctttttttcttaatttgcaaagtctgctatagctatccaaattaaggtaccctttaatatgtactccttaatctggtaaatgtgatcagttaaaattgtcatctagatagcaataaagagtgatatgcttagagatagataatggattatttaaaacctgaatggtttatagagaagtcattataaattcccctcattttgcaggtgtaacagataaccagagaagctgtgtgactcgtacaaatttattcagtgtaataatatagtaaattcatgttaacagttggattaaatcctagctctctcttattccagtactatatcacttttaaaatcctgagcagtatgtagtaagagtatatcacagaatctttcattcttaaagagtttgcattggatagaattaagtattttaagtttaacatatttgaaaaatgccccccatacattgttattccaatagtaaggagcagggaaatatagcatcatttgctaaatagaggagatagatcttgaactgttattttttatataattaaaactgctattaaatgtgttgtcagtatttaacatttagttactgtctcattaatatttaattttgaggatgtacttgcatactgttgaagttgagtgctgttttgctgttaatgctgctgctttgccaatgaagaatgaaataaatttatctgaatgtatcaataacttt

SEQ ID NO: 5473 - DNA, 1434 bp, Homo sapiens
atgtggatgttttcttggctttgtgctattttaattattttggctattgctggtatgaacacaatagcaaagaccacaccacataccaaatttacgaagaaatctgaggaaagagagatgccaaagggtctaaagccatccagtggcccacctccagaagaagaagaaaccctcttcacagaaatggctgaaatggcagaaccaattaccaaaccctcggccttggattctgtctttggcactgccactctctctccctttgaaaacttcactcttgacccagctgatttctttttgaattgttgtgattgttgttcacctgtacccgggcagaaaggagaacctggagagactggacagccaggtcctaaaggagaggctggaaatttggggatcccagggccaccaggagttgttgggccccaaggccctagaggctacaaaggagagaaaggactcaaaggagaacgtggggaccaaggagttccaggatacccaggaaaaccgggagcacaaggtgaacctggccctaagggagataaaggaaacattggtttgggaggagtgaaaggacaaaaaggctccaagggagacacatgtgggaattgtaccaaaggagaaaaaggagaccaaggggctatgggctcacctggcctgcacggagggcctggcgccaagggagagaagggggagatgggggagaagggggagatgggggataagggctgctgtggagattctggggagaggggaggaaaaggacagaaaggtgaggggggtatgaaaggggaaaaaggtagcaaaggagacagtggaatggaaggcaaaagcggccgtaatggtctgcctggggccaaaggtgatccagggattaaaggagaaaaaggagagttaggtcctcctggtctcctgggacctactgggccgaagggtgacattggcaacaaaggggtccgaggccccactgggaagaagggctctcggggctttaaaggctccaagggtgagttggctagagtgccccggtcggctttcagcgctggtttgtcaaagccatttcctcctcctaacatccccatcaaatttgaaaagattctctataatgaccaagggaattacagtcctgtcactgggaagtttaactgctctattcctgggacatatgttttttcctaccatattacggtgagggggcgacctgctcgaatcagtctggtggcccagaataagaagcagttcaagtccagagaaactctctatggtcaggaaatagaccaggcctctctcctcgtcatcttgaaattaagtgcaggagaccaagtctggcttgaggtgtcaaaagattggaatggggtgtatgtcagtgctgaggatgacagcatttttactgggttccttttgtacccagaggaaacttctggaatttcaccataa

SEQ ID NO: 5474 - DNA, 2740 bp, Homo sapiens
ccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacaggtacttctgcagtggaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttc

SEQ ID NO: 5475 - DNA, 2682 bp, Homo sapiens
ccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttccctgagcgactctgttctgtgtggggcaggggttgggcgggcctctgggcagaggatgcaatggcacggaccttggcttgacctcagaggtgtgaatgctctccagcagggtctgtctgggggcctggagtttgtatttgatttgctgcttattaaacctccttctggacctattgccactgg

SEQ ID NO: 5476 - DNA, 970 bp, Homo sapiens
gaagcgggaaagggccacaatggggtctgggaggtgggcggggcggagcggggatgtccagccacgtcgctttgttttcccacgctaggagctaccacaacaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctc

SEQ ID NO: 5477 - DNA, 762 bp, Homo sapiens
atgggctcggacgcctgggtgggcctttggcggccacaccggccccgcggccccatcgcggcgcactacggaggccccgggcccaaatacaagctgccgcccaacaccggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactga

SEQ ID NO: 5478 - DNA, 465 bp, Homo sapiens
atgctcccaggctacgccctgcatcccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacatattcggtacccccatatccggatctcaaatcccaaaccccgccacggggctttgataaatcgtggctcagactccccactagtcccaggaccccatctcgggtacccaccaggctcccacgcagttctagccccccacacccttga

SEQ ID NO: 5479 - DNA, 1196 bp, Homo sapiens
tccaagctctgccgtgacgtcatctccagctccagcctgctggggcctgtgctgactgtgccccagacagccttagctgctcaagctggagaactgtcttccttcccagcttcctccgtgtctggggtgggggatgggggggtctcaggcagggatactctagccccttgactgctgtttagaccctgctgtagctgctgctgctccctgcccagccccagccatgaaactgcccaaggggaccaggagctctgtgtactttgcacagcacccagaaaaggagccattgccctcaaggcaggaggtcaagcagacccctgtcatcatggccaagatcaaaggtccggggcccgccaagtacctccggccatcctgcacgggctacatagatcatgacatctccatgttcaaggcaccagcttataccctgcatagccggcactcagagaagcggatggtgtgccacagcagccctgggccttgctatctcttggatcccaaaataactcggtttggaatgtccagctgcccgcaggtccccatggaggagcgcatctccaacctgcgcctgaaccccaccctcgcatcctgccagtactactttgagaagatccacccaccgggggaacgcagggctccccagtacacgtttggctaccggcgcccatacagagtgatggacctcaacccggctcccaaccagtaccagatgccactcttgctggggcccaacacccctgtcagccgagctgctccctgctacagtctggcctccagggacaagaactggttctacaaggaggatgtggcaggaggccctggacctaccacgtacgcccgacctgagccatccatctatcagaaccgcagccctacttacagcatggccaagcgcttcgcctaccctctggacctcacgccacggcctggccccggctcccacgaggtccagcaggtcactgtgcacaagccccacatccctgctttcaccatgggcatcaagcactcactccacctgtgcccactggtcatcgacattcgtgactgaggcccctcttggggcactcactgcccctcatccccagaaattatttttctacaccaaattgagcaatttgaccaagatttctagtagcagagccggtacctgctgagtgtccggcacacagaagacattagagatacattttcatgta

SEQ ID NO: 5480 - DNA, 1606 bp, Homo sapiens
actcgatcccggccccacttccaggccagtgtccggccgaccagcctgccttgggccagggccccacgactccctgctgcgggacaagaggccgtctgtgcggctgtggtcgtgggagggtgtggtgaggccgtgaaggtggggacggtgcctgggcctgtggccgccagagctgctgcggctcagaaggtagcaccaggccccgtgggtgctgtgggggccatcgcctgcccaccatggggaccctcagctgcgactccaccccacggctggccacagccccccttggccggcgagtgacggagggccagattccggagaccggcctgaggaagtcctgtgggacggccaccctggagaacggctcggggccaggcttgtatgtcctgccgtccaccgtgggcttcatcaaccacgactgcaccagggtggccagtcccgcctactcgctcgtccggaggcccagtgaggcaccacctcaggacaccagcccgggccccatctacttcttggaccccaaagtcacacgctttggccgcagctgcacccctgcctactccatgcagggccgggccaagtctcggggtccggaggtgacgccaggccctggggcctacagcccagagaaggtgccccctgtgcgccatcggacaccgccggctttcaccctgggctgccgcctccccctgaagcccctggacacctcagcccctgcccctaatgcctacaccatgccccctctgtggggctcacagatcttcaccaagcccagcagccccagctacacggtggtgggccgcaccccccccgcccgccccccgcaggatcctgctgagataccaggcccgggccagtacgacagcccggacgcaaacacctaccgccagcgcctgcctgccttcaccatgctggggcggccccgggccccgcgacccctggaggagacccccggccctggcgcccactgcccagagcaggtcaccgtgaacaaagccagggctccagcgttctctatgggcatccgccactcgaaacgggccagcaccatggccgccaccacgccctcccggcctgcggggcacaggctgcccggccgctgctgctaggccaggcctgtttcccacacagtgaacggggggctggcgggcctctcctggggcctggctttggctggaggggctagaaggcgagaggggctgggaaaggagtcttccctcccctttcctgaactgtccaggtccttctaggacacctgatccttccagtccctgggggctgtgacccatggccctgtgcagggtgcagggtgagtctccttccagtgccccagtttcttccaggtcacgccaggccaggccaggccaggtggggaaagggacaccttccggccctccccagtagctggctggagatggagcttcctgtgtcccagaactcggcgtccagctccactagggcctggatccccatcacagcttgggttagccccggtcccagcccaaactcaggctggaggcagccccgaggcctgtgcctttcccactccaccttctacagttgcttagccaataaacctttcctgggctggagagctgtcagcatcaca

SEQ ID NO: 5481 - DNA, 1498 bp, Homo sapiens
actcgatcccggccccacttccaggccagtgtccggccgaccagcctgccttgggccagggccccacgactccctgctgcgggacaagaggccgtctgtgcggctgtggtcgtgggagggtgtggtgaggccgtgaaggtggggacggtgcctgggcctgtggccgccagagctgctgcggctcagaaggtagcaccaggccccgtgggtgctgtgggggccatcgcctgcccaccatggggaccctcagctgcgactccaccccacggctggccacagccccccttggccggcgagtgacggagggccagattccggagaccggcctgaggaagtcctgtgggacggccaccctggagaacgcaccacctcaggacaccagcccgggccccatctacttcttggaccccaaagtcacacgctttggccgcagctgcacccctgcctactccatgcagggccgggccaagtctcggggtccggaggtgacgccaggccctggggcctacagcccagagaaggtgccccctgtgcgccatcggacaccgccggctttcaccctgggctgccgcctccccctgaagcccctggacacctcagcccctgcccctaatgcctacaccatgccccctctgtggggctcacagatcttcaccaagcccagcagccccagctacacggtggtgggccgcaccccccccgcccgccccccgcaggatcctgctgagataccaggcccgggccagtacgacagcccggacgcaaacacctaccgccagcgcctgcctgccttcaccatgctggggcggccccgggccccgcgacccctggaggagacccccggccctggcgcccactgcccagagcaggtcaccgtgaacaaagccagggctccagcgttctctatgggcatccgccactcgaaacgggccagcaccatggccgccaccacgccctcccggcctgcggggcacaggctgcccggccgctgctgctaggccaggcctgtttcccacacagtgaacggggggctggcgggcctctcctggggcctggctttggctggaggggctagaaggcgagaggggctgggaaaggagtcttccctcccctttcctgaactgtccaggtccttctaggacacctgatccttccagtccctgggggctgtgacccatggccctgtgcagggtgcagggtgagtctccttccagtgccccagtttcttccaggtcacgccaggccaggccaggccaggtggggaaagggacaccttccggccctccccagtagctggctggagatggagcttcctgtgtcccagaactcggcgtccagctccactagggcctggatccccatcacagcttgggttagccccggtcccagcccaaactcaggctggaggcagccccgaggcctgtgcctttcccactccaccttctacagttgcttagccaataaacctttcctgggctggagagctgtcagcatcaca

SEQ ID NO: 5482 - DNA, 3405 bp, Homo sapiens
atgggcctgctggccagtgctggtttgttgctgttgctggtcatcggccaccccagaagcctaggactgaagtgtggaattcgcatggtcaacatgaaaagtaaggaacctgccgtgggatctagattcttctctagaattagtagttggagaaattcaacagtgactggacatccatggcaggtctccctaaaatcagatgagcaccacttctgtggaggaagcttgattcaagaagatcgggttgttacagcagcacactgcctggacagcctcagtgagaagcagctgaagaatataactgtgacttctggggagtacagcctctttcagaaggataagcaagaacagaatattcctgtctcaaaaattattacccatcctgaatacaacagccgtgaatatatgagtcctgatattgcactgctgtatctaaaacacaaagtcaagtttggaaatgctgttcagccaatctgtcttcctgacagcgatgataaagttgaaccaggaattctttgcttatccagtggatggggcaagatttccaaaacatcagaatattcaaatgtcctacaagaaatggaacttcccatcatggatgacagagcgtgtaatactgtgctcaagagcatgaacctccctcccctgggaaggaccatgctgtgtgctggcttccctgattggggaatggacgcctgccagggggactctggaggaccactggtttgtagaagaggtggtggaatctggattcttgctgggataacttcctgggtagctggttgtgctggaggttcagttcccgtaagaaacaaccatgtgaaggcatcacttggcattttctccaaagtgtctgagttgatggattttatcactcaaaacctgttcacaggtttggatcggggccaacccctctcaaaagtgggctcaaggtatataacaaaggccctgagttctgtccaagaagtgaatggaagccagagaggaaagggtattttagacatggaaaagcaagttggatgtgatcatgactatgtatctttacgatcaagcagtggagtgctttttaatcagagatctctcatggaagacgatggaaaacaaaacaaacgtgtctgtggaaaaatattgccttcaccattgctggcagagaccagtgaggccatggttccatttgtttctgatacagaagacagtggcagtggctttgagcttaccgttactgctgtacagaagtcagaagcagggtcaggttgtgggagtctggctatattggtagaagaagggacaaatcactctgccaagtatcctgatttgtatcccagtaacacaaggtgtcattggttcatttgtgctccagagaagcacattataaagttgacatttgaggactttgctgtcaaatttagtccaaactgtatttatgatgctgttgtgatttacggtgattctgaagaaaagcacaagttagctaaactttgtggaatgttgaccatcacttcaatattcagttctagtaacatgacggtgatatactttaaaagtgatggtaaaaatcgtttacaaggcttcaaggccagatttaccattttgccctcagagtctttaaacaaatttgaaccaaagttacctccccaaaacaatcctgtatctaccgtaaaagctattctgcatgatgtctgtggcatccctccatttagtccccagtggctttccagaagaatcgcaggaggggaagaagcctgcccccactgttggccatggcaggtgggtctgaggtttctaggcgattaccaatgtggaggtgccatcatcaacccagtgtggattctgaccgcagcccactgtgtgcaattgaagaataatccactctcctggactattattgctggggaccatgacagaaacctgaaggaatcaacagagcaggtgagaagggccaaacacataatagtgcatgaagactttaacacactaagttatgactctgacattgccctaatacaactaagctctcctctggagtacaactcggtggtgaggccagtatgtctcccacacagcgcagagcctctattttcctcggagatctgtgctgtgaccggatggggaagcatcagtgcagatggtggcctagcaagtcgcctacagcagattcaagtgcatgtgttagaaagagaggtctgtgaacacacttactattctgcccatccaggagggatcacagagaagatgatctgtgctggctttgcagcatctggagagaaagatttctgccagggagactctggtgggccactagtatgtagacatgaaaatggtccctttgtcctctatggcattgtcagctggggagctggctgtgtccagccatggaagccgggtgtatttgccagagtgatgatcttcttggactggatccaatcaaaaatcaatggtcctgcttcacttcagacaaataataaatgcaaaaccttaaaacaacaattgccaccacccacaccttcaccagacagtgcatcttggccaggttgttgctctgaagcagagctagaaaagcctagaggcttttttcccacaccacggtatctactggattatagaggaagactggaatgttcttgggtgctcagagtttcagcaagcagtatggcaaaatttaccattgagtatctgtcactcctggggtctcctgtgtgtcaagactcagttctaattatttatgaagaaagacacagtaagagaaagacggcaggtggattacatggaagaagactttactcaatgactttcatgagtcctggaccgctggtgagggtgacattccatgcccttgtacgaggtgcatttggtataagctatattgtcttgaaagtcctaggtccaaaggacagtaaaataaccagactttcccaaagttcaaacagagagcacttggtcccttgtgaggatgttcttctgaccaagccagaagggatcatgcagatcccaagaaattctcacagaactactatgggttgccaatggagattagtagcccctttaaatcacatcattcagcttaatattattaacttcccgatgaagccaacaacttttgtctgtcatggtcatctgcgtgtttacgaaggatttggaccaggaaaaaaattaatagcttcattcgctggaactctggcaatgatactgacaaaagacatattaaaaagagaaaaactgaattttattaacacatatatcatgcatatatgggaaaattcagtgtatgataatgtaagaagtgttggaaaaagaaaacagaagaaatttgcatcaaatttaagttatagtatggaggctgagaagtccaggatccaggtgccagcagatttggtgcctgctaagggctcactttctggttcttag

SEQ ID NO: 5483 - DNA, 1695 bp, Homo sapiens
atgcttataagcaggaacaagctgattttactactaggaatagtcttttttgaacgaggtaaatctgcaactctttcgctccccaaagctcccagttgtgggcagagtctggttaaggtacagccttggaattattttaacattttcagtcgcattcttggaggaagccaagtggagaagggttcctatccctggcaggtatctctgaaacaaaggcagaagcatatttgtggaggaagcatcgtctcaccacagtgggtgatcacggcggctcactgcattgcaaacagaaacattgtgtctactttgaatgttactgctggagagtatgacttaagccagacagacccaggagagcaaactctcactattgaaactgtcatcatacatccacatttctccaccaagaaaccaatggactatgatattgcccttttgaagatggctggagccttccaatttggccactttgtggggcccatatgtcttccagagctgcgggagcaatttgaggctggttttatttgtacaactgcaggctggggccgcttaactgaaggtggcgtcctctcacaagtcttgcaggaagtgaatctgcctattttgacctgggaagagtgtgtggcagctctgttaacactaaagaggcccatcagtgggaagacctttctttgcacaggttttcctgatggagggagagacgcatgtcagggagattcaggaggttcactcatgtgccggaataagaaaggggcctggactctggctggtgtgacttcctggggtttgggctgtggtcgaggctggagaaacaatgtgaggaaaagtgatcaaggatcccctgggatcttcacagacattagtaaagtgcttccctggatccacgaacacatccaaactggtaatcggagaaagagctccagagcctggtgcagtgagcaggatgtcatagtcagcggggctgaggggaagctgcacttcccagaaagcctccacctatattatgagagcaagcaacggtgtgtctggaccctgctggtaccagaggaaatgcatgtgttgctcagtttttcccacctagatgttgagtcttgtcaccacagttacctgtcaatgtattctttagaagacagacccattggaaaattttgtggagaaagcctcccttcatccattcttattggctctaattctctaaggctgaaattcgtctctgatgccacagataatgcagctgggtttaatcttacctataaagctcttaaaccaaactacattcctgattcaggttgcagttacttaactgtcctttttgaagaaggtctcatacagagtctaaactatcctgaaaactacagtgacaaggctaactgtgactggatttttcaagcctccaaacatcacctaattaagctttcatttcagagtctggaaatagaagaaagtggagactgcacttccgactatgtgacagtgcacagcgatgtagaaaggaagaaggaaatagctcggctgtgtggctatgatgtccccacccctgtgctgagcccctccagcatcatgctcatcagcttccaatcagatgaaaacgggacctgcaggggctttcaggctacagtctccttcattcctaaagcaggtaagaagatagagttaccaactctttggttcccagttctaatccttgtgatgtga

SEQ ID NO: 5484 - DNA, 806 bp, Homo sapiens
atgccccgcgccttcctggtcaggagtcggcgtccacagccccccaactggggccatctgcctgaccagctccggggagatgcctatatcccagactgcagcagcctgggggggccaccggcacaacagtcgtccagtgtcagggatccgtggacagcggtgagtgtcctcgggacctgtccgcccctacttctctgtgttgggaatgcctctcctttcctagtagcaccagggccggcagccacagggatctcttccagcggggcacaagattcatccccacatgtggatgatccgctttatctgtgcatgcattggaggaaggaaagcgccagccggaatcagcccacacagggcaacctgacctctgctcccaggggccctgggacgctgggctgcccgctctgccctaaggccttccctctgcagcgcatgctgacaaggcacctcaagtgccacagccccgtgcgccgccacctgtgccgctgttgtggcaagggctttcatgacgccttcgatctcaagcgccacatgaggactcacactgggatccggcccttccgctgcagtgcttgcgggaaagcgtttacgcagcgctgctccctggaagctcaccttgctaaggtgcatggacagccggccagctacgcttaccgtgagcgccgcgagaagctgcacgtgtgcgaggactgcggcttcaccagctcccggcccgacacctacgcacagcaccgcgccctgcaccgcgcagcctgatacggtgtgccagcgtcctccccacgaggcaaataaacacagaaaactca

SEQ ID NO: 5485 - DNA, 2391 bp, Homo sapiens
ggagcaactcagcaattctgttaccgataatcacctaacaggtaaacaagatggcagggaggaaagtccacgtctcgccccacagttccccatatcagcaaatcttcaaattctagaacaaggtcagggtcagcaggggcagggcaggtttggaggaaggccaggccaagcccaggagaagagacagggtccagggaagcccacctccttcctgggtctcccctccagacccccaagacccccagcctcaggccttctcaagccccagccttaaggagttgagcactccagggtggggggtctctgatcctgggtgcctgtctctctctgcctcagtttacacattcaaaaccactgggaagccacagaccaggcaccgtgggatggggaagtggagaccgagaggctgctgccggggaaatatgcagtgcagacaagaggttcctgctactctcacctcatcagagttgttttctaccaggaaccagccccagccccagccccagcccctgctggcagatgctccggtaccctgggctgtggcttccaggatgtgcctgactccagggcagggctgtggccaccagggccaggacgagggtccgctgccagccccaagccccccaccagccatgagctcctccagaaaggaccacctcggcgccagcagctcagagcccctcccggtcatcattgtgggtaacggcccctctggtatctgcctgtcctacctgctctccggctacacaccctacacgaagccagatgccatccacccacaccccctgctgcagaggaagctcaccgaggccccgggggtctccatcctggaccaggacctggactacctgtccgaaggcctcgaaggccgatcccaaagccccgtggccctgctctttgatgcccttctacgcccagacacagactttgggggaaacatgaagtcggtcctcacctggaagcaccggaaggagcacgccatcccccacgtggttctgggccggaacctccccgggggagcctggcactccatcgaaggctccatggtgatcctgagccaaggccagtggatggggctcccggacctggaggtcaaggactggatgcagaagaagcgaagaggtcttcgcaacagccgggccactgccggggacatcgcccactactacagggactacgtggtcaagaagggtctggggcataactttgtgtccggtgctgtagtcacagccgtggagtgggggacccccgatcccagcagctgtggggcccaggactccagccccctcttccaggtgagcggcttcctgaccaggaaccaggcccagcagcccttctcgctgtgggcccgcaacgtggtcctcgccacaggcacgttcgacagcccggcccggctgggcatccccggggaggccctgcccttcatccaccatgagctgtctgccctggaggccgccacaagggtgggtgcggtgaccccggcctcagaccctgtcctcatcattggcgcggggctgtcagcggccgacgcggtcctctacgcccgccactacaacatcccggtgatccatgccttccgccgggccgtggacgaccctggcctggtgttcaaccagctgcccaagatgctgtaccccgagtaccacaaggtgcaccagatgatgcgggagcagtccatcctgtcgcccagcccctatgagggttaccgcagcctccccaggcaccagctgctgtgcttcaaggaagactgccaggccgtgttccaggacctcgagggtgtcgagaaggtgtttggggtctccctggtgctggtcctcatcggctcccaccccgacctctccttcctgcctggggcaggggctgactttgcagtggatcctgaccagccgctgagcgccaagaggaaccccattgacgtggaccccttcacctaccagagcacccgccaggagggcctgtacgccatggggccgctggccggggacaacttcgtgaggtttgtgcaggggggcgccttggctgtggccagctccctgctaaggaaggagaccaggaagccaccctaacactcggccagacccgctggctcccaggccctgagaggacagagatgaccacatccctgctggatgcaggacccgtccaaagatgccccggggaggggtgtcagcccacgttgctggcctttggggtcaagaggagtagggatcccaggctgccctggacttagaccagtgtctgaggtggtaacagcggccgcaggccagggttggcctagacctgggatttgtggggaaagctgctggtgtgaccagctgagcacccagccaggagacctgcagccctgcgccttccagaagcaggtcccaaataaagccagtgcccacctgc

SEQ ID NO: 5486 - DNA, 2231 bp, Homo sapiens
ggagcaactcagcaattctgttaccgataatcacctaacaggtaaacaagatggcagggaggaaagtccacgtctcgccccacagttccccatatcagcaaatcttcaaattctagaacaaggtcagggtcagcaggggcagggcaggtttggaggaaggccaggccaagcccaggagaagagacagggtccagggaagcccacctccttcctgggtctcccctccagacccccaagacccccagcctcaggccttctcaagccccagccttaaggagttgagcactccagggtggggggtctctgatcctgggtgcctgtctctctctgcctcagtttacacattcaaaaccactgggaagccacagaccaggcaccgtgggatggggaagtggagaccgagaggctgctgccggggaaatatgcagtgcagacaagaggtccgctgccagccccaagccccccaccagccatgagctcctccagaaaggaccacctcggcgccagcagctcagagcccctcccggtcatcattgtgggtaacggcccctctggtatctgcctgtcctacctgctctccggctacacaccctacacgaagccagatgccatccacccacaccccctgctgcagaggaagctcaccgaggccccgggggtctccatcctggaccaggacctggactacctgtccgaaggcctcgaaggccgatcccaaagccccgtggccctgctctttgatgcccttctacgcccagacacagactttgggggaaacatgaagtcggtcctcacctggaagcaccggaaggagcacgccatcccccacgtggttctgggccggaacctccccgggggagcctggcactccatcgaaggctccatggtgatcctgagccaaggccagtggatggggctcccggacctggaggtcaaggactggatgcagaagaagcgaagaggtcttcgcaacagccgggccactgccggggacatcgcccactactacagggactacgtggtcaagaagggtctggggcataactttgtgtccggtgctgtagtcacagccgtggagtgggggacccccgatcccagcagctgtggggcccaggactccagccccctcttccaggtgagcggcttcctgaccaggaaccaggcccagcagcccttctcgctgtgggcccgcaacgtggtcctcgccacaggcacgttcgacagcccggcccggctgggcatccccggggaggccctgcccttcatccaccatgagctgtctgccctggaggccgccacaagggtgggtgcggtgaccccggcctcagaccctgtcctcatcattggcgcggggctgtcagcggccgacgcggtcctctacgcccgccactacaacatcccggtgatccatgccttccgccgggccgtggacgaccctggcctggtgttcaaccagctgcccaagatgctgtaccccgagtaccacaaggtgcaccagatgatgcgggagcagtccatcctgtcgcccagcccctatgagggttaccgcagcctccccaggcaccagctgctgtgcttcaaggaagactgccaggccgtgttccaggacctcgagggtgtcgagaaggtgtttggggtctccctggtgctggtcctcatcggctcccaccccgacctctccttcctgcctggggcaggggctgactttgcagtggatcctgaccagccgctgagcgccaagaggaaccccattgacgtggaccccttcacctaccagagcacccgccaggagggcctgtacgccatggggccgctggccggggacaacttcgtgaggtttgtgcaggggggcgccttggctgtggccagctccctgctaaggaaggagaccaggaagccaccctaacactcggccagacccgctggctcccaggccctgagaggacagagatgaccacatccctgctggatgcaggacccgtccaaagatgccccggggaggggtgtcagcccacgttgctggcctttggggtcaagaggagtagggatcccaggctgccctggacttagaccagtgtctgaggtggtaacagcggccgcaggccagggttggcctagacctgggatttgtggggaaagctgctggtgtgaccagctgagcacccagccaggagacctgcagccctgcgccttccagaagcaggtcccaaataaagccagtgcccacctgc

SEQ ID NO: 5487 - DNA, 1940 bp, Homo sapiens
acttccctctggcctctcagagcctcttggatccccacagggtaatgggtgtcccgatctcgcgggggactctgtgatccgtgttcccctgaccctcctagtgcacaacttggccgggctcactgggctcctgcaccactgcctgtcaggtccgctgccagccccaagccccccaccagccatgagctcctccagaaaggaccacctcggcgccagcagctcagagcccctcccggtcatcattgtgggtaacggcccctctggtatctgcctgtcctacctgctctccggctacacaccctacacgaagccagatgccatccacccacaccccctgctgcagaggaagctcaccgaggccccgggggtctccatcctggaccaggacctggactacctgtccgaaggcctcgaaggccgatcccaaagccccgtggccctgctctttgatgcccttctacgcccagacacagactttgggggaaacatgaagtcggtcctcacctggaagcaccggaaggagcacgccatcccccacgtggttctgggccggaacctccccgggggagcctggcactccatcgaaggctccatggtgatcctgagccaaggccagtggatggggctcccggacctggaggtcaaggactggatgcagaagaagcgaagaggtcttcgcaacagccgggccactgccggggacatcgcccactactacagggactacgtggtcaagaagggtctggggcataactttgtgtccggtgctgtagtcacagccgtggagtgggggacccccgatcccagcagctgtggggcccaggactccagccccctcttccaggtgagcggcttcctgaccaggaaccaggcccagcagcccttctcgctgtgggcccgcaacgtggtcctcgccacaggcacgttcgacagcccggcccggctgggcatccccggggaggccctgcccttcatccaccatgagctgtctgccctggaggccgccacaagggtgggtgcggtgaccccggcctcagaccctgtcctcatcattggcgcggggctgtcagcggccgacgcggtcctctacgcccgccactacaacatcccggtgatccatgccttccgccgggccgtggacgaccctggcctggtgttcaaccagctgcccaagatgctgtaccccgagtaccacaaggtgcaccagatgatgcgggagcagtccatcctgtcgcccagcccctatgagggttaccgcagcctccccaggcaccagctgctgtgcttcaaggaagactgccaggccgtgttccaggacctcgagggtgtcgagaaggtgtttggggtctccctggtgctggtcctcatcggctcccaccccgacctctccttcctgcctggggcaggggctgactttgcagtggatcctgaccagccgctgagcgccaagaggaaccccattgacgtggaccccttcacctaccagagcacccgccaggagggcctgtacgccatggggccgctggccggggacaacttcgtgaggtttgtgcaggggggcgccttggctgtggccagctccctgctaaggaaggagaccaggaagccaccctaacactcggccagacccgctggctcccaggccctgagaggacagagatgaccacatccctgctggatgcaggacccgtccaaagatgccccggggaggggtgtcagcccacgttgctggcctttggggtcaagaggagtagggatcccaggctgccctggacttagaccagtgtctgaggtggtaacagcggccgcaggccagggttggcctagacctgggatttgtggggaaagctgctggtgtgaccagctgagcacccagccaggagacctgcagccctgcgccttccagaagcaggtcccaaataaagccagtgcccacctgc

SEQ ID NO: 5488 - DNA, 4209 bp, Homo sapiens
ggtgtggtctggggcgggcctgatgagcacctggattttcacccggcgtgctggtaattcctacacttgtgggtgtttgagagacatgaagaggggaggatgacctcttcccggaagcgggacttccataaaagaagcgtggtgggcgggtcccgggcacctgtggtttggtgagtcctccaggtaactgtgatgcgggggtcagcgggagaggcacccggaagctcccggcgtctgcaccccggcagcgcgaggaaatgcccaaagaaactatagtgacactgaaactgaaggagagatttttaattccttagtgcaatactttggtgacaacttggggcgaaaagttaaagcgatgccattagttgaagaaacttctttactggaagattcgtcagtgacttttcctgtggtaataataggaaatggaccctcaggaatatgcctttcttatatgttatcaggctacagaccgtatttatcatcagaagcaatacacccaaatacaatcttaaatagtaaattagaagaagcaagacatctttccattgttgatcaggacttagaatacttgtctgagggccttgagggccgatcatccaatccagttgcagtacttttcgatacacttcttcatccagatgctgactttgggtatgattatccatccgttttgcattggaaattagagcaacatcattatatccctcacgtagttcttggtaaaggtccacctggtggggcttggcataatatggaaggctccatgttgacaatcagctttggaagttggatggaactacctggacttaaatttaaggactgggtatcaagtaaacgaaggagcctaaaaggggatcgagttatgccagaggaaatagctcgctactataaacattatgtaaaagtcatgggtcttcagaagaatttcagagagaatacttacataacttccgtatcaagactctacagagatcaagatgatgatgatattcaagacagagatatttcaacaaagcatttacagatagagaagtcaaactttatcaagagaaactgggaaattaggggttatcagcgaatagctgatggttctcatgttcccttctgcctctttgctgagaatgtagcgctggcaactggaacgctggattctcctgcccatctggaaattgaaggggaagattttccttttgtgtttcattcaatgcctgaatttggagctgctataaacaaaggaaagttgcgtggcaaagtggatccagtgttaattgtaggttctgggcttactgccgctgacgcagtactgtgtgcttacaacagtaatatccctgtgattcatgtgtttcgcagacgagtaactgatccaagcttaattttcaaacagcttcccaaaaagctgtatcctgaatatcataaagtctatcatatgatgtgtactcagtcatattctgtagactcaaatcttttatctgattataccagctttcccgagcaccgtgtgctttcctttaagtcggacatgaaatgtgttctccaaagcgtttctggattgaagaaaatatttaagctgtctgcagcagtagtattgataggttctcatcctaatctgtcttttctgaaggatcaagggtgttacctaggccataagtcaagccagccaatcacatgtaagggtaatcctgtggaaatagatacatatacctatgagtgtattaaagaagccaacctttttgcattgggtcctttggttggagacaattttgttcgatttttaaagggaggggcgctgggtgttacacgctgtttagctacaagacagaagaaaaagcatttgtttgttgaaagaggaggaggagatgggatagcttaaagcaagtttacaagtaattaaaatggacagtttgccattaaagatttttaatagtggttttgcagtgtactggcttgaattttctggacttgagttaactgaaggagagcctcaaactatagtaacttcatttttaaaagttactagaatttggtatcctgatttatattgcagtgtttcaaaggtgtcactgtcagacaaatagaaacactgccaacttggtgtaacttaagctttcatttaactaaaacattcttttcttgcaaaacttatttttcatgatcatttttggttatttattatacttgattccaaaatagtacagccttgaatctataaaactgtgcagtcattatgccagaaattatcttaaatatataatgggtcaccttgctgttcaaagggtggtgcaaggtcctgcagcatcttacatctgtagcttgttagaaatgtaaactctcaggccccacaacttacttcctgcattttaacaagatccccaagggatatgtatgctcataaaaatttgagacactggtttaaatgaaaatggatataaggtatgtataactgggggtggggtgagggtaggaggcatttacaactcagattttatttattttgaaattatcaattgtataaatctaatttattaccaaatagggtcttttaaaaaatatttttatcgttgaaaccttgacaggtacttcatattcttctaataatttaaacagtccaataatgtggtatacactttgacatccaagaactcaccaagatgtttttcagagatttattctcgatttaactatcatagcatttaatgaatctgatttgtagttcaataaattgtgggttgaactacttatccctgtgtgaacattgaattactttctgtcactgaaactgaggtatttgggtgtggtaagtacttcgaaaattgtaatactgtttgggcattgtctaaattattaaaggttaaaatagaaaataaagtcagaatttttcttttccattccaaaggtgtacttagagatctctattagtattcattcgagatgacatagcagctcatatcatggttgtttattggatttatctgttctaattatataagtgtgtttactgtctgtgttttcacacaaactgctagaatttttaatgttaagacgaaaacatctgaagttctccatggcaaattgaatttttcagtcattttcttttctttttttggtacaattacttcatctggaatgtcttcattgaactcgttattctatttttcttagaattaaaagtggattaatgtgggtttttctgttcattttattgcagtattaaatgcttaagcttattaggaccataattcactttaaatataattgtatagaatatatttgcgtcgatcaaataattgcttcagatgaattcttagactcttgataatatcacacctaatttaacttgattttacaagctgtacaatccagttttagttttctattgtgataataacttttttcaaaccagtttcacatcttaatgaaataacattctctgactgcacttgcttcagtactctcttgcctgcctgtttttgacctctgcatgagttggattagatgtttttcttactgtcacttctaaatagaaaatgacagtgttataaaaaagggaaggataaaacctttgacatccccttgtgtctcaaaagtccacagttattcaaacaatggctttttttgtgatgagagtatttgttaaaaaaaaaaaaagacttcaagaaaaataaaagttcagtggagctgcaaataaatctggtgaataatttcatctttggtaatctcccatttcctgagttcttcctcaatccaagctgtcctgtgtagtatataacatttgggcattttctctgatatactatactctcatgttctataaatttctgtcccgtaattctaacactttacattttttctttgctatcagctatagctattcatggaagggaagaatcactaaatacttgtctagttatagcatgatgtgagcatctcctccttatccctcgatgcctggcttggtgtctggcaaacagtccataattagcagatgttgaaagaccgtttacaaagcagaatttggggatttaaagtgcaatgatacaacaaaaagatttaattacagcttccagtgttttgactatgtgaaccatatccaactacttttttgaaaatctagttctatgtaatatatttctgtggcatcaaattttagttgattgtattagtcaataggaagtggtggaaaatttctaaataaattcaactattaaa

SEQ ID NO: 5489 - DNA, 4266 bp, Homo sapiens
gctccgcccctatcgcggcgccccgagatcacccgcctccggcgcctggctccctgcaggcgaggagcggaagccgctatctggaggcggactccggcgccacagagccggggcagccgcggcaacggcgaggcgcgaggcaggggcgcccggcagaccccgcgaccccgagccagcgggcgccccgagcgggcagcctcgccgggggaggcggaggcggccacggcggccgcgctcgggcgcccctcgcgcagcgctccatgcccgtgtggtgctgccgctgctccctggccggtcatttcagaaactatagtgacactgaaactgaaggagagatttttaattccttagtgcaatactttggtgacaacttggggcgaaaagttaaagcgatgccattagttgaagaaacttctttactggaagattcgtcagtgacttttcctgtggtaataataggaaatggaccctcaggaatatgcctttcttatatgttatcaggctacagaccgtatttatcatcagaagcaatacacccaaatacaatcttaaatagtaaattagaagaagcaagacatctttccattgttgatcaggacttagaatacttgtctgagggccttgagggccgatcatccaatccagttgcagtacttttcgatacacttcttcatccagatgctgactttgggtatgattatccatccgttttgcattggaaattagagcaacatcattatatccctcacgtagttcttggtaaaggtccacctggtggggcttggcataatatggaaggctccatgttgacaatcagctttggaagttggatggaactacctggacttaaatttaaggactgggtatcaagtaaacgaaggagcctaaaaggggatcgagttatgccagaggaaatagctcgctactataaacattatgtaaaagtcatgggtcttcagaagaatttcagagagaatacttacataacttccgtatcaagactctacagagatcaagatgatgatgatattcaagacagagatatttcaacaaagcatttacagatagagaagtcaaactttatcaagagaaactgggaaattaggggttatcagcgaatagctgatggttctcatgttcccttctgcctctttgctgagaatgtagcgctggcaactggaacgctggattctcctgcccatctggaaattgaaggggaagattttccttttgtgtttcattcaatgcctgaatttggagctgctataaacaaaggaaagttgcgtggcaaagtggatccagtgttaattgtaggttctgggcttactgccgctgacgcagtactgtgtgcttacaacagtaatatccctgtgattcatgtgtttcgcagacgagtaactgatccaagcttaattttcaaacagcttcccaaaaagctgtatcctgaatatcataaagtctatcatatgatgtgtactcagtcatattctgtagactcaaatcttttatctgattataccagctttcccgagcaccgtgtgctttcctttaagtcggacatgaaatgtgttctccaaagcgtttctggattgaagaaaatatttaagctgtctgcagcagtagtattgataggttctcatcctaatctgtcttttctgaaggatcaagggtgttacctaggccataagtcaagccagccaatcacatgtaagggtaatcctgtggaaatagatacatatacctatgagtgtattaaagaagccaacctttttgcattgggtcctttggttggagacaattttgttcgatttttaaagggaggggcgctgggtgttacacgctgtttagctacaagacagaagaaaaagcatttgtttgttgaaagaggaggaggagatgggatagcttaaagcaagtttacaagtaattaaaatggacagtttgccattaaagatttttaatagtggttttgcagtgtactggcttgaattttctggacttgagttaactgaaggagagcctcaaactatagtaacttcatttttaaaagttactagaatttggtatcctgatttatattgcagtgtttcaaaggtgtcactgtcagacaaatagaaacactgccaacttggtgtaacttaagctttcatttaactaaaacattcttttcttgcaaaacttatttttcatgatcatttttggttatttattatacttgattccaaaatagtacagccttgaatctataaaactgtgcagtcattatgccagaaattatcttaaatatataatgggtcaccttgctgttcaaagggtggtgcaaggtcctgcagcatcttacatctgtagcttgttagaaatgtaaactctcaggccccacaacttacttcctgcattttaacaagatccccaagggatatgtatgctcataaaaatttgagacactggtttaaatgaaaatggatataaggtatgtataactgggggtggggtgagggtaggaggcatttacaactcagattttatttattttgaaattatcaattgtataaatctaatttattaccaaatagggtcttttaaaaaatatttttatcgttgaaaccttgacaggtacttcatattcttctaataatttaaacagtccaataatgtggtatacactttgacatccaagaactcaccaagatgtttttcagagatttattctcgatttaactatcatagcatttaatgaatctgatttgtagttcaataaattgtgggttgaactacttatccctgtgtgaacattgaattactttctgtcactgaaactgaggtatttgggtgtggtaagtacttcgaaaattgtaatactgtttgggcattgtctaaattattaaaggttaaaatagaaaataaagtcagaatttttcttttccattccaaaggtgtacttagagatctctattagtattcattcgagatgacatagcagctcatatcatggttgtttattggatttatctgttctaattatataagtgtgtttactgtctgtgttttcacacaaactgctagaatttttaatgttaagacgaaaacatctgaagttctccatggcaaattgaatttttcagtcattttcttttctttttttggtacaattacttcatctggaatgtcttcattgaactcgttattctatttttcttagaattaaaagtggattaatgtgggtttttctgttcattttattgcagtattaaatgcttaagcttattaggaccataattcactttaaatataattgtatagaatatatttgcgtcgatcaaataattgcttcagatgaattcttagactcttgataatatcacacctaatttaacttgattttacaagctgtacaatccagttttagttttctattgtgataataacttttttcaaaccagtttcacatcttaatgaaataacattctctgactgcacttgcttcagtactctcttgcctgcctgtttttgacctctgcatgagttggattagatgtttttcttactgtcacttctaaatagaaaatgacagtgttataaaaaagggaaggataaaacctttgacatccccttgtgtctcaaaagtccacagttattcaaacaatggctttttttgtgatgagagtatttgttaaaaaaaaaaaaagacttcaagaaaaataaaagttcagtggagctgcaaataaatctggtgaataatttcatctttggtaatctcccatttcctgagttcttcctcaatccaagctgtcctgtgtagtatataacatttgggcattttctctgatatactatactctcatgttctataaatttctgtcccgtaattctaacactttacattttttctttgctatcagctatagctattcatggaagggaagaatcactaaatacttgtctagttatagcatgatgtgagcatctcctccttatccctcgatgcctggcttggtgtctggcaaacagtccataattagcagatgttgaaagaccgtttacaaagcagaatttggggatttaaagtgcaatgatacaacaaaaagatttaattacagcttccagtgttttgactatgtgaaccatatccaactacttttttgaaaatctagttctatgtaatatatttctgtggcatcaaattttagttgattgtattagtcaataggaagtggtggaaaatttctaaataaattcaactattaaataaatgcaagttccactaaa

SEQ ID NO: 5490 - DNA, 4553 bp, Homo sapiens
gtgtcggcaggtggaggaagaggggaaagtttggcccgtgcgtggggctggggtggagggcgggacagaggggctgggcccaggcaaagcttctgtcgctgctgctgcggaggccgaggacaggacgtgggctgggccgggcagtgccggactcggaggagcaggaggcgaggtccgccggagctctgagcccccgctgctctgccgcgcggtgaccccgcgccccggcgccgtccgacccgtggctgttccgagacgattggtgggggcgcggcggcggcggcggcggctgttgggggtggggagacgcgcggcgaggagacgagcgaggtcagcgagtttgagggaggaccgcgagccgctgccgccgtcatgtccgaggactcgagcgccctgccctggtccatcaacagggacgattacgagctgcaggaggtgatcgggagtggagcaactgctgtagtccaagcagcttattgtgcccctaaaaaggagaaagtggcaatcaaacggataaaccttgagaaatgtcaaactagcatggatgaactcctgaaagaaattcaagccatgagtcaatgccatcatcctaatattgtatcttactacacatcttttgtggtaaaagatgagctgtggcttgtcatgaagctgctaagtggaggttctgttctggatattattaagcacattgtggcaaaaggggaacacaaaagtggagtcctagatgaatctaccattgctacgatactccgagaagtactggaagggctggaatatctgcataaaaatggacagatccacagagatgtgaaagctggaaacattcttcttggagaagatggctcagtacagattgcagactttggggttagtgcttttttagcaactggtggtgatattacccgaaataaagtgagaaagacctttgttggcaccccttgttggatggcacctgaagttatggaacaggtccgtggttatgatttcaaagctgatatttggagttttggaattacagcaattgaattggctacaggggcggctccttatcataaatatccaccaatgaaggttttaatgctgacactgcagaacgatcctccttctttggaaactggtgttcaagataaagaaatgctgaaaaaatatggaaaatcatttagaaaaatgatttcattgtgccttcaaaaagatccagaaaaaagaccaacagcagcagaactattaaggcacaaatttttccagaaagcaaagaataaagaatttcttcaagaaaaaacattgcagagagcaccaaccatttctgaaagagcaaaaaaggttcggagagtaccaggttccagtgggcgtcttcataagacagaggatggaggctgggagtggagtgatgatgaatttgatgaagaaagtgaggaagggaaagcagcaatttcacaactcaggtctccccgagtgaaagaatcaatatcaaattctgagctctttccaacaactgatcctgtgggtactttgctccaagttccagaacagatctctgctcatctacctcagccagctgggcagattgctacacagccaactcaagtctctctcccacccaccgcagagccagcaaaaacagctcaggctttgtcttcaggatcaggttcacaagaaaccaagatcccaatcagtctagtactaagattaaggaattccaaaaaagaactaaatgatattcgatttgaatttactcctgggagagatacagcagagggtgtctctcaggaactcatttctgctggcctggtcgacggaagggatttagtaatagtggcagctaatttgcagaaaattgtggaagaacctcagtcaaatcgatctgtcactttcaaactggcatctggtgtcgaaggctcagatattcctgatgatggtaaactgataggatttgcccagctcagcatcagctaaaccacaaccctggaagaggcggcctaaggagattccacacatgcgtatctctgttgcttctattggcctaaacccactactgccaaagaacccagcaacaaacctcccggctaggagctttagaagtctttatgttcttcctgccatcattcctccttttcccacagggaaagaaaagttggatcactagtggccagcatccccagagttccgttagtaaacttacttcatatgtcccctgtcttcctccatctgagaagtggcccatgtgcttcaaggcccaggagggagatctgtcagctcattcttgccttactccaatgatggcccaggtggaaaagtagcagctgtatcgggcttcctcatcctgcctgttcccccacacctgccaggatatggacatcttgggatatctctttaccactgaagtagaattgattgttcagctggagcccagagaatttaatttaatgttttttctttgtacctgatgtgaattctagcaacctttgttaggaaaaagcacagcctcagatggaggcagcctaaactgtgttcttgttttgttcatggtgtttctaagcgttttgctgaagctgctctcaggcacccccttcttcattgctctctccagaaagggttgctagccttaacttcagctggtgcaaaacatctgactgtagccgaacttcagccatcagatccttcaaagtggaactttggattgtttttacagacaacatcgagtaatggcttgtaaatgtgaattttgccagaggtggtttttgaacaggaaaatcataattcatatcattggagaagtatttattttcaaatatcaaattgaagaaaaactcaatcctcccatgaaaatcagttcgcctggcctccaagtcgtgaggaaatgggtatgcaaggctgagatttctacagcaataaaggagacacacactgggccagagaggcctgccttctgcctgctctcctgcactgaccctttggagggggtctctgtgtgctgaagctaactcaagatggaaagtgaaaccacatgtgccgtgacctttaggttttatgagtagacagtgttcatttgattttctacagaaataatataaattattctttaggtttaaaaaagagcactcataatgcaatatgtgaataatcagtgaggttgatttttcttttttcctaccgtttcatagtctttgtctaactgctagtaaccctaccgagttttatatatgagtgggatactcaatctggccttaaaaagatacacaaagatgggctgtgggtccctggaaagggggagagttgccctttacagaatcactcgagccctttccagcactgttggtctgatgaacaaggttgttttaccttattttctcttggaacatatctgaaaaccttccccacaaataacttgtcacaccttttgtttcattctgagtctttagttttagtcatgggctttcttcacctgctctaggtgcaaaggcatgttgggaaagagatggatgttggggaggaagagaggagatggatttcagttgggagttaggaggagagtaggtgagatgatcagacaccggagttcaacgtcccagcagtcttggtaaaaggagggagcctgctgagccaggagggagaaaagaagattgaccagcttgctagaaaaatacttagcttttctttttctttttttgtggaggggggacggagaggaacaaggatggggaggtaggaatgaggtatagaaaagagatagcatcttctttggcacaagactagtggcttaccgcttaccttagagttttgttttttttttttcaaacccatcaaaatctacttatttatgaatccaaggggtggcagcatcactctgttctagcattctttgtggagatggtctggtgcctagctgggagtgagcagcagcccatcccctgttcactttctctagcccatcattacctgtgaactgcagtggggcagtcatggcaaatagaattgggctggggtttctccttcttttcagttcattgtttgccctgctaggaattagaagacagacaccatgtcccaggacagtgttacttcttctgcatgatgtgtggtagactccctttgctggcttgtgcagtgatactgagaaaatacatgaacagaaactgcccaggtggaacagcacgtaacctagtgagtgactgtactcctttctaggaatgctgattcagagtgcacctctttgactaggtcccaggatccccttgtccctggagtagggactaactatagcacaaagtaatatgtgccaatgctatttgtgaaatgtttggtctttctaaacgactaaaggatttgttgggtttttgcttaagttttgaaccaaatcctagagccagctgataatatttaataatctggaggagagaataatgatgtaccaataagtggagattcctccttatgatgtatgctaggttatggaagatgtaaaatattcaactttttcctcctttttttggactttgtattttactgcatgttttcttcatttttaatcaataaagagtaaattgtcctta

SEQ ID NO: 5491 - DNA, 499 bp, Homo sapiens
gccacttctcttcccttcattcttcgccaggctctctgctgactcaagttcttcagttcacgatcttctagttgcagcgatgagtgcacgagtgagatcaagatccagaggaagaggagatggtcaggaggctcccgatgtggttgcattcgtggctcccggtgaatctcagcaagaggaaccaccaactgacaatcaggatattgaacctggacaagagagagaaggaacacctccgatcgaagaacgtaaagtagaaggtgattgccaggaaatggatctggaaaagactcggagtgagcgtggagatggctctgatgtaaaagagaagactccacctaatcctaagcatgctaagactaaagaagcaggagatgggcagccataagttaaaaagaagacaagctgaagctacacacatggctgatgtcacattgaaaatgtgactgaaaatttgaaaattctctcaataaagtttgagttttctctgaagaagtca

SEQ ID NO: 5492 - DNA, 493 bp, Homo sapiens
ctttccgccatcttgattctttgtcactgaccgagactcagccgtgggaaatatgagtgagcatgtgagaacaagatcccaatcctcagaaagaggaaatgaccaagagtcttcccagccagttggatctgtgattgtccaggagcccactgaggaaaaacgtcaagaagaggaaccaccaactgataatcagggtattgcacctagtggggagatcgaaaatgaaggagcacctgccgttcaagggcctgacatggaagcttttcaacaggaactggctctgcttaagatagaggatgagcctggagatggtcctgatgtcagggaggggattatgcccacttttgatctcactaaagtgctggaagcaggtgatgcgcaaccataggtttcaagcaagacaaatgaagactgaaaccaagaacgttattcttaatctggaaatttgactgataatattctcttaataaagttttaagttttctgcaaagaa

SEQ ID NO: 5493 - DNA, 381 bp, Homo sapiens
atgagtgagcatgtgagaacaagatcccaatcctcagaaagaggaaatgaccaagagtcttcccagccagttggatctgtgattgtccaggagcccactgaggaaaaacgtcaagaagaggaaccaccaactgataatcaggggcctgacatggaagcttttcaacaggaactggctctgcttaagatagaggatgagcctggagatggtcctgatgtcagggaggggattatgcccacttttgatctcactaaagtgctggaagcaggtgatgcgcaaccataggtttcaagcaagacaaatgaagactgaaaccaagaacgttattcttaatctggaaatttgactgataatattctcttaataaagttttaagttttc

SEQ ID NO: 5494 - DNA, 741 bp, Homo sapiens
aggcagagctctgcaaggagaggttgtgtcttcgttctttccgccatcttcgttctttccaacatcttcgttctttctcactgaccgagactcagccggtaggtctgcagagtggtcttcctggtaatttagttgtgagtgaatgtgtggaggagccagcgggcttaggacaggtcccgtggcacagtccgtggctttgagggaaaagggcctcgcggtggtcctccgccttcccccaggtcctgatgcaggcgccatgggccggtaatcgtggctgggctggaacgagggaggaagtgagagatatgagtgagcatgtaacaagatcccaatcctcagaaagaggaaatgaccaagagtcttcccagccagttggacctgtgattgtccagcagcccactgaggaaaaacgtcaagaagaggaaccaccaactgataatcagggtattgcacctagtggggagatcaaaaatgaaggagcacctgctgttcaagggactgatgtggaagcttttcaacaggaactggctctgcttaagatagaggatgcacctggagatggtcctgatgtcagggaggggactctgcccacttttgatcccactaaagtgctggaagcaggtgaagggcaactataggtttaaaccaagacaaatgaagactgaaaccaagaatattgttcttatgctggaaatttgactgctaacattctcttaataaagttttacagttttctgcaaa

SEQ ID NO: 5495 - DNA, 428 bp, Homo sapiens
cttcgttctttctcactgaccgagactcagccgtgagagatatgagtgagcatgtaacaagatcccaatcctcagaaagaggaaatgaccaagagtcttcccagccagttggacctgtgattgtccagcagcccactgaggaaaaacgtcaagaagaggaaccaccaactgataatcaggggactgatgtggaagcttttcaacaggaactggctctgcttaagatagaggatgcacctggagatggtcctgatgtcagggaggggactctgcccacttttgatcccactaaagtgctggaagcaggtgaagggcaactataggtttaaaccaagacaaatgaagactgaaaccaagaatattgttcttatgctggaaatttgactgctaacattctcttaataaagttttacagttttctgcaaaga

SEQ ID NO: 5496 - DNA, 540 bp, Homo sapiens
gcagagctctgcaaggagaggttgtgtcttcgttctttccgccatcttcgttctttccaacatcttcgttctttctcactgaccgagactcagccgtgagagatatgagtgagcatgtaacaagatcccaatcctcagaaagaggaaatgaccaagagtcttcccagccagttggacctgtgattgtccagcagcccactgaggaaaaacgtcaagaagaggaaccaccaactgataatcagggtattgcacctagtggggagatcaaaaatgaaggagcacctgctgttcaagggactgatgtggaagcttttcaacaggaactggctctgcttaagatagaggatgcacctggagatggtcctgatgtcagggaggggactctgcccacttttgatcccactaaagtgctggaagcaggtgaagggcaactataggtttaaaccaagacaaatgaagactgaaaccaagaatattgttcttatgctggaaatttgactgctaacattctcttaataaagttttacagttttctgcaaa

SEQ ID NO: 5497 - DNA, 4718 bp, Homo sapiens
cctctttcccctgcctgtgtgcccttctccaggatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctggagtcgggtgggagaatgtgctgctaaaggaaggtgagtcagcctcgaacgccacagaaacatccggcccagacatgactatcaagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagtgtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggag

SEQ ID NO: 5498 - DNA, 7507 bp, Homo sapiens
cccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttctttcctctttcccctgcctgtgtgcccttctccaggatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctggagtcgggtgggagaatgtgctgctaaaggaaggtgagtcagcctcgaacgccacagaaacatccggcccagacatgactatcaagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagttacacttctaagttactgtcttgcaaggtgacttccgaggtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggagagtctcctatttattctcatactttacattcatgcttagtatactatagaggatgccagctttaatctttctgtcatttaaagcaatatgataagggtattcaataattgggtgccctaaatttctggatgagaaaattttcaattctggccatgagaaagaaaaaaaaataaacagccttctttttttttcctttgttttaaaactgtggttttttaaaaaagcaataattaactcagacctcactaaaaatcatttttgtttttatattgttatgtcataagctctattatgttattctaacaagtagcaatttcacaaaatttgtatgtagatgttaacgcacatttcctttgcttcttttattagactagtgttgactttggggggggacatttattcacaaatgagaagtaggcacaaagtaaaaaatggaaccatctactaacaaggatcctttaaaactgccaagggagctctaacttgaagccacatcctacagatggcagcccaaatagcacatgggcaattggcaccatctttatatggttgagtctcctgaatattttgaatgaattctcaacaaaatgtgctagccactggggacgcaaaacaagtaagatccctgttgcaagaaattcattttatagtgagggaggttggcatggagactaaaattctcaggaaaatgagatccgtgttagattagaagtcctgatgtgaaatgggaggactcaggaaggaggatcgtctttacctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacgaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgttttacttggatgacacaatgcagtttacttgcctcttcatacccatgcatgctgctcaccctagacaatgacatataagccgtatatagatcaatgtccacatatatatacacacacacatatatatatataaagtgtaacaaggaacactaaaacagtgttgattcttgtctctgaagacaaataattaaaccttttttttcccaactaaagaatggatttaattaaactatgtattgaaaaaaaagtagcctaagtgttagagatggtgaatatattccattttagttaaagaacaaatttcctgaattttaagcattcagtgagctgccaattttgattttgtgttgctctttacccaaattattttttctttgtttttctttttttgggggaggaggggaaaaaagcagcaatactgtgtttggaaattatactctgtatctggttttcctgtgtatgttaaccacttaaatgttattatcctgctttggttttagagtgattgtgaggcattcaatgcaagtatacagttattttctcattaaaatccaatgtgtgttgagtttttataaa

SEQ ID NO: 5499 - DNA, 1351 bp, Homo sapiens
gcgtgtgttttttctttcctctttcccctgcctgtgtgcccttctccaggatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctgctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgcggctgagcttgtgtccgggaggccggtctcagacaccacagagccctcatccccagaagggaaggaagagagcctagctacagagccagccccaggagtcgggtgggagaatgtgctgctaaaggaaggtgagtcagcctcgaacgccacagaaacatccggcccagacatgactatcaagaagcctccccagctttctgagga

SEQ ID NO: 5500 - DNA, 1497 bp, Homo sapiens
ccggtgggagggaacatctggaacattagacaggatgctgatcttctggacaatcacacttttcctgctgggagcagccaaaggaaaagaagtttgctatgaggacctcgggtgcttttctgacactgagccctggggcgggacagcaatcaggcccctgaaaattctcccctggagccctgagaagatcggcacccgcttcctgctgtacaccaatgaaaacccaaacaactttcaaattctcctcctctctgatccatcaacaattgaggcatcaaattttcaaatggacagaaagacccggttcatcatccatggcttcatagacaaaggagatgagagctgggtgacagacatgtgcaagaaactgttcgaggtggaggaggtgaactgcatctgcgtggactggaagaagggctcccaagccacctacacacaggctgccaacaacgtgcgagtggtgggcgcccaggtggcccagatgctcgacatcctcttgacagagtatagctaccccccttccaaagttcacctcattggccacagcctgggagcccacgtggctggagaggcaggaagcaagactccaggcctgagcaggattacagggttggatcctgtagaagcaagtttcgagagtactcctgaagaggtgcgacttgatccctctgatgctgactttgttgatgtgattcacacggatgcagctcccctgatcccattcttgggttttggaacgaaccaacagatgggtcatcttgacttcttccccaatggaggagagagcatgccgggatgcaagaagaatgccctgtctcagatcgtggatctagatggcatctgggcgggaacccgggactttgtggcttgcaatcacctaagaagctacaagtattacttggaaagcatcctcaatcccgatgggtttgctgcatatccctgcacttcctacaagtcctttgagtctgacaagtgcttcccgtgtccagatcaaggatgcccacagatgggtcactatgctgataaatttgctggcaggacaagtgaagagcagcagaaattcttcttgaacacaggagaggctagcaatttcgctcgctggagatatggggtttccatcacactgtctggaagaacagccactggtcagatcaaagttgctttgtttggaaataagggaaacactcaccagtacagtatcttcagggggattctcaaaccaggctcaacccattcctatgagtttgatgcaaagctggatgttggaacaattgagaaagtcaagtttctttggaataacaatgtgataaatccaaccctccccaaagtgggtgccaccaagatcactgtgcaaaagggagaagagaagacagtgtacaacttctgtagcgaagacacagtgcgggaagacacgctgctcaccctcacgccctgctaagctcccggggcgacgaggctgctgcgttcacactaataaaatccactggtgcatctgta

SEQ ID NO: 5501 - DNA, 1479 bp, Homo sapiens
gtgagtggaagctctggtgcagcatgatgctgcccccttggaccctcggccttctcctgctggccacagtcagagggagaaaagtctgctacggacaacttggctgcttttctgatgaaaaaccatgggcaggaacccttcagcgacctgtaaaattacttccctggtcccccgaggacattgacacccgctttcttctgtacacaaatgaaaatccaaacaacttccaactaatcactggcacggaaccagacaccattgaggcttcaaacttccaactggaccgcaagacacgcttcatcatccatggcttcttagacaaggcggaggacagctggccatcggacatgtgcaagaaaatgtttgaagtggagaaggtgaactgcatctgtgtggactggaggcacgggtcccgggcaatgtacacccaagccgtgcaaaacattcgggttgttggggcggagacagctttcttaatacaagcactgtcgacgcagctagggtacagccttgaggacgtgcatgtcatcggccacagcctgggcgcgcacacggccgcggaggcgggcaggaggctggggggccgcgtgggcaggatcacagggctggatccagcagggccgtgcttccaggatgaacctgaggaggttcggttggatccatctgacgccgtgtttgtggatgtgattcacacagattcttctcccatagttccttccctaggtttcggaatgagccaaaaggtgggccatctggatttctttccaaatggaggaaaggaaatgcccggatgtaagaaaaatgtcctttcaaccattactgatattgatggaatatgggaaggaattggtggctttgtgtcttgcaatcacctaagaagcttcgagtattactcaagcagcgtcctcaaccctgatggcttcctgggctatccctgtgcctcctacgatgagtttcaggagagtaagtgtttcccttgtccagctgaaggatgccccaaaatggggcactatgctgaccaatttaaggggaaaacaagtgctgtggaacaaacctttttcctgaacacaggagagagtggtaactttactagtaaatataagatatcagtcacactttctggaaaagagaaagtgaatgggtacatcaggattgctttgtatggaagtaatgaaaactcaaaacaatatgagattttcaaaggatccctcaaaccagatgcaagtcacacgtgtgctattgatgtggattttaatgttggaaaaatacagaaagttaaattcctctggaacaaacgtgggataaatctatctgagcccaaactgggggcttcccaaatcacagtgcaaagtggtgaagatgggactgagtataatttttgtagcagcgacactgtggaagaaaacgtcttgcaatctctttacccttgttaaaaacgtggtgcagctattgcggtaataaaatctttaatgcactcgg

SEQ ID NO: 5502 - DNA, 627 bp, Homo sapiens
cgcctctctgtcgtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtgagtgcaggatcgcccctttctccccccgctcctccaggagctggcagcatcaagaccccacttcgcttctctcaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctcc

SEQ ID NO: 5503 - DNA, 535 bp, Homo sapiens
accccgcgcgcgcctctctgtcgtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtctccccaaggctgacccgggtcattggtgggccagcttctttttcgggaagtccaccctcccaccccccaccctgtaaactaggcggctgcagcaagcagaccttcgcatcaacacagcagacaccaaaaaccagtgagagccccgctctctaccgcccggccccagcactcgctagctttcctgacacctggaactgtgcacctggcaccaagcggaaaataaactccaagcagccagtagccc

SEQ ID NO: 5504 - DNA, 868 bp, Homo sapiens
gcggcccccgcgcatataagtgggcgcgtccgcgcgtgcgcaccccgcgcgcgcctctctgtcgtggcgcggcttcccgcggtcttctctgcaaatgggctccgtggcctagcgcccccgtccccgccacccgtgatcgtgcgccgaggcccgcgaggggtcgccgcccagatcccaccagccagcaagctaaagcatggcggccatcccctccagcggctcgctcgtggccacccacgactactaccggcgccgcctgggttccacttccagcaacagctcctgcagcagtaccgagtgccccggggaagccattccccaccccccaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctccccgcccctctccccactccgcatccctcgcccccctccccacctcccaccccccaccctgtaaactaggcggctgcagcaagcagaccttcgcatcaacacagcagacaccaaaaaccagtgagagccccgctctctaccgcccggccccagcactcgctagctttcctgacacctggaactgtgcacctggcaccaagcggaaaataaactccaagcagccagtagccccgatggtgtgtgcctgagctgtgtggcccgaggttcca

SEQ ID NO: 5505 - DNA, 7842 bp, Homo sapiens
atgtatcgctccggggagcgcctgctgggcagccacgcgctgcccgcggagcagcgggacttcctgcccctagagacgaccaacaacaacaacaaccaccaccagcccggggcctgggcccgccgggcgggctcctcggcgtcctcgcctccctcggcgtcctcgtccccgcacccttcggccgccgtccccgccgccgatccagccgattcggcctcgggcagcagcaacaagaggaagcgcgacaacaagcccagcggagggcgggccgcggggggcggccgagcagacggcggcggggtcgtgtacagcgggaccccgtggaaacggaggaactacaaccagggagtcgtgggtctgcatgaagaaatcagtgatttttatgaatacatgtctccaagacctgaggaggagaagatgcggatggaggtggtgaacaggatcgagagtgtaattaaggagctctggcccagcgctgacgtccagatatttggaagttttaaaactggactttatttacctactagtgacatcgacctagtggtgtttgggaagtgggagaacctacccctctggactctggaagaagctcttcggaaacacaaagtcgcagatgaggattcggtgaaagttttagacaaagcaactgtacctattattaaattaacagattcttttactgaagtgaaagttgatatcagctttaatgtacagaatggcgtgagagcagctgacctcatcaaagattttaccaagaaatatcctgtattgccatacttggttttagtattgaaacaattcctattgcagagggaccttaatgaagtatttacaggtggaattggttcttatagtctctttttaatggcagtcagtttccttcagttacatcccagggaagatgcttgcatccccaatacaaactatggtgttctcttaatagaattttttgaattatatggacgacacttcaattatttaaagactggcatccggataaaggatggtggttcatatgtggccaaagatgaagtacagaaaaatatgctagatggctacaggccatcaatgctttatatcgaagatcctttacaaccaggtaacgatgttggaaggagttcatatggggccatgcaagtgaagcaggcctttgattatgcctacgttgttttgagtcatgctgtatcaccaatagcaaagtactatcccaacaatgaaacagaaagcatactaggtagaataattagagtaacagatgaagttgccacatatagagattggatatcaaagcagtggggcttgaagaatagacctgagccttcatgcaatggaaatggtgttaccttgatagtagatactcagcagttagataaatgtaataataatctatctgaagaaaatgaagcccttggaaaatgtagaagtaaaacctcggaatctcttagtaaacactcttcaaactcttcatcaggtccagtgtcgtcctcttctgccacacagtccagctctagtgatgtagattccgatgcaacaccatgcaaaaccccgaaacagctgctttgccgtccgtccactgggaaccgagtagggtcgcaagatgtatccttggagtcctctcaggcagttgggaaaatgcaaagcacccaaaccactaacacatccaacagcaccaacaaatctcagcatggatcagcaaggctctttcgttcttccagcaaaggcttccaaggtacaactcaaacaagccatggttccttgatgacaaacaaacaacatcaaggcaaatccaataatcagtattaccatggcaaaaagaggaaacacaagagggacgcgcccctctcagacctctgtagatagtcagcgctgcgcggtggactgtcttctctgtgcaatgatctcatgctcaggacagttgcgcagggactcctgggagatattcaggagcctcacactgttcagacgttgacttagcaactgcgttttttcccagctcgccacagaatggatcatgaagactgacaactgcaaaaaaaacaaaacaaaacaaaaaaaaaagcaagcaaaaaagagggaaaaaaaaggctgcttatttgataagtcatatgctacaacagggtcattttaagatttaaagcttgaatgtaaaataaatatatttctcattggctttatgcagagttatagggaatagtattcagtgttggtagggtgatagaaacaaaaaacagtatcagaggatgaggtggggaaggaaaacaaaggtatctgataggaagtccagattccaaaggggaaagtgatctgtgcatgttttttttttaaatatttttgcatatatttaccattttattgtgtgtatatatagaagaccatataggagattgatatttgtaatagtggatttgttaataatactttttacataacattactgtttaaattgtaaacagattttttctcaggattagtttgaaaaataatctaaattgtcatcttaacatccatatatagggaagtgattagttctattactcaatttgtttttctcagcattgaaatgacttaatagaacccttgtgtcctgctgcaaaaatttttcctctctaaagaaaaggtttatggtggcaaatgatgtttattttattttgtaaaaaaaaaaaaatgtactatgtacttttgtgtaaacactgaaaaatctctggtcatctccgagaattaacttgcaactgttttctatagtgctgtcgtcttgggcaatgggcaattacatgactttgtgtttgcttcctttgcagtcttttttttttccccccatttcttcctaataggaaaaaaaaaaaaaaaaaggtcacccatgtctggtctcattcctgttgcagtgaaacttcgagttccacagactttgcatgctggcttctctaaccctgtgtgctgcgtgtgcctgtttctcatctcttattctttttaaaattcatgcttaactactgtgggagaataactgtaaacagctttaattaaatcatacttataaaaaactattttcttatattccactctatgcttttggtattgttgatctttacaaattaaatggtctttgataatggatctattttgtattgccttattaagaccaaatacttcttgtcatcccattctttatcctcttctttcatggaattgttatcgttaattaaaacttttttaaacattggcttgtttcaatcatactgtaaattttggttgtagtcagctttgagtgcaatgagatgtataattctgttatcattacctgttgagtttgaaactcagttgggaatatttaatataatagaatgtaagtgacatttctgaaaatgctttctttcagggtgaaagctcttatgtttagcatcaatgtgtatggctctgttaaatgcagccatttctgagacgagattcttttatatatatatacatataaagtactattggcttttaggagtttcttttatatacatttatgaaatactgaagaccaatcagaccattaatggacacttagtgtaactttttataaagaaaataatgctaaagtaagaccaaaactgatgtcatcactgaaattaacaattttcaatatgttcatattttaattcacaatggaaaaatgtgttccaaaactggaaactcatagtactcgtgtaaactgtggaagatttcaaatgtgatgttattttgacaatgttttaaattttagagtcacattttattctgatcagaatttttattgagatgttgagcttttgtttttgaaactagtttgtcataacattgtgcataatcacagtatttattttctaggacaattgtgaatgtgtagacttatgtttactgctaagggaacaattatttataaaataatattaaatccagtattagctgcctatttcagacacttaatacttgcagagatctatgttacatttaccacactgaagttttttttgttgttttttgtttgtttttaaagaatcaccctcattgttgaaagtaaatgtactcttagggtgcgaatattagtgttccaataagcatgtgattatattaaggtggtggtagcgggaagataattctgattccattgggaatcttaggttttcgtaaatttattgggaaaatagtttttcctgtactgctgaagtttctttttggtaaacagtatctttctaaaagaaaaaagcatgaaggagaaattgaggtgtgtatacatttcctcaaatgaccagcattgtattcgtgaatactgtgtatcttgcagtgaacagtgtggaagctgttcatttttcaatctgaagtaaaatactttcaagaacttttagtttgcctgctcatttgttttatacatttcatctatttgactcctatcttatttcttttttgagttttaatacttcctatattttgtgaatatatcagaaatgtgtcatttatatattagagtccattcatatccatgaatcataaccttcctttgctaatacttgttgaatgggattttacaaattctccctcactctggtgacatttctcaggcagtcatgtatgtgtacctggccattagaaatattaatatttaaagactgttttttagaggagctgatgggttggtgaggtgtcagcacaaaatcttactggttatgttttgatgataaaagtatatccattttttccctccagctttaaggtgactgtgaaggtgcctggttttgaatgtctttgtttggtttggagatgtcgcactcagttttcaaatctagcttggatctgtaggacctatgttttttacaagtaattgccctccagtcttcaacagttgattctgttttatttttatcctgttttgagtgtactttacctttacttgcattttgagcctcattaatatttaggttatttgatttggctccagatattcctagatctgcacagggcaaaacatgggctatagggtgagcatttttaattgtctttttctgctggaaccttatatctctccatgtgttttctgctccttccctcccccatgaaatggtaagtgtgacttgtgtttgcctgaacctgtggactagtgtttggggtttctggaaacactagagggtcagaaaagagtaatgaccaccgtgacgtgcaggattctcttgctgtgacatgttcattgcaaagccctctccagtgactaggaggtgtagttattaaggttgatctgttagaaatcaccattattaggtattagtggtagatgttgctgatacttttattggtcatgactacatctcagttttactttaatattgatctatagtttgatcagttccttgaattctaatatgttgatttctcagtgtttctgtcactaaccaagaatgtttctaggcagttggttgcttcacagtcaaaactaaatggtaaactatcaaaaatacattcccaattttgctgtgataaatattgaaatgttaaaattaatgaacagaagaatttattcttacccatctattcttgttctcctagttcattaaactttcagttattggaaaggcacattctcaaagtattttatgagcaaaatattctataaatgcgtctaacaaacctaattgaatataaaagttatatttagtagttactgttgatagtaattttcatcagggtcatagttcatctagtaaaatatttagagaatgatgttaacattccagcattaaagtgggaacaaagatttatatatgaaattccttaaaagagttcatcttgccttggtttctgaccctcaagactctagctacctgccatcttgtcaaaacatttgtgggtagaataagtgttaaagatcaaattttaatatgcttctcgatatttaacatagctaagaagccagattttactgtagaagttatttacatgatttgaaaacttgacctaactggaagcctttttctcagtcatcttgttctaagccatcttgacttcacacccttagcgacttttcttttttttttggtcaaagataatgagctaaatatatatagacgttgaatgttgacaaaattattaaccagaaaaattgcttataaaggctgctgatctatttgatacctagaattaaatatttgaggacagtttttagttaataaactgctaatgtttattttactgtctctcaggtttttggtttttttaaaaaaaatgtgtttggcctttacattttctacttaagtgtgtactttattgagtttaaccttgtctgtagcctagtagcctgaaagaaaaggagacagaaccagagagatggatgtagtgcattccctttggttattacacatttgtggtagctcctggatttactgagagatattttagctatgtcaataagaacagctaatgatgtggaaatcaggtgttctcttgtgtatttcagtgaacatttttattagtagttgcatatcatctctagttccacattttaacttaacgtctttgtggcttcaccactgagctacctttcactacaccagcttctgtgtggcctggtaacatggaaggtctctcctaaggacagtctggacgtattttgggggaatgttatttatcttaaagatgcctagaaacaaaacgcatatagtaccagtgagaaactatgaagtaaacaagttgctcaggccgggcatggtggctcacgcctgtaatcccagcactttgggaggccgaagcgggaggatggcttgaggctgggagtttgagaccttcatctcttaaaaaaacaaacaaaaacctgaatggtgaggtgtggtggaattgggtaggggagggaaaggaggacttggaaaagcattctccaaagccagcaacttggtgaagttcagtacttgcctcttagaggttaggccatgcctttcaaagagagtgaaatgatgggttatcagccacattcttggagttaatatttttcttcatctttcagtttgggttctgtgctattcatagttcttccctaagaccatttcattattaccttttatatttagttgcaatttattataatatgttgttttgtccctgaacttaatctcctaattttaagatcctctctgatttttgcatattgaaacttacagaagtcactttaaaaaagtcttttgaaagtcctacaatcctaaaataaatcacaagcttgtttgttagacgtgtcaagagtctccagtctttactactaaaaagcagcactgccttaacacacattgttatgggtgaaaagtgagggacgaccagtgtagtttctggatataaagtgtgaaggactgttgagttaaacatttttagtggaatatacatagataacgtgtatttagaaactttggtgaagccagtatttgtttttagtaacctttttatgtatttccttctttgattagcattgtcttcagtgttaagaaatgtggactcctgtgaggtgctggaggtttgaatcatcttgaaaactttccaatcttgtctagttaccactgcagagacactaaggaatttaccagaaaaagatatttgatacaagtgatttaagaaatctcaacatttcctgaggccgtatcactgggcaaccagtgatgaaaactatgaatgaattgcacacctggaagattttttaagctaatgacagtttcttcaaagatgtcaattatttgccttggaaattttataaattgcatttctatgcacatcggcctctagtgcttaccactcggtttattattcataatctgcaattcaataaaggctttgtgttttcatttatcttcaaaa

SEQ ID NO: 5506 - DNA, 8114 bp, Homo sapiens
acaacgcgctccctgcggggcgggcggcaacctccatgcggcctcgtccacgctcagcaccggggaagccgaggcggagaagccgcgcgcgcctcagaagctcccggacgcccagcggcggcgcgagcggcggcggcggcagcagcagcagcagcagcacggccaccggcgggagcggcagcagcaccggcagccccggcggcgcggcctcggccccggccccggccccggccggcatgtatcgctccggggagcgcctgctgggcagccacgcgctgcccgcggagcagcgggacttcctgcccctagagacgaccaacaacaacaacaaccaccaccagcccggggcctgggcccgccgggcgggctcctcggcgtcctcgcctccctcggcgtcctcgtccccgcacccttcggccgccgtccccgccgccgatccagccgattcggcctcgggcagcagcaacaagaggaagcgcgacaacaaggccagcacgtatggactcaactacagcctgctgcagcccagcggagggcgggccgcggggggcggccgagcagacggcggcggggtcgtgtacagcgggaccccgtggaaacggaggaactacaaccagggagtcgtgggtctgcatgaagaaatcagtgatttttatgaatacatgtctccaagacctgaggaggagaagatgcggatggaggtggtgaacaggatcgagagtgtaattaaggagctctggcccagcgctgacgtccagatatttggaagttttaaaactggactttatttacctactagtgacatcgacctagtggtgtttgggaagtgggagaacctacccctctggactctggaagaagctcttcggaaacacaaagtcgcagatgaggattcggtgaaagttttagacaaagcaactgtacctattattaaattaacagattcttttactgaagtgaaagttgatatcagctttaatgtacagaatggcgtgagagcagctgacctcatcaaagattttaccaagaaatatcctgtattgccatacttggttttagtattgaaacaattcctattgcagagggaccttaatgaagtatttacaggtggaattggttcttatagtctctttttaatggcagtcagtttccttcagttacatcccagggaagatgcttgcatccccaatacaaactatggtgttctcttaatagaattttttgaattatatggacgacacttcaattatttaaagactggcatccggataaaggatggtggttcatatgtggccaaagatgaagtacagaaaaatatgctagatggctacaggccatcaatgctttatatcgaagatcctttacaaccaggtaacgatgttggaaggagttcatatggggccatgcaagtgaagcaggcctttgattatgcctacgttgttttgagtcatgctgtatcaccaatagcaaagtactatcccaacaatgaaacagaaagcatactaggtagaataattagagtaacagatgaagttgccacatatagagattggatatcaaagcagtggggcttgaagaatagacctgagccttcatgcaatggaaatggtgttaccttgatagtagatactcagcagttagataaatgtaataataatctatctgaagaaaatgaagcccttggaaaatgtagaagtaaaacctcggaatctcttagtaaacactcttcaaactcttcatcaggtccagtgtcgtcctcttctgccacacagtccagctctagtgatgtagattccgatgcaacaccatgcaaaaccccgaaacagctgctttgccgtccgtccactgggaaccgagtagggtcgcaagatgtatccttggagtcctctcaggcagttgggaaaatgcaaagcacccaaaccactaacacatccaacagcaccaacaaatctcagcatggatcagcaaggctctttcgttcttccagcaaaggcttccaaggtacaactcaaacaagccatggttccttgatgacaaacaaacaacatcaaggcaaatccaataatcagtattaccatggcaaaaagaggaaacacaagagggacgcgcccctctcagacctctgtagatagtcagcgctgcgcggtggactgtcttctctgtgcaatgatctcatgctcaggacagttgcgcagggactcctgggagatattcaggagcctcacactgttcagacgttgacttagcaactgcgttttttcccagctcgccacagaatggatcatgaagactgacaactgcaaaaaaaacaaaacaaaacaaaaaaaaaagcaagcaaaaaagagggaaaaaaaaggctgcttatttgataagtcatatgctacaacagggtcattttaagatttaaagcttgaatgtaaaataaatatatttctcattggctttatgcagagttatagggaatagtattcagtgttggtagggtgatagaaacaaaaaacagtatcagaggatgaggtggggaaggaaaacaaaggtatctgataggaagtccagattccaaaggggaaagtgatctgtgcatgttttttttttaaatatttttgcatatatttaccattttattgtgtgtatatatagaagaccatataggagattgatatttgtaatagtggatttgttaataatactttttacataacattactgtttaaattgtaaacagattttttctcaggattagtttgaaaaataatctaaattgtcatcttaacatccatatatagggaagtgattagttctattactcaatttgtttttctcagcattgaaatgacttaatagaacccttgtgtcctgctgcaaaaatttttcctctctaaagaaaaggtttatggtggcaaatgatgtttattttattttgtaaaaaaaaaaaaatgtactatgtacttttgtgtaaacactgaaaaatctctggtcatctccgagaattaacttgcaactgttttctatagtgctgtcgtcttgggcaatgggcaattacatgactttgtgtttgcttcctttgcagtcttttttttttccccccatttcttcctaataggaaaaaaaaaaaaaaaaaggtcacccatgtctggtctcattcctgttgcagtgaaacttcgagttccacagactttgcatgctggcttctctaaccctgtgtgctgcgtgtgcctgtttctcatctcttattctttttaaaattcatgcttaactactgtgggagaataactgtaaacagctttaattaaatcatacttataaaaaactattttcttatattccactctatgcttttggtattgttgatctttacaaattaaatggtctttgataatggatctattttgtattgccttattaagaccaaatacttcttgtcatcccattctttatcctcttctttcatggaattgttatcgttaattaaaacttttttaaacattggcttgtttcaatcatactgtaaattttggttgtagtcagctttgagtgcaatgagatgtataattctgttatcattacctgttgagtttgaaactcagttgggaatatttaatataatagaatgtaagtgacatttctgaaaatgctttctttcagggtgaaagctcttatgtttagcatcaatgtgtatggctctgttaaatgcagccatttctgagacgagattcttttatatatatatacatataaagtactattggcttttaggagtttcttttatatacatttatgaaatactgaagaccaatcagaccattaatggacacttagtgtaactttttataaagaaaataatgctaaagtaagaccaaaactgatgtcatcactgaaattaacaattttcaatatgttcatattttaattcacaatggaaaaatgtgttccaaaactggaaactcatagtactcgtgtaaactgtggaagatttcaaatgtgatgttattttgacaatgttttaaattttagagtcacattttattctgatcagaatttttattgagatgttgagcttttgtttttgaaactagtttgtcataacattgtgcataatcacagtatttattttctaggacaattgtgaatgtgtagacttatgtttactgctaagggaacaattatttataaaataatattaaatccagtattagctgcctatttcagacacttaatacttgcagagatctatgttacatttaccacactgaagttttttttgttgttttttgtttgtttttaaagaatcaccctcattgttgaaagtaaatgtactcttagggtgcgaatattagtgttccaataagcatgtgattatattaaggtggtggtagcgggaagataattctgattccattgggaatcttaggttttcgtaaatttattgggaaaatagtttttcctgtactgctgaagtttctttttggtaaacagtatctttctaaaagaaaaaagcatgaaggagaaattgaggtgtgtatacatttcctcaaatgaccagcattgtattcgtgaatactgtgtatcttgcagtgaacagtgtggaagctgttcatttttcaatctgaagtaaaatactttcaagaacttttagtttgcctgctcatttgttttatacatttcatctatttgactcctatcttatttcttttttgagttttaatacttcctatattttgtgaatatatcagaaatgtgtcatttatatattagagtccattcatatccatgaatcataaccttcctttgctaatacttgttgaatgggattttacaaattctccctcactctggtgacatttctcaggcagtcatgtatgtgtacctggccattagaaatattaatatttaaagactgttttttagaggagctgatgggttggtgaggtgtcagcacaaaatcttactggttatgttttgatgataaaagtatatccattttttccctccagctttaaggtgactgtgaaggtgcctggttttgaatgtctttgtttggtttggagatgtcgcactcagttttcaaatctagcttggatctgtaggacctatgttttttacaagtaattgccctccagtcttcaacagttgattctgttttatttttatcctgttttgagtgtactttacctttacttgcattttgagcctcattaatatttaggttatttgatttggctccagatattcctagatctgcacagggcaaaacatgggctatagggtgagcatttttaattgtctttttctgctggaaccttatatctctccatgtgttttctgctccttccctcccccatgaaatggtaagtgtgacttgtgtttgcctgaacctgtggactagtgtttggggtttctggaaacactagagggtcagaaaagagtaatgaccaccgtgacgtgcaggattctcttgctgtgacatgttcattgcaaagccctctccagtgactaggaggtgtagttattaaggttgatctgttagaaatcaccattattaggtattagtggtagatgttgctgatacttttattggtcatgactacatctcagttttactttaatattgatctatagtttgatcagttccttgaattctaatatgttgatttctcagtgtttctgtcactaaccaagaatgtttctaggcagttggttgcttcacagtcaaaactaaatggtaaactatcaaaaatacattcccaattttgctgtgataaatattgaaatgttaaaattaatgaacagaagaatttattcttacccatctattcttgttctcctagttcattaaactttcagttattggaaaggcacattctcaaagtattttatgagcaaaatattctataaatgcgtctaacaaacctaattgaatataaaagttatatttagtagttactgttgatagtaattttcatcagggtcatagttcatctagtaaaatatttagagaatgatgttaacattccagcattaaagtgggaacaaagatttatatatgaaattccttaaaagagttcatcttgccttggtttctgaccctcaagactctagctacctgccatcttgtcaaaacatttgtgggtagaataagtgttaaagatcaaattttaatatgcttctcgatatttaacatagctaagaagccagattttactgtagaagttatttacatgatttgaaaacttgacctaactggaagcctttttctcagtcatcttgttctaagccatcttgacttcacacccttagcgacttttcttttttttttggtcaaagataatgagctaaatatatatagacgttgaatgttgacaaaattattaaccagaaaaattgcttataaaggctgctgatctatttgatacctagaattaaatatttgaggacagtttttagttaataaactgctaatgtttattttactgtctctcaggtttttggtttttttaaaaaaaatgtgtttggcctttacattttctacttaagtgtgtactttattgagtttaaccttgtctgtagcctagtagcctgaaagaaaaggagacagaaccagagagatggatgtagtgcattccctttggttattacacatttgtggtagctcctggatttactgagagatattttagctatgtcaataagaacagctaatgatgtggaaatcaggtgttctcttgtgtatttcagtgaacatttttattagtagttgcatatcatctctagttccacattttaacttaacgtctttgtggcttcaccactgagctacctttcactacaccagcttctgtgtggcctggtaacatggaaggtctctcctaaggacagtctggacgtattttgggggaatgttatttatcttaaagatgcctagaaacaaaacgcatatagtaccagtgagaaactatgaagtaaacaagttgctcaggccgggcatggtggctcacgcctgtaatcccagcactttgggaggccgaagcgggaggatggcttgaggctgggagtttgagaccttcatctcttaaaaaaacaaacaaaaacctgaatggtgaggtgtggtggaattgggtaggggagggaaaggaggacttggaaaagcattctccaaagccagcaacttggtgaagttcagtacttgcctcttagaggttaggccatgcctttcaaagagagtgaaatgatgggttatcagccacattcttggagttaatatttttcttcatctttcagtttgggttctgtgctattcatagttcttccctaagaccatttcattattaccttttatatttagttgcaatttattataatatgttgttttgtccctgaacttaatctcctaattttaagatcctctctgatttttgcatattgaaacttacagaagtcactttaaaaaagtcttttgaaagtcctacaatcctaaaataaatcacaagcttgtttgttagacgtgtcaagagtctccagtctttactactaaaaagcagcactgccttaacacacattgttatgggtgaaaagtgagggacgaccagtgtagtttctggatataaagtgtgaaggactgttgagttaaacatttttagtggaatatacatagataacgtgtatttagaaactttggtgaagccagtatttgtttttagtaacctttttatgtatttccttctttgattagcattgtcttcagtgttaagaaatgtggactcctgtgaggtgctggaggtttgaatcatcttgaaaactttccaatcttgtctagttaccactgcagagacactaaggaatttaccagaaaaagatatttgatacaagtgatttaagaaatctcaacatttcctgaggccgtatcactgggcaaccagtgatgaaaactatgaatgaattgcacacctggaagattttttaagctaatgacagtttcttcaaagatgtcaattatttgccttggaaattttataaattgcatttctatgcacatcggcctctagtgcttaccactcggtttattattcataatctgcaattcaataaaggctttgtgttttcatttatcttcaaaa

SEQ ID NO: 5507 - DNA, 522 bp, Homo sapiens
atggacattgagaaggtcaactccatggaccttggagaattcgtggatgtgtttgggaatgccactgagagatgtcctctgattgcagctgctgtttggtcccagcggccattctctgatttggaagatttagagaagcacttttttgcctttattgatgcccttgcacagtcaggccaggagggcatcctgcgctgccacccggacctggcgggcagcgagctgcagcggggcacgctcacggccgagtcgcagcgggaacagagcggcgcaggcctgaggagcctgggcgcggacgagcggctgcggctggccgagctcaacgcgcagtaccgcgcgcgcttcggtttccccttcgtgctcgccgcgcgcttcagcgaccggacggcggtgccgcgcgagctggcgcgccggctgctctgcccgtccgcgcaggagctgcgcactgctctgggcgaggtgaagaagatcggcagcctgcgcctggccgacctcctccgcgcagaccccgccaagctgtag

SEQ ID NO: 5508 - DNA, 2260 bp, Homo sapiens
atggcggagagctccctctaccggcagcggctagaagtcatcgctgagaagcggcggctgcaggaggagatccgcgccgcgcgccgggaggtggaggaggagaaactccgcgtggagcgtctcaagaggaagtctctccgggaacgttggctaatggatggggcagctgcagtgccagagccatccgaagaccccacctcgaaggacccccagtcacccgagggccaggctcaggcccgaatccggaacctggaagacagtttgttcacactccagtcccagctgcaactgttgcaaagtgcttccacaggtgcccagcacaagccctcaggcaggcccagctggcgcagacagggtcaccgtcctctctcccagtccattgtcgaggcaggttctgtaggccagactgatctgaacaagagagcctccctgccggctggactagtgggcacgcctccagagtccccctctgagcccagggaggatgtcttggggtttctgccaggcccgaggcaggtccccggggcagcaggagactcctcagaagccaatggcccatgccccagccccatccccactccagagcaggggctaagtcagagggcagtgccatccgaagggcgggtgggtgaggccaaaggagggggcgtggtgagtgtggtgtgggaagggctgagggccacagaggactgtgccacaggggccacgggccccgagctggaggctaaggtggaggaagtggtgctggaagccatcggagacaggaagggagctggtagcctggagctcccggcctgggtgaaggaggacaggggcatcgtggaggtggtctgggagggggtgggtggcagtgatgcagaggccatgggggagataggcagggtccctgaggtcgtgcagactagctcgcctaggctccaggagagattagaggcagcagcttccatagaaggggaagatgtgccccagggcagccctgagggtgatgggcagggaggctctggaggagaggagggatccttcatttgggtggagagagtgaccctcagtgaagagtgggaggagctgctggtggaggggttggaagggcccgaggtggcagggagggagagaggagatgaaagcccgctgggggccgagggggccaagacgggaggaggcgaggagacctgggaggcagagaagagaaaagcggaagaatccatgggaataggaagtgaggaaaagccagggacagggagggatgaagcggagatgtcaccagtggtagagaggaaaggaggagagaagaagttggagctggagagcagaggaagtgcagaaaagctgggaacagagagggaaggaggtgaggaaccactgggcatagagagaaaagttgagggacatttgagggcagagaaggaaggagatgaggaaaagcgaggggcagaggaggaggaggtagaagaaccattgggagtagagaagaaaggaggtgaggaagagccagaggcaaccaaagaaccactggaggcagagagaaagggaggggaggagacactggaggcagagaaaaggggaggtgaggaatcattggagacagagaagacccaagggacggagggagatctgaatctagaacaagggtctagggaaggaagtgaatcccaggcagaggagatgaatgaggcagggcctccccttgaggctaacacggagacaaggccagagaaggaaggaccccagccccaggagaagccagtaggagccctggaggaggaaggagtgaagccccaaaccgctgctgagggccaaggccccttgggggatgccacacctcttctggcagagaccccagccccagagcagcccgccgaatgccagccactgcttcagggggaggggcccagcgccaaccccagtgcccaccctgtgcccacctacgcgcctgcccggcagcctgagccatctgcccccaccgagggtgaagaggcaagtggccctaagcaaaagacgtgccagtgttgtgcggtcatgtgaacccatgcccctccaccccatgtccagctcctctcacagctacctcggcctcttggcacccagaagagggtcccaggcacagacagggaccacaggactggccatggcacctgggagccagctagcctgcacgtccacctaaacctgggcttccagaccccttgcccactgcctgtaaccctggcctccttctgcgatgaagcctttatacttgaaaataaaatgtgaaagcactcaa

SEQ ID NO: 5509 - DNA, 3197 bp, Homo sapiens
cattgcattgcgcagagctcagccatctttctcatccgtcaggcattcctgagaaagagggccactctacctctcttgctgccagccttcactccagcaaggagggtgctgggtgacctgagcccacatagccccgagtgagcagtgaggctgtctcctgccctcttctgcctggagggctcgtcagtgtccccaggtgtcaggccctgcctcctgacgttggccttttcactacaggcacccgaagcacacacagcagagtcctctggactttgaggaagaacccacagcaggaggaagctgtgtgaaacctgggaccacttctgccttcctacgtggcagtggctcagagttatttgagtgctgtcaaactgagctgattgctgccctagtattagatcagtccatagaaagtgggagcaatggcactgacactgctagaggattggtgcaaggggatggacatggaccccagaaaggccctgctgattgtaggcatccccatggagtgtagtgaggtggaaattcaggacactgtgaaggcaggcttacagcccctgtgcgcatacagggtcctagggagaatgttcaggagggaagacaatgccaaggcagtcttcattgaactggctgacactgtcaattacactactctgcccagtcacataccaggaaagggtggctcctgggaagtggtggtaaaaccccgtaacccagatgatgagtttctcagtagactgaactacttcctgaaagatgagggccgaagtatgacagatgtggccagagccctgggatgttgcagcctccctgccgagagcctggatgcagaggtcatgccccaagttagatccccacctttagagcctccgaaagaaagtatgtggtacaggaaactgaaagtgttttcgggaactgcttcccctagcccaggcgaagagacctttgaagactggctagagcaggtcactgagataatgcccatatggcaagtgtctgaggtggagaagaggcggcgtttgctggagagcttacgtgggcctgctctgtcaatcatgcgggtgctccaggccaacaatgactccataactgtggagcagtgccttgacgccctaaagcagatctttggggataaagaggactttagagcctctcagtttaggtttctgcagacctctccgaagattggagagaaagtctccactttcctgctgcgcttagagcccctgctgcagaaagccgtgcacaagagccccttgtcagtgcgcagcacagacatgattcgtctgaaacatctcttagctcgggtcgccatgacccccgccctcaggggcaagctggagctcttggatcagcgagggtgtcctcccaattttctggagttaatgaagctcattcgagatgaagaagagtgggagaacactgaggcagtgatgaagaataaggagaagccatcagggagaggccggggggcctccggtagacaggcaagagcagaagccagtgtctctgcacctcaggccaccgtgcaggcaaggtcttttagcgacagcagcccccagaccatacagggaggcttacccccattagtgaaacgcaggcggctgttaggcagtgaaagcactaggggagaagaccatggccaggccacgtatcccaaggctgaaaaccagactccaggcagggaggggccacaggctgcaggagaggagttgggaaacgaggcaggggctggggccatgagccatcccaagccctgggaaacataggctcagaagaccgaagcactccttcccctggcaggcagcagggacatttgaacaaggggaaggggcagcttacactaacagggaacttgactggggcagagggacagggaagccaggtcgagatcaagcccccttactttccaccagctggaagggacttcaccaaccaagaccaaatagcatctggttcagtgggggccgggcccatagcccctaacaggtacaggagacacaagcggggaaccactacacttagcacatggggtgcctgggcttcagatggggaccccagcgaagcaggggctgaagaaggtgtggctgggggctctggcctggtcctctggacacccccaaatatctaccctgtggactttgagctgagcatgcccactggcacccaggccacgtgggacctggaggagcctgcctggggcctgcctctgccagaaggagccagggctgctgaggaagagctgtggggcagaagtgaagccccgcaggggaggccacagggtccagcctgtctttaggatcatctacactgcatgaggggagccccaggaaggcagcattcataagcccctgcaccagtgaggaagagaaagaggaggagaattaagaagaggatgatcgggaggaggaagaggagaataaggaggagcaggaggaagagggggaggagaaggaggaagagggggaggaggaagaggggaaggaggaggaagaagtgtaagaagagaagagaggatgtgttgggggtgggtagttgtttttggtttgcgtcatcatcaggcccgggctctgctcactgctgttccgtgtcaagaactccacctctgctttgccggtgtagatctcggccagtggctgcttgttctcttggggatgtgtgtgtttttatctgagcagctcctttccagagtaccccagcgcagttccaggagacggtgggaaggaggcatggcagacgctcaccttgtgactgtgacctcgactgcaggaggaccaaccagacacgggaaggagcagggctgcctgaggctccccaggaagctttgtgctttggcgttccacccctgctgttactcgtgactcagtttcctcaacttggtggggtgttccctgctatgttttccagcatcctgtgactgtcctgtgcagtctatagggcagggccctgccccagcgggtgggctcaggagggggttccctgaagcgagtacacattgccagagcccaccatcctggcaagaggtggatcctggggccctatggaaggagggatgtggtggggggggccacactgagggaggggccggggacttgtgacctgtagtggctgtttgcagtttctctctgtgttagattcccttttcttcagcagtttcagttcatgtttctcttcagtaaattttgttcagtgttcca

SEQ ID NO: 5510 - DNA, 749 bp, Homo sapiens
atccagtgaagcaggacccatcacgcctgagtcaggaactgcctaactggatagagttgaaaagcagagcgagtctgaagtggctgtgttattgcagcatccgcgctgccagcagggccaacccagcaaggcacccgaagcacacacagcagagtcctctggactttgaggaagaacccacagcaggaggaagtcagcagggagtggctgtgtgaaacctgggaccacttctgccttcctacgtggcagtggctcagagttatttgagtgctgtcaaactgagctgattgctgccctagtattagatcagtccatagaaagtgggagcaatggcactgacactgctagaggattggtgcaaggggatggacatggaccccagaaaggccctgctgattgtaggcatccccatggagtgtagtgaggtggaaattcaggacactgtgaaggcaggcttacagcccctgtgcgcatacagggtcctagggagaatgttcaggagggaagacaatgccaaggcagtcttcattgaactggctgacactgtcaattacactactctgcccagtcacataccaggaaagggtggctcctgggaagtggtggtaaaaccccgtaacccagatgatgagtttctcagtagactgaactacttcctgaaagatgagggccgaagtatgacagatgtggccagagccctgggatgttgcagcctccctgccgagagcctggatgcagaggtcatgccc

SEQ ID NO: 5511 - DNA, 3213 bp, Homo sapiens
tctcattgcattgcgcagagctcagccatctttctcatccgtcaggcattcctgagaaagagggccactctacctctcttgctgccagccttcactccagcaaggagggtgctgggtgacctgagcccacatagccccgagtgagcagtgaggctgtctcctgccctcttctgcctggagggctcgtcagtgtccccaggtgtcaggccctgcctcctgacgttggccttttcactacaggcacccgaagcacacacagcagagtcctctggactttgaggaagaacccacagcaggaggaagtcagcagggagtggctgtgtgaaacctgggaccacttctgccttcctacgtggcagtggctcagagttatttgagtgctgtcaaactgagctgattgctgccctagtattagatcagtccatagaaagtgggagcaatggcactgacactgctagaggattggtgcaaggggatggacatggaccccagaaaggccctgctgattgtaggcatccccatggagtgtagtgaggtggaaattcaggacactgtgaaggcaggcttacagcccctgtgcgcatacagggtcctagggagaatgttcaggagggaagacaatgccaaggcagtcttcattgaactggctgacactgtcaattacactactctgcccagtcacataccaggaaagggtggctcctgggaagtggtggtaaaaccccgtaacccagatgatgagtttctcagtagactgaactacttcctgaaagatgagggccgaagtatgacagatgtggccagagccctgggatgttgcagcctccctgccgagagcctggatgcagaggtcatgccccaagttagatccccacctttagagcctccgaaagaaagtatgtggtacaggaaactgaaagtgttttcgggaactgcttcccctagcccaggcgaagagacctttgaagactggctagagcaggtcactgagataatgcccatatggcaagtgtctgaggtggagaagaggcggcgtttgctggagagcttacgtgggcctgctctgtcaatcatgcgggtgctccaggccaacaatgactccataactgtggagcagtgccttgacgccctaaagcagatctttggggataaagaggactttagagcctctcagtttaggtttctgcagacctctccgaagattggagagaaagtctccactttcctgctgcgcttagagcccctgctgcagaaagccgtgcacaagagccccttgtcagtgcgcagcacagacatgattcgtctgaaacatctcttagctcgggtcgccatgacccccgccctcaggggcaagctggagctcttggatcagcgagggtgtcctcccaattttctggagttaatgaagctcattcgagatgaagaagagtgggagaacactgaggcagtgatgaagaataaggagaagccatcagggagaggccggggggcctccggtagacaggcaagagcagaagccagtgtctctgcacctcaggccaccgtgcaggcaaggtcttttagcgacagcagcccccagaccatacagggaggcttacccccattagtgaaacgcaggcggctgttaggcagtgaaagcactaggggagaagaccatggccaggccacgtatcccaaggctgaaaaccagactccaggcagggaggggccacaggctgcaggagaggagttgggaaacgaggcaggggctggggccatgagccatcccaagccctgggaaacataggctcagaagaccgaagcactccttcccctggcaggcagcagggacatttgaacaaggggaaggggcagcttacactaacagggaacttgactggggcagagggacagggaagccaggtcgagatcaagcccccttactttccaccagctggaagggacttcaccaaccaagaccaaatagcatctggttcagtgggggccgggcccatagcccctaacaggtacaggagacacaagcggggaaccactacacttagcacatggggtgcctgggcttcagatggggaccccagcgaagcaggggctgaagaaggtgtggctgggggctctggcctggtcctctggacacccccaaatatctaccctgtggactttgagctgagcatgcccactggcacccaggccacgtgggacctggaggagcctgcctggggcctgcctctgccagaaggagccagggctgctgaggaagagctgtggggcagaagtgaagccccgcaggggaggccacagggtccagcctgtctttaggatcatctacactgcatgaggggagccccaggaaggcagcattcataagcccctgcaccagtgaggaagagaaagaggaggagaattaagaagaggatgatcgggaggaggaagaggagaataaggaggagcaggaggaagagggggaggagaaggaggaagagggggaggaggaagaggggaaggaggaggaagaagtgtaagaagagaagagaggatgtgttgggggtgggtagttgtttttggtttgcgtcatcatcaggcccgggctctgctcactgctgttccgtgtcaagaactccacctctgctttgccggtgtagatctcggccagtggctgcttgttctcttggggatgtgtgtgtttttatctgagcagctcctttccagagtaccccagcgcagttccaggagacggtgggaaggaggcatggcagacgctcaccttgtgactgtgacctcgactgcaggaggaccaaccagacacgggaaggagcagggctgcctgaggctccccaggaagctttgtgctttggcgttccacccctgctgttactcgtgactcagtttcctcaacttggtggggtgttccctgctatgttttccagcatcctgtgactgtcctgtgcagtctatagggcagggccctgccccagcgggtgggctcaggagggggttccctgaagcgagtacacattgccagagcccaccatcctggcaagaggtggatcctggggccctatggaaggagggatgtggtggggggggccacactgagggaggggccggggacttgtgacctgtagtggctgtttgcagtttctctctgtgttagattcccttttcttcagcagtttcagttcatgtttctcttcagtaaattttgttcagtgttcc

SEQ ID NO: 5512 - DNA, 3113 bp, Homo sapiens
tctcattgcattgcgcagagctcagccatctttctcatccgtcaggcattcctgagaaagagggccactctacctctcttgctgccagccttcactccagcaaggagggtgctgggtgacctgagcccacatagccccgagcacccgaagcacacacagcagagtcctctggactttgaggaagaacccacagcaggaggaagtcagcagggagtggctgtgtgaaacctgggaccacttctgccttcctacgtggcagtggctcagagttatttgagtgctgtcaaactgagctgattgctgccctagtattagatcagtccatagaaagtgggagcaatggcactgacactgctagaggattggtgcaaggggatggacatggaccccagaaaggccctgctgattgtaggcatccccatggagtgtagtgaggtggaaattcaggacactgtgaaggcaggcttacagcccctgtgcgcatacagggtcctagggagaatgttcaggagggaagacaatgccaaggcagtcttcattgaactggctgacactgtcaattacactactctgcccagtcacataccaggaaagggtggctcctgggaagtggtggtaaaaccccgtaacccagatgatgagtttctcagtagactgaactacttcctgaaagatgagggccgaagtatgacagatgtggccagagccctgggatgttgcagcctccctgccgagagcctggatgcagaggtcatgccccaagttagatccccacctttagagcctccgaaagaaagtatgtggtacaggaaactgaaagtgttttcgggaactgcttcccctagcccaggcgaagagacctttgaagactggctagagcaggtcactgagataatgcccatatggcaagtgtctgaggtggagaagaggcggcgtttgctggagagcttacgtgggcctgctctgtcaatcatgcgggtgctccaggccaacaatgactccataactgtggagcagtgccttgacgccctaaagcagatctttggggataaagaggactttagagcctctcagtttaggtttctgcagacctctccgaagattggagagaaagtctccactttcctgctgcgcttagagcccctgctgcagaaagccgtgcacaagagccccttgtcagtgcgcagcacagacatgattcgtctgaaacatctcttagctcgggtcgccatgacccccgccctcaggggcaagctggagctcttggatcagcgagggtgtcctcccaattttctggagttaatgaagctcattcgagatgaagaagagtgggagaacactgaggcagtgatgaagaataaggagaagccatcagggagaggccggggggcctccggtagacaggcaagagcagaagccagtgtctctgcacctcaggccaccgtgcaggcaaggtcttttagcgacagcagcccccagaccatacagggaggcttacccccattagtgaaacgcaggcggctgttaggcagtgaaagcactaggggagaagaccatggccaggccacgtatcccaaggctgaaaaccagactccaggcagggaggggccacaggctgcaggagaggagttgggaaacgaggcaggggctggggccatgagccatcccaagccctgggaaacataggctcagaagaccgaagcactccttcccctggcaggcagcagggacatttgaacaaggggaaggggcagcttacactaacagggaacttgactggggcagagggacagggaagccaggtcgagatcaagcccccttactttccaccagctggaagggacttcaccaaccaagaccaaatagcatctggttcagtgggggccgggcccatagcccctaacaggtacaggagacacaagcggggaaccactacacttagcacatggggtgcctgggcttcagatggggaccccagcgaagcaggggctgaagaaggtgtggctgggggctctggcctggtcctctggacacccccaaatatctaccctgtggactttgagctgagcatgcccactggcacccaggccacgtgggacctggaggagcctgcctggggcctgcctctgccagaaggagccagggctgctgaggaagagctgtggggcagaagtgaagccccgcaggggaggccacagggtccagcctgtctttaggatcatctacactgcatgaggggagccccaggaaggcagcattcataagcccctgcaccagtgaggaagagaaagaggaggagaattaagaagaggatgatcgggaggaggaagaggagaataaggaggagcaggaggaagagggggaggagaaggaggaagagggggaggaggaagaggggaaggaggaggaagaagtgtaagaagagaagagaggatgtgttgggggtgggtagttgtttttggtttgcgtcatcatcaggcccgggctctgctcactgctgttccgtgtcaagaactccacctctgctttgccggtgtagatctcggccagtggctgcttgttctcttggggatgtgtgtgtttttatctgagcagctcctttccagagtaccccagcgcagttccaggagacggtgggaaggaggcatggcagacgctcaccttgtgactgtgacctcgactgcaggaggaccaaccagacacgggaaggagcagggctgcctgaggctccccaggaagctttgtgctttggcgttccacccctgctgttactcgtgactcagtttcctcaacttggtggggtgttccctgctatgttttccagcatcctgtgactgtcctgtgcagtctatagggcagggccctgccccagcgggtgggctcaggagggggttccctgaagcgagtacacattgccagagcccaccatcctggcaagaggtggatcctggggccctatggaaggagggatgtggtggggggggccacactgagggaggggccggggacttgtgacctgtagtggctgtttgcagtttctctctgtgttagattcccttttcttcagcagtttcagttcatgtttctcttcagtaaattttgttcagtgttcc

SEQ ID NO: 5513 - DNA, 3198 bp, Homo sapiens
agcctcgtggcgcagtcagcacggaggcggcagccgccatagacgtgtggtggtcgcgctgcgcgggaactccggcttggaggcacctccggcagatccagtgaagcaggacccatcacgcctgagtcaggaactgcctaactggatagagttgaaaagcagagcgagtctgaagtggctgtgttattgcagcatccgcgctgccagcagggccaacccagcaaggcacccgaagcacacacagcagagtcctctggactttgaggaagaacccacagcaggaggaagtcagcagggagtggctgtgtgaaacctgggaccacttctgccttcctacgtggcagtggctcagagttatttgagtgctgtcaaactgagctgattgctgccctagtattagatcagtccatagaaagtgggagcaatggcactgacactgctagaggattggtgcaaggggatggacatggaccccagaaaggccctgctgattgtaggcatccccatggagtgtagtgaggtggaaattcaggacactgtgaaggcaggcttacagcccctgtgcgcatacagggtcctagggagaatgttcaggagggaagacaatgccaaggcagtcttcattgaactggctgacactgtcaattacactactctgcccagtcacataccaggaaagggtggctcctgggaagtggtggtaaaaccccgtaacccagatgatgagtttctcagtagactgaactacttcctgaaagatgagggccgaagtatgacagatgtggccagagccctgggatgttgcagcctccctgccgagagcctggatgcagaggtcatgccccaagttagatccccacctttagagcctccgaaagaaagtatgtggtacaggaaactgaaagtgttttcgggaactgcttcccctagcccaggcgaagagacctttgaagactggctagagcaggtcactgagataatgcccatatggcaagtgtctgaggtggagaagaggcggcgtttgctggagagcttacgtgggcctgctctgtcaatcatgcgggtgctccaggccaacaatgactccataactgtggagcagtgccttgacgccctaaagcagatctttggggataaagaggactttagagcctctcagtttaggtttctgcagacctctccgaagattggagagaaagtctccactttcctgctgcgcttagagcccctgctgcagaaagccgtgcacaagagccccttgtcagtgcgcagcacagacatgattcgtctgaaacatctcttagctcgggtcgccatgacccccgccctcaggggcaagctggagctcttggatcagcgagggtgtcctcccaattttctggagttaatgaagctcattcgagatgaagaagagtgggagaacactgaggcagtgatgaagaataaggagaagccatcagggagaggccggggggcctccggtagacaggcaagagcagaagccagtgtctctgcacctcaggccaccgtgcaggcaaggtcttttagcgacagcagcccccagaccatacagggaggcttacccccattagtgaaacgcaggcggctgttaggcagtgaaagcactaggggagaagaccatggccaggccacgtatcccaaggctgaaaaccagactccaggcagggaggggccacaggctgcaggagaggagttgggaaacgaggcaggggctggggccatgagccatcccaagccctgggaaacataggctcagaagaccgaagcactccttcccctggcaggcagcagggacatttgaacaaggggaaggggcagcttacactaacagggaacttgactggggcagagggacagggaagccaggtcgagatcaagcccccttactttccaccagctggaagggacttcaccaaccaagaccaaatagcatctggttcagtgggggccgggcccatagcccctaacaggtacaggagacacaagcggggaaccactacacttagcacatggggtgcctgggcttcagatggggaccccagcgaagcaggggctgaagaaggtgtggctgggggctctggcctggtcctctggacacccccaaatatctaccctgtggactttgagctgagcatgcccactggcacccaggccacgtgggacctggaggagcctgcctggggcctgcctctgccagaaggagccagggctgctgaggaagagctgtggggcagaagtgaagccccgcaggggaggccacagggtccagcctgtctttaggatcatctacactgcatgaggggagccccaggaaggcagcattcataagcccctgcaccagtgaggaagagaaagaggaggagaattaagaagaggatgatcgggaggaggaagaggagaataaggaggagcaggaggaagagggggaggagaaggaggaagagggggaggaggaagaggggaaggaggaggaagaagtgtaagaagagaagagaggatgtgttgggggtgggtagttgtttttggtttgcgtcatcatcaggcccgggctctgctcactgctgttccgtgtcaagaactccacctctgctttgccggtgtagatctcggccagtggctgcttgttctcttggggatgtgtgtgtttttatctgagcagctcctttccagagtaccccagcgcagttccaggagacggtgggaaggaggcatggcagacgctcaccttgtgactgtgacctcgactgcaggaggaccaaccagacacgggaaggagcagggctgcctgaggctccccaggaagctttgtgctttggcgttccacccctgctgttactcgtgactcagtttcctcaacttggtggggtgttccctgctatgttttccagcatcctgtgactgtcctgtgcagtctatagggcagggccctgccccagcgggtgggctcaggagggggttccctgaagcgagtacacattgccagagcccaccatcctggcaagaggtggatcctggggccctatggaaggagggatgtggtggggggggccacactgagggaggggccggggacttgtgacctgtagtggctgtttgcagtttctctctgtgttagattcccttttcttcagcagtttcagttcatgtttctcttcagtaaattttgttcagtgttcc

SEQ ID NO: 5514 - DNA, 2236 bp, Homo sapiens
aaacgccgagcgagcgagggagaggcacagtcagagggaacgcccgcgcggggagccaggggcgcccgaccccgccgccgccgcagcggcgcgcagcccccgacgcgccctgtggggacccggaccaggagggaccctgccccgggaaaaggctgtggagacctgggctccgaccccagttcatccccccacacccccgccgccccgtgccaccctggtccgcgctgggaaccctatcctgcccctcgtgtcagcccggcactggccagaatcgcgggcatggcggtgaccatgctgcaggactggtgccggtggatgggggtcaacgctcgcaggggcctgctcatcctgggcatcccggaggactgtgatgatgccgaattccaagagtccctcgaggctgccctgaggcctatgggacactttacagtgctaggcaaagtgtttcgagaggaggataatgccaccgcggccctggtcgagctcgaccgggaagtcaactatgctttggtccccagggaaatccccggcactgggggcccgtggaacgtggtctttgtgccccgttgctcaggcgaggagtttctcggtctcggtcgcgtgttccacttcccggagcaagaggggcagatggtggagagcgtggccggcgccctgggtgtggggctgcgcagggtgtgctggctgcgatccatcggtcaggcggtccagccctgggtggaggccgtgaggtaccagagcctgggcgtgttttccgggagggaccagccagccccaggggaggagtcctttgaggtctggctagaccacaccaccgaaatgctgcatgtgtggcagggggtctcggaaagggagaggaggaggaggctgctggaaggcttgcgtgggaccgccctgcagctcgtgcacgcgctcctggcggagaaccccgccaggacggcgcaggactgtctggcggccctggcccaggtgtttggagacaacgagtcccaggcgaccatccgggtgaagtgtctgaccgctcagcagcagtcaggcgagcgtctctcagctttcgtgttgcggctggaagtgctgctgcagaaggccatggagaaggaggccctggccagagcatccgccgaccgcgtgcgcctgaggcagatgctcaccagggcccaccttactgagcctctggatgaagcactgaggaagctgagaatggccgggaggtctccaagtttcttggagatgctggggctcgttcgggagtctgaggcatgggaggccagtctagccaggagcgtgagagcccagacacaggaaggggccggtgcccgggctggtgcccaggctgttgccagagccagcactaaagtagaggcggtcccaggaggtcctggtcgggagccagagggcctccgccaggcaggaggccaggaggctgaggagctcctccaggaggggctcaagcccgtcctggaggaatgtgataactaggttggggctggggaggcagcccagcgcgagtcctccccgggcaaataggctccgagggccccggggcctcctctcctcctctcaggcagcagggccctggagacaggcggaggcggggccagggccggtccctcaccccacatcgggatcggggccccccacttccccccaaggggccctgcccaccaccaccttcccggtgacccagatgaccacatttaataccaaatggggtggggggaggcgcccctccagtgccaggggcacgtgctgtgagcttcctgggagcccaggttgtgctcactgctctcccgtatcgtgagcaccacctctgctttccctgcgtagatctaggccaggggctgcttgtttttgtggagccgtgtgtgttcttctctgagcagctcctccccagaggaccccagcgcagtcccgggagatggcggaaagaaggcaccagggcacagtggacactcatcccgtgacagcgatggtgaccatgactgtgggagaaagaacaggacccgggatggagtggggctgtctgaggttccccagtgaactttgtgctttggcgttccacccctgttgttacttgttactgagtttcctagacctggggtgggtgttcccccaggaggaggggggtcccgacctgtgtcctgtggtggccatttgcagcttctgtgttgtgattcccttctcttcaacggtttcagtacatatctctcttcaataaatttcattcagtgttcca

SEQ ID NO: 5515 - DNA, 1479 bp, Homo sapiens
aaacgccgagcgagcgagggagaggcacagtcagagggaacgcccgcgcggggagccaggggcgcccgaccccgccgccgccgcagcggcgcgcagcccccgacgcgccctgtggggacccggaccaggagggaccctgccccgggaaaaggctgtggagacctgggctccgaccccagttcatccccccacacccccgccgccccgtgccaccctggtccgcgctgggaaccctatcctgcccctcgtgtcagcccggcactggccagaatcgcgggcatggcggtgaccatgctgcaggactggtgccggtggatgggggtcaacgctcgcaggggcctgctcatcctgggcatcccggaggactgtgatgatgccgaattccaagagtccctcgaggctgccctgaggcctatgggacactttacagtgctaggcaaagtgtttcgagaggaggataatgccaccgcggccctggtcgagctcgaccgggaagtcaactatgctttggtccccagggaaatccccggcactgggggcccgtggaacgtggtctttgtgccccgttgctcaggcgaggagtttctcggtctcggtcgcgtgttccacttcccggagcaagaggggcagatggtggagagcgtggccggcgccctgggtgtggggctgcgcagggtgtgctggctgcgatccatcggtcaggcggtccagccctgggtggaggccgtgaggtaccagagcctgggcgtgttttccgggagggaccagccagccccaggggaggagtcctttgaggtctggctagaccacaccaccgaaatgctgcatgtgtggcagggggtctcggaaagggagaggaggaggaggctgctggaaggcttgcgtgggaccgccctgcagctcgtgcacgcgctcctggcggagaaccccgccaggacggcgcaggactgtctggcggccctggcccaggtgtttggagacaacgagtcccaggcgaccatccgggtgaagtgtctgaccgctcagcagcagtcaggcgagcgtctctcagctttcgtgttgcggctggaagtgctgctgcagaaggccatggagaaggaggccctggccagagcatccgccgaccgcgtgcgcctgaggcagatgctcaccagggcccaccttactgagcctctggatgaagcactgaggaagctgagaatggccgggaggtctccaagtttcttggagatgctggggctcgttcgggagtctgaggcatgggaggccagtctagccaggagcgtgagagcccagacacaggaaggggccggtgcccgggctggtgcccaggctgttgccagagccagcactaaagtagaggcggtcccaggaggtcctggtcgggagccagagggcctccgccaggcaggaggccaggaggctgaggagctcctccaggaggggctcaagcccgtcctggaggaatgtgataactag

SEQ ID NO: 5516 - DNA, 1609 bp, Homo sapiens
acagtcagagggaacgcccgcgcggggagccaggggcgcccgaccccgccgccgccgcagcggcgcgcagcccccgacgcgccctgtggggacccggaccaggagggaccctgccccgggaaaaggctgtggagacctgggctccgaccccagttcatccccccacacccccgccgccccgagccaccctggtccgcgctgggaaccctatcctgcccctcgtgtcagcccggcactggccagaatcgcgggcatggcggtgaccatgctgcaggactggtgccggtggatgggggtcaacgctcgcaggggcctgctcatcctgggcatcccggaggactgtgatgatgccgaattccaagagtccctcgaggctgccctgaggcctatgggacactttacagtgctaggcaaagtgtttcgagaggaggataatgccaccgcggccctggtcgagctcgaccgggaagtcaactatgctttggtccccagggaaatccccggcactgggggcccgtggaacgtggtctttgtgccccgttgctcaggcgaggagtttctcggtctcggtcgcgtgttccacttcccggagcaagaggggcagatggtggagagcgtggccggcgccctgggtgtggggctgcgcagggtgtgctggctgcgatccatcggtcaggcggtccagccctgggtggaggccgtgaggtaccagagcctgggcgtgttttccgggagggaccagccagccccaggggaggagtcctttgaggtctggctagaccacaccaccgaaatgctgcatgtgtggcagggggtctcggaaagggagaggaggaggaggctgctggaaggcttgcgtgggaccgccctgcagctcgtgcacgcgctcctggcggagaaccccgccaggacggcgcaggactgtctggcggccctggcccaggtgtttggagacaacgagtcccaggcgaccatccgggtgaagtgtctgaccgctcagcagcagtcaggcgagcgtctctcagctttcgtgttgcggctggaagtgctgctgcagaaggccatggagaaggaggccctggccagagcatccgccgaccgcgtgcgcctgaggcagatgctcaccagggcccaccttactgagcctctggatgaagcactgaggaagctgagaatggccgggaggtctccaagtttcttggagatgctggggctcgttcgggagtctgaggcatgggaggccagtctagccaggagcgtgagagcccagacacaggaaggggccggtgcccgggctggtgcccaggctgttgccagagccagcactaaagtagaggcggtcccaggaggtcctggtcgggagccagagggcctccgccaggcaggaggccaggaggctgaggagctcctccaggaggggctcaagcccgtcctggaggaatgtgataactaggttggggctggggaggcagcccagcgcgagtcctccccgggcaaataggctccgagggccccggggcctcctctcctcctctcaggcagcagggccctggagacaggcggaggcggggccagggccggtccctcaccccacatcgggatcggggcc

SEQ ID NO: 5517 - DNA, 2255 bp, Homo sapiens
aggcgcctgcgcaccggcccaaacgccgagcgagcgagggagaggcacagtcagagggaacgcccgcgcggggagccaggggcgcccgaccccgccgccgccgcagcggcgcgcagcccccgacgcgccctgtggggacccggaccaggagggaccctgccccgggaaaaggctgtggagacctgggctccgaccccagttcatccccccacacccccgccgccccgtgccaccctggtccgcgctgggaaccctatcctgcccctcgtgtcagcccggcactggccagaatcgcgggcatggcggtgaccatgctgcaggactggtgccggtggatgggggtcaacgctcgcaggggcctgctcatcctgggcatcccggaggactgtgatgatgccgaattccaagagtccctcgaggctgccctgaggcctatgggacactttacagtgctaggcaaagcgtttcgagaggaggataatgccaccgcggccctggtcgagctcgaccgggaagtcaactatgctttggtccccagggaaatccccggcactgggggcccgtggaacgtggtctttgtgccccgttgctcaggcgaggagtttctcggtctcggtcgcgtgttccacttcccggagcaagaggggcagatggtggagagcgtggccggcgccctgggtgtggggctgcgcagggtgtgctggctgcgatccatcggtcaggcggtccagccctgggtggaggccgtgaggtgccagagcctgggcgtgttttccgggagggaccagccagccccaggggaggagtcctttgaggtctggctagaccacaccaccgaaatgctgcatgtgtggcagggggtctcggaaagggagaggaggaggaggctgctggaaggcttgcgtgggaccgccctgcagctcgtgcacgcgctcctggcggagaaccccgccaggacggcgcaggactgtctggcggccctggcccaggtgtttggagacaacgagtcccaggcgaccatccgggtgaagtgtctgaccgctcagcagcagtcaggcgagcgtctctcagctttcgtgttgcggctggaagtgctgctgcagaaggccatggagaaggaggccctggccagagcatccgccgaccgcgtgcgcctgaggcagatgctcaccagggcccaccttactgagcctctggatgaagcactgaggaagctgagaatggccgggaggtctccaagtttcttggagatgctggggctcgttcgggagtctgaggcatgggaggccagtctagccaggagcgtgagagcccagacacaggaaggggccggtgcccgggctggtgcccaggctgttgccagagccagcactaaagtagaggcggtcccaggaggtcctggtcgggagccagagggcctcctccaggcaggaggccaggaggctgaggagctcctccaggaggggctcaagcccgtcctggaggaatgtgataactaggttggggctggggaggcagcccagcgcgagtcctccccgggcaaataggctccgagggccccggggcctcctctcctcctctcaggcagcagggccctggagacaggcggaggcggggccagggccggtccctcaccccacatcgggatcggggccccccacttccccccaaggggccctgcccaccaccaccttcccggtgacccagatgaccacatttaataccaaatggggtggggggaggcgcccctccagtgccaggggcacgtgctgtgagcttcctgggagcccaggttgtgctcactgctctcccgtatcgtgagcaccacctctgctttccctgcgtagatctaggccaggggctgcttgtttttgtggagccgtgtgtgttcttctctgagcagctcctccccagaggaccccagcgcagtcccgggagatggcggaaagaaggcaccagggcacagtggacactcatcccgtgacagcgatggtgaccatgactgtgggagaaagaacaggacccgggatggagtggggctgtctgagtttccccagtgaactttgtgctttggcgttccacccctgttgttacttgttactgagtttcctagacctggggtgggtgttcccccaggaggaggggggtcccgacctgtgtcctgtggtggccatttgcagcttctgtgttgtgattcccttctcttcaacggtttcagtacatatctctcttcaataaatttcattcagtgttcc

SEQ ID NO: 5518 - DNA, 1479 bp, Homo sapiens
aaacgccgagcgagcgagggagaggcacagtcagagggaacgcccgcgcggggagccaggggcgcccgaccccgccgccgccgcagcggcgcgcagcccccgacgcgccctgtggggacccggaccaggagggaccctgccccgggaaaaggctgtggagacctgggctccgaccccagttcatccccccacacccccgccgccccgtgccaccctggtccgcgctgggaaccctatcctgcccctcgtgtcagcccggcactggccagaatcgcgggcatggcggtgaccatgctgcaggactggtgccggtggatgggggtcaacgctcgcaggggcctgctcatcctgggcatcccggaggactgtgatgatgccgaattccaagagtccctcgaggctgccctgaggcctatgggacactttacagtgctaggcaaagcgtttcgagaggaggataatgccaccgcggccctggtcgagctcgaccgggaagtcaactatgctttggtccccagggaaatccccggcactgggggcccgtggaacgtggtctttgtgccccgttgctcaggcgaggagtttctcggtctcggtcgcgtgttccacttcccggagcaagaggggcagatggtggagagcgtggccggcgccctgggtgtggggctgcgcagggtgtgctggctgcgatccatcggtcaggcggtccagccctgggtggaggccgtgaggtgccagagcctgggcgtgttttccgggagggaccagccagccccaggggaggagtcctttgaggtctggctagaccacaccaccgaaatgctgcatgtgtggcagggggtctcggaaagggagaggaggaggaggctgctggaaggcttgcgtgggaccgccctgcagctcgtgcacgcgctcctggcggagaaccccgccaggacggcgcaggactgtctggcggccctggcccaggtgtttggagacaacgagtcccaggcgaccatccgggtgaagtgtctgaccgctcagcagcagtcaggcgagcgtctctcagctttcgtgttgcggctggaagtgctgctgcagaaggccatggagaaggaggccctggccagagcatccgccgaccgcgtgcgcctgaggcagatgctcaccagggcccaccttactgagcctctggatgaagcactgaggaagctgagaatggccgggaggtctccaagtttcttggagatgctggggctcgttcgggagtctgaggcatgggaggccagtctagccaggagcgtgagagcccagacacaggaaggggccggtgcccgggctggtgcccaggctgttgccagagccagcactaaagtagaggcggtcccaggaggtcctggtcgggagccagagggcctcctccaggcaggaggccaggaggctgaggagctcctccaggaggggctcaagcccgtcctggaggaatgtgataactag

SEQ ID NO: 5519 - DNA, 3197 bp, Homo sapiens; identical to SEQ ID NO: 5509

SEQ ID NO: 5520 - DNA, 3198 bp, Homo sapiens; identical to SEQ ID NO: 5513

SEQ ID NO: 5521 - DNA, 3113 bp, Homo sapiens; identical to SEQ ID NO: 5512

SEQ ID NO: 5522 - DNA, 3213 bp, Homo sapiens; identical to SEQ ID NO: 5511

SEQ ID NO: 5523 - DNA, 5308 bp, Homo sapiens
gtgcaaaaccacaggatttattgtgcatgcatagttcagaatacaggaacgtgtatgggagtgagggccggtcccatcgagtggggcctgtaccctgcaagtgaggcccatataccctgaatggtgtcttgctcacaggtggtgcctgggcccccctatttgatactgagacccatatactgtgaatgaggccagtatcccgagtaagtcctggtcctacgctgcaaggccagtgccctttgatttaggcctatataatcctgaattccacctggcccctggaagggggaattgtaacccccagtgatgccggtaccctctggaaggaggcctctatcccctgaatgaggtcgggtatccttgagtgatttctggccctctgtggtttcggccttgttttttgctggttaatgaaagtggtgcttccaggccccaagtccttgtcatcgggacctttaagaaaagcgtctcaggccacagcgacgcagaccccagctcaaggctgcaccgttgccatggagacggttgggcgggggacaggggagggtgtgcggctccctctgcgcaggcgcacgcgcgagcagccgcgtcgcagcggaactgctgagattcaggcccagggtgcgcgctcagacgcggcgcgagcgccaggcaagctgcggctgctacctcccacgcctctccaggtgcactcggcgccgcccccctgcacctggctgcggtgccgagtcactcaggcctgtgtcagggagagagggagggagctgtcctggaaagcagacacgtaagccccccgcggatcctcagacagctctggagaggggtcccgggggaaggtcactgcgtccagccggccagcaggcagctagagcccccgagccccgagccccactccagccttgccacattcaccggaaccgggactctaagccctgcaagtggctttctagggttgcattgacaccgtgcgctgcagcccacccctatctcgggctccctgctgccccaagatcagcgccaagggggctgcaccatggccatgagccttttgcaggactggtgccggagcctggacgtggacgcgcacagggccctgctggtcaccggcatcccggagggcctggagcaggcagacgtcgaagccgtcctgcagccgaccctcctgcccctgggcacgttcaggttgcgacacatgaaggctttgatgaacgagaaggcccaggccgccctggtggagtttgtggaggacgtcaatcacgctgccattcccagggagatcccaggcaaggatggggtctggagggttctgtggaaggaccgtgcgcaggacacgagggtcctgaggcagatgagacgcctgctgctggatgacgggcccacgcaggccgcggaggctgggacccccggggaggcacccacccctcccgcttcggagacgcaggcccaggattctggggaggtaacagggcaggctggctcgcttcttggggcagccaggaacccaaggaggggccgtcggggtcgcagaaacagaaccagacgcaacaggttgacccagaagggcaagaagagaagccgaggaggacggccgtctgctcccgcgaggagtgaggccgaggactcttccgacgagagcctgggcatcgtgatcgaggagatcgaccagggcgacctgagcggagaagaggaccagagcgcgctgtacgccacgctgcaggccgctgccagggagctggttaggcagtgggcgccctgcaactccgagggggaagaagacggtccccgcgagttcttggctctggtcaccgtcaccgacaaatcgaagaaagaagaggcagagaaggagccagctggggccgaatccatccgcttgaacaccaaagaagacaaaaatggtgtccccgacttagtggccctgctggctgtgagagacaccccggacgaggagccggtggacagcgacacttcggagagcgactcgcaggaaagtggggaccaagaaacagaggagttggataatcctgagttcgtggccattgtggcctataccgacccgtcggacccctgggcccgggaggagatgttgaaaatcgcttctgttatcgagtcgctgggctggagcgacgagaaagacaagcgagaccccctccgacaggtcttgtccgtcatgtccaaggacactaacgggacccgcgtgaaggtggaagaggcgggccgcgaggtggacgccgtggtcctgcgcaaggccggggatgacggggacctccgggagtgcatttccaccttggcgcagccggatctccctccccaggcgaagaaggctgggcgtggcctcttcgggggctggagcgagcaccgtgaggacgaagggggtcttctggagctggtggcgctcctggctgcccaggacatggcggaggtgatgaaggaggaaaaagaaaacgcctgggaaggcgggaagtacaaataccccaaaggcaaactgggggaggtattggcgctcctggccgcccgggagaacatggggtccaacgaggggtcggaggaggcttcggacgaacagtccgaggaggagtcggaggacaccgagagcgaggcgtcggagccggaggacagggcatccaggaagccccgggccaagagggcgcgcacggcccccaggggcctgactccggccggcgcgcctcccaccgcttccggggcccgcaaaacccgcgcgggcggccgaggccgaggccggggcgtcactcccgagaagaaagccgggagccggggctcggcccaggacgacgccgcaggaagcaggaagaagaaggggagcgcgggcgccggggcccatgccagggcaggcgaggccaagggccaggcgcccactggatccaaggccgcgcgcgggaagaaggcccgtcggggccggaggctgccccctaaatgccgctagtggccccccaagaagccgcccaggctgcgagcaggccccgcagggcacccgcccgcctgtggcccccgccctcccctcccctcttcctgtcctccgcagacgcaatctcctcgcttcacagcgcgcccgggccgcgttttgccagcgtcacgttcccctctcgggccctcgcaggccgggggcgccagcgatcccgacggaggaagcccggatgggaggaggaaagagaagtgggcgcccgaggcagcagcgcagggccgagatggggacgcgccaagtggaccaggattgggggcccgggttgcccccggagggggtgtgtgtgtggacgccgggcacctgcagaggcgagcagggctcttcgtggcgctctcggggcctgcgcctggcaggtgctgtaggccgctgtcgcccctaccccagtctgactgggccctgggtctgtggtggaggctcagtcaccagccgcgcagcgcgtgtcagggcgcaactctcagccaggggaggccccagctcccagccaggggaagagatgattccagaaaggaaagtctgagagatagaaggcggttgggaaggggaggaggaggaaaggggagaggaacggtgggagaagggaaagaggaggaggagggggaggggggagcagagggaagacacatgccagccctgcctactggggcgcccctgataacaaaggaaccagccccaggccaaggccacctgcccctgaccacaagttgaatttgtcactcagactgcagtgtttcccaacattctaattatttgcagaggtgttcaatttggggtaattcacttaaaatccagttttggttcttctgggctgagtgggccctggcccctcccataggctgtggctcccctgggtgccccctctccagtggagctgacccaccgctcagcgctggccttgcagcccttactaaaagacttgaaagtccctgggttcaccccctgagtgaattaaaggccagaggggccccgaagggcactgtgagggacagaggctcacctgggcagtgcagaagccggccgcgtgtccctccttacaggggatgaaatgacctggggaggaaaccccagccctgccctggaggttccagagtaggcgggccggtgctgtgaggcttcacaacctgctgtcccaagcacgcttgagttgtatgtgagtctgtgccgtgccgtgccgtatgcttcagctcctgcaaccccggctgagctcgatttttacctaaatatcagtctccacgggaccccaccttcattcatgccttcttgtccctggggcaatgtgtgtgcttcctcgtcccaatttccattccctggcagtgaggagcccatcgtgccagggggccctgccccacttgtccctgggaaggaataggagggtttgggtgtgacctcacagtccagaccagactgtcccagtcctatgtcagggacacccagatgtagaagctgactgagacctgctgcagggcgtgggtgctcccctctgcttggaggctgtccctggacagtgacccacccactgaggaccaggctgggtgtaccttgagctgggcacagcagcctgtggtgttgcctgtgggtggggagggccccaggtgtgcttctcccgtagcagtcctaggcttctctccctgtgccctgtgtcacctggatcctccagtaaagtgaaattcagcactgtactctctctgtgctctgggcagtggggcaggcggggtgtgggagcgtgggccacagatgtccacggtcttgactgtggtttgcccagaatacctgggaactgtcctgtcactggtttacatacactgtcctttgctgcttcgggatccctgcctggctctccctaccccccagcatcatctcaccccttgcagatctgagccagcttccactcccacccctgatgcctccccacttccagcctcagctccgaagcccctggacacccatggagaccccgcccagccaatccccaccctagcttccacccagatacactctgccaggccacaactgcaggcactctccccccagcctccacccctcacctgtgccctggacctcagactcagctttccatcctacctgagttttctgcctccctccatcctgtgtccccccaccatacatggctgccagagacgtcctcttagaagtcacacctggggtctgattgcgtccctcgcctccccagatcccccaaggtctccttcctgtgccgtcatatctgcagttcttaggactgtctagacatgctttgttcaactaggtaatcacacggggtaaattggatttaaatgtaattaagattaaataaaaatacacatgcatgtc

SEQ ID NO: 5524 - DNA, 1937 bp, Homo sapiens
cggcgcgaccaggttcaggggcgggccgcgcggagcctcatttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacagtttgttacaggaacaactttttgacgtgaaggaagatagaaatttagccataaaattccatccaaaacttccactgaattggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcgggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcgaagaaccattattgagtttgcaagataagatgtatttgtattttctagtgtctttttatttataacaacacttttttggcaatcagtttgtagctgtgcccttatttttatagatagtttgccatttcttgggtttaatgtttaacaaggctatagaagtttaaaatagtggacaaatgtttgtgaatacacttttaaaaaattgttttaaaagagaaaagcggtcttgctttgttgcccagactggagtgcagtggcataatcatagctcaccgcaagcctcaaatttttgtgctcagatgatccttttcatctcagcctcctgattagctgggactataggcgtgtgccaccatgcccagctaattttgaaatttgcttgtagagatgggatctcactctgttgtccaggctggtctcagaattctggtgagtgatcctcccacagtggacttccaaagtgctgggattacaggtgtgagccaccatgcctggccccatgaatacactactaatattatttgtaaatatgtattttataatgtacaatgcttggaaaattttcagagtattctagtttaaaaaattttttctaattctgtaaattctattacaagtatgttgtttattacaactcattacaactacctaaattttaggtgttaactgtatttaagtaaatgtgttatttttgcatttcatagccagaaaatactgatgttcactt

SEQ ID NO: 5525 - DNA, 2061 bp, Homo sapiens
attgcgcggcgcgaccaggttcaggggcgggccgcgcggagcctcatttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcgggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcgaagaaccattattgagtttgcaagataagatgtatttgtattttctagtgtctttttatttataacaacacttttttggcaatcagtttgtagctgtgcccttatttttatagatagtttgccatttcttgggtttaatgtttaacaaggctatagaagtttaaaatagtggacaaatgtttgtgaatacacttttaaaaaattgttttaaaagagaaaagcggtcttgctttgttgcccagactggagtgcagtggcataatcatagctcaccgcaagcctcaaatttttgtgctcagatgatccttttcatctcagcctcctgattagctgggactataggcgtgtgccaccatgcccagctaattttgaaatttgcttgtagagatgggatctcactctgttgtccaggctggtctcagaattctggtgagtgatcctcccacagtggacttccaaagtgctgggattacaggtgtgagccaccatgcctggccccatgaatacactactaatattatttgtaaatatgtattttataatgtacaatgcttggaaaattttcagagtattctagtttaaaaaattttttctaattctgtaaattctattacaagtatgttgtttattacaactcattacaactacctaaattttaggtgttaactgtatttaagtaaatgtgttatttttgcatttcatagccagaaaatactgatgttcacttaaagatattcagcaattaaaatgttaaaa

SEQ ID NO: 5526 - DNA, 1582 bp, Homo sapiens
attgcgcggcgcgaccaggttcaggggcgggccgcgcggagcctcatttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcctttccaagagattaatggacaagaaattcaaagagccaatcaccagcgcattacaaaagctagagcaacatggtggaagtgggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcgaagaaccattattgagtttgcaagataagatgtatttgtattttctagtgtctttttatttataacaacacttttttggcaatcagtttgtagctgtgcccttatttttatagatagtttgccatttcttgggtttaatgtttaacaaggctatagaagtttaaaatagtggacaaatgtttgtgaatacactttt

SEQ ID NO: 5527 - DNA, 620 bp, Homo sapiens
tttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatctttgttacaggaacaactttttgacgtgaaggaagatagaaatttagccataaaattccatccaaaacttccactgaattggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcag

SEQ ID NO: 5528 - DNA, 681 bp, Homo sapiens
atttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactgtttgttacaggaacaactttttgacgtgaaggaagatagaaatttagccataaaattccatccaaaacttccactgaattggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactc

SEQ ID NO: 5529 - DNA, 1142 bp, Homo sapiens
aggcgctcggtggcggtagccgcggttgttggccgaccgagtgccggtcataagccccccccggtggggggcagctggtgtgcggatcgcggcgggagagaggcgcggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcgggagccttagcatcatcaaatctaaaattccaacatactgctccatatgctgttgaagaagggagccaacaaaaattgttttttctacctgttgacgtgtcaagcactaactgatttctgttgtgtgtctaggtgacgagttctaatttaatgcaattttctgctcaataaaagacaagataattatgtcctaaaaatcaatggtccttctgatggagtttggatttcttctggcaagcacttgaagacagtggaaagttttaaagaagaggagtgaagccactggctttgactgggtgagagaaagaagcaaaggcaaaggaatgtccagctaggcagaaaactggataaaatgacgaaaagagaaactgtctacaaaagcatctatggttctggttttactcaactg

SEQ ID NO: 5530 - DNA, 580 bp, Homo sapiens
atttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaagga

SEQ ID NO: 5531 - DNA, 915 bp, Homo sapiens
tttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagggtctgagagagactaagcatccatacacttttgtgtcaaaggagggttttagagaattacttttggtcaaaggtgctcctgaaaaagctattcctttgctacctagactgattcctgtgctaaaggcagctctggtccattcggatgatgaagtgtttgaaagaggattgaatgctctagttcagctaagtgtcgttgttggtccttctctaaacgaccatctgaagcatctgcttacaagcg

SEQ ID NO: 5532 - DNA, 860 bp, Homo sapiens
ccaggttcaggggcgggccgcgcggagcctcatttccccaaacgcaggcgctcggtggcggtagccgcggttgttggccgaccgagtgccggtcataagccccccccggtggggggcagctggtgtgcggatcgcggcgggagagaggcgcgggccgctggaccccgttgctaaggacccttgagatcgtgagcgcttggagtgtacccctcctttcctggggtagagggtcagtcgagagtagccttcgttaaccttaattgaaactgtctctttcagatacccaaatccacccatgccaaagtcctccagtctgctctccgtatccgtggttgggtcaaatctatagatgtggaacccgcatatacggagagccaactgtaatttgtcgttaagtttgttacaggaacaactttttgacgtgaaggaagatagaaatttagccataaaattccatccaaaacttccactgaattggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattacagtgggaatgtcctcctgaaagtctttcatttgatccacttcttattactttagctgagg

SEQ ID NO: 5533 - DNA, 573 bp, Homo sapiens
atttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacagaaacttgtgttgttccccctccaggagcttctcaaaacagaagtcaggcacaatattaaatacttgttgaatgatcacagaagtacaatagagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccgtttggtgaacagtcacgagtgccttctgcatttgcagctatttactctaaaggaggtattccttgcagattggtacatggttcagtaaaacacagattac

SEQ ID NO: 5534 - DNA, 1022 bp, Homo sapiens
atttccccaaacgcaggtgtcctgtctgcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccggtccattcggatgatgaagtgtttgaaagaggattgaatgctctagttcagctaagtgtcgttgttggtccttctctaaacgaccatctgaagcatctgcttacaagcgggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcgaagaaccattattgagtttgcaagataagatgtatttgtattttctagtgtctttttatttataacaacacttttttggcaatcagtttgtagctgtgcccttatttttatagatagtttgccatttcttgggtttaatgtttaacaaggctatagaagtttaaaatagtggacaaatgtttgtgaatacacttttaaaa

SEQ ID NO: 5535 - DNA, 1720 bp, Homo sapiens
ggggcgggccgcgcggagcctcatttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactggagtgaaagggaagcaatgcagaaatcagagggctctggaggtacacagttgaaaaacagagcaacaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccggtccattcggatgatgaagtgtttgaaagaggattgaatgctctagttcagctaagtgtcgttgttggtccttctctaaacgaccatctgaagcatctgcttacaagcgggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcgaagaaccattattgagtttgcaagataagatgtatttgtattttctagtgtctttttatttataacaacacttttttggcaatcagtttgtagctgtgcccttatttttatagatagtttgccatttcttgggtttaatgtttaacaaggctatagaagtttaaaatagtggacaaatgtttgtgaatacacttttaaaaaattgttttaaaagagaaaagcggtcttgctttgttgcccagactggagtgcagtggcataatcatagctcaccgcaagcctcaaatttttgtgctcagatgatccttttcatctcagcctcctgattagctgggactataggcgtgtgccaccatgcccagctaattttgaaatttgcttgtagagatgggatctcactctgttgtccaggctggtctcagaattctggtgagtgatcctcccacagtggacttccaaagtgctgggattacaggtgtgagccaccatgcctggccccatgaatacactactaatattatttgtaaatatgtattttataatgtacaatgcttggaaaattttcagagtattctagtttaaaaaattttttctaattctgtaaattctattacaagtatgttgtttattacaactcattacaactacctaaattttaggtgttaactgtatttaagtaaatgtgttatttttgcatttcatagccagaaaatactgatgttcacttaaaga

SEQ ID NO: 5536 - DNA, 3372 bp, Homo sapiens
gcgggaggcggtaccaacccctgccgcaggactttcctgggccggctcgcggagagcgtagcgcggccttggtggcggaatggcgttgagtgacggcccggccccgccatctggttaaagggactcgttcaacacggaagtgtcccggggctgcattgtgctacagctagaatgaagcacatcaacctatcatttgcagcgtgtggatttctgggcatttaccacttgggggcagcatctgcactttgcagacatggcaaaaaacttgtgaaggatgtcaaagccttcgctggggcgtctgcgggatcgttggttgcttctgttctgctaacagcaccagaaaaaatagaggaatgtaaccaatttacctacaagtttgccgaagaaatcagaaggcagtctttcggggcagtaacgcccggttatgacttcatggcccgactaagaagtgggatggagtcgattcttcctcccagcgctcacgagctggcccagaaccgactgcacgtatccatcaccaacgccaaaaccagagaaaatcacttagtctccactttttcctccagggaggacctcattaaggtcctcctagccagcagttttgtgcccatttatgcaggactgaagctagtggaatacaaagggcagaagtgggtggacggaggcctcaccaacgctcttcccatcctgcccgtcggccggacagtaaccatctcccccttcagtggacgactggacatctccccgcaggacaaagggcagctagatctgtatgttaatatcgccaagcaggatatcatgttgtccctggcaaacctggtgagactcaaccaagccctttttcccccaagcaagaggaaaatggaatctttgtatcagtgtggttttgatgacactgttaagtttttacttaaagaaaattggtttgaataaaatgcataaaagtttataatgcaaaacacgttttagatagtttttgatggaagtttctaatcaaatcctttttagaaaatctatcatgactcaattgtattactccttgtaatatttgtgtttatttttaatatttgaattattacttagcacatggatataagaggcactttattagaatttgacaacgtcattaagaaggatacacttaggtgataaggaatcatttttggtgaactgttgtgtcctttaaaaaatggaggaggataggttctttgggtaaattgaggaacatggaaaatggagggccaccacttaggttccatggagaatatgtggcatgatcttgacgtgaagcatgggtgtttccgtgacttagctgtgtccctgtagctctggaactgaaggaactaggtaggagaggaaggatttgagaaataggcaactcatggttaaagacctttgatcaggactggaggaacaaaggtttgtgtattagtccattttcacactgctgagaaagacatacccaagactgggcaatttacaaaagaaaggtttaatgggctcacagttccacatgactgaggaggcctcacaattgtggtggaaggtgaaaggcatgtctcacatggcagcagacaagagaagaaaacttgtgcagggaaactcccctttataaaaccatcggatctcttgagactcgttcactatcatgagaatagcatgggaaagacctgcctccatgattcagttacctcccactgggtccctcccacaacgtgtggcaattgtgggagctacatacacttcaagatgagatttgggtggggacacagccaaaccataacagtttgctttccacaggtgtgtgcagttgctcccagtgcagttaggggcagatatccagaagcctaggagattttgaagaggcttatcccctctcatcttcctcccctaaaccccaccccagtttaggagattatcaagctggttgtcattcattctctctctctctctctctctctctctctctctctctctctctctctctctctcgccatacctctctgagtatttagctattgttctatatactggatacatctattatgggaacttaaatagataaaatactactaaacacaaagaaccaagtagcctagtaaataagaattaaatccagaataatcattcacttctcatttttaaatcacgttgtactgatcccaggttttttactttctgagtagttgtccatcactttgaggacttgtgtatgggcttgtaccaatttactgacactgtcttaaatcctaaatctgtttttatgaggttttgccaagcaagaactcttgattactaagaggcagttagagacaaaccaatttaattccatgtcttcaattgtcacgcatttcttcttttactctttgaaactattctttgagtcaattttatggttctcagaagccaaaatacacaacttttagcacataaacaccaacgatggcctctttttgaggagttatgcatagacccactctagagtaatgatggtccctgtggtatatactttctcctactctagcaaacatgtagtttaatcttaatgtgttgtttccataagtgacatgaagtggatagattctcaattgttatgtccacttattcactaggtaaattttcagttttaatacttttctccttaccccttcctttgatcatttcatgtgaatattctatttgtatgatacactgtatttcaataaattccttgttgatgtacccttaaattgaagaaatttaagctgcaaaaccaaatctcattgtataagacttttttgaagtatcttgtatcgactacatatgtatttgaccctgtgggaggatggtacttttctttttaacttttattttaagttcaggggtacgtgtacaggtttgttataggtaaacttgtgtcacgggggtttgttgtaaagattaatttatcacccaggtgttggtacttttctttaaaaatactgtaagatcattgacgtatcagtctgcagcaactttcctacatgaggggaatacagcggtgtaatgaaacacatacttggtgcacactaggcgctctccggggctggtgcaccaaattctcctgtgagcatgctaccaagcatgctctgcttacctttgctggagtgtgtgctcatgcagccatactaattgaaaacaggcattcacaacaggatctgcctcacttgtgggatcaaaattttgaggcattgtagaactggcatatagaaaatctgaaaggagtttctgacccagatactgatatgtttgcagggtaattactgtgattggcagcttgataaattcccaattccctgtgggggcaatttccttatatatttgaatctgtcattaaaaatgtcattagtcttc

SEQ ID NO: 5537 - DNA, 652 bp, Homo sapiens
agacgcgaagagggtaaggcacttccggggcacagaaaatgaggattattaaaggtcagttgctcgcagtgctacagctagaatgaagcacatcaacctatcatttgcagcgtgtggatttctgggcatttaccacttgggggcagcatctgcactttgcagacatggcaaaaaacttgtgaaggatgtcaaagccttcgctggggcgtctgcgggatcgttggttgcttctgttctgctaacagcaccagaaaaaatagaggaatgtaaccaatttacctacaagtttgccgaagaaatcagaaggcagtctttcggggcagtaacgcccggttatgacttcatggcccgactaagaagtgggatggagtcgattcttcctcccagcgctcacgagctggcccagaaccgactgcacgtatccatcaccaacgccaaaaccagagaaaatcacttagtctccactttttcctccagggaggacctcattaaggtcctcctagccagcagttttgtgcccatttatgcaggactgaagctagtggaatacaaagggcagaagtgggtggacggaggcctcaccaacgctcttcccatcctgcccgtcggccggacagtaaccatctcccccttcagtggacgactggacatc

SEQ ID NO: 5538 - DNA, 2752 bp, Homo sapiens
agacgcgaagagggtaaggcacttccggggcacagaaaatgaggattattaaagtgctacagctagaatgaagcacatcaacctatcatttgcagcgtgtggatttctgggcatttaccacttgggggcagcatctgcactttgcagacatggcaaaaaacttgtgaaggatgtcaaagccttcgctggggcgtctgcgggatcgttggttgcttctgttctgctaacagcaccagaaaaaatagaggaatgtaaccaatttacctacaagtttgccgaagaaatcagaaggcagtctttcggggcagtaacgcccggttatgacttcatggcccgactaagaagtgggatggagtcgattcttcctcccagcgctcacgagctggcccagaaccgactgcacgtatccatcaccaacgccaaaaccagagaaaatcacttagtctccactttttcctccagggaggacctcattaaggtcctcctagccagcagttttgtgcccatttatgcaggactgaagctagtggaatacaaagggcagaagtgggtggacggaggcctcaccaacgctcttcccatcctgcccgtcggccggacagtaaccatctcccccttcagtggacgactggacatctccccgcaggacaaagggcagctagatctgtatgttaatatcgccaagcaggatatcatgttgtccctggcaaacctggtgagactcaaccaagccctttttcccccaagcaagaggaaaatggaatctttgtatcagtgtggttttgatgacactgttaagtttttacttaaagaaaattggtttgaataaaatgcataaaagtttataatgcaaaacacgttttagatagtttttgatggaagtttctaatcaaatcctttttagaaaatctatcatgactcaattgtattactccttgtaatatttgtgtttatttttaatatttgaattattacttagcacatggatataagaggcactttattagaatttgacaacgtcattaagaaggatacacttaggtgataaggaatcatttttggtgaactgttgtgtcctttaaaaaatggaggaggataggttctttgggtaaattgaggaacatggaaaatggagggccaccacttaggttccatggagaatatgtggcatgatcttgacgtgaagcatgggtgtttccgtgacttagctgtgtccctgtagctctggaactgaaggaactaggtaggagaggaaggatttgagaaataggcaactcatggttaaagacctttgatcaggactggaggaacaaaggtttgtgtattagtccattttcacactgctgagaaagacatacccaagactgggcaatttacaaaagaaaggtttaatgggctcacagttccacatgactgaggaggcctcacaattgtggtggaaggtgaaaggcatgtctcacatggcagcagacaagagaagaaaacttgtgcagggaaactcccctttataaaaccatcggatctcttgagactcgttcactatcatgagaatagcatgggaaagacctgcctccatgattcagttacctcccactgggtccctcccacaacgtgtggcaattgtgggagctacatacacttcaagatgagatttgggtggggacacagccaaaccataacagtttgctttccacaggtgtgtgcagttgctcccagtgcagttaggggcagatatccagaagcctaggagattttgaagaggcttatcccctctcatcttcctcccctaaaccccaccccagtttaggagattatcaagctggttgtcattcattctctctctctctctctctctctctctctctctctctctctctctctctctctcgccatacctctctgagtatttagctattgttctatatactggatacatctattatgggaacttaaatagataaaatactactaaacacaaagaaccaagtagcctagtaaataagaattaaatccagaataatcattcacttctcatttttaaatcacgttgtactgatcccaggttttttactttctgagtagttgtccatcactttgaggacttgtgtatgggcttgtaccaatttactgacactgtcttaaatcctaaatctgtttttatgaggttttgccaagcaagaactcttgattactaagaggcagttagagacaaaccaatttaattccatgtcttcaattgtcacgcatttcttcttttactctttgaaactattctttgagtcaattttatggttctcagaagccaaaatacacaacttttagcacataaacaccaacgatggcctctttttgaggagttatgcatagacccactctagagtaatgatggtccctgtggtatatactttctcctactctagcaaacatgtagtttaatcttaatgtgttgtttccataagtgacatgaagtggatagattctcaattgttatgtccacttattcactaggtaaattttcagttttaatacttttctccttaccccttcctttgatcatttcatgtgaatattctatttgtatgatacactgtatttcaataaattccttgttgatgtacccttaaattgaagaaatttaagctgcaaaaccaaatctcattgtataagacttttttgaagtatcttgtatcgactacatatgtatttgaccctgtgggaggatggtacttttctttttaacttttattttaag

SEQ ID NO: 5539 - DNA, 2559 bp, Homo sapiens
agacgcgaagagggtaaggcacttccggggcacagaaaatgaggattattaaaggaatgtaaccaatttacctacaagtttgccgaagaaatcagaaggcagtctttcggggcagtaacgcccggttatgacttcatggcccgactaagaagtgggatggagtcgattcttcctcccagcgctcacgagctggcccagaaccgactgcacgtatccatcaccaacgccaaaaccagagaaaatcacttagtctccactttttcctccagggaggacctcattaaggtcctcctagccagcagttttgtgcccatttatgcaggactgaagctagtggaatacaaagggcagaagtgggtggacggaggcctcaccaacgctcttcccatcctgcccgtcggccggacagtaaccatctcccccttcagtggacgactggacatctccccgcaggacaaagggcagctagatctgtatgttaatatcgccaagcaggatatcatgttgtccctggcaaacctggtgagactcaaccaagccctttttcccccaagcaagaggaaaatggaatctttgtatcagtgtggttttgatgacactgttaagtttttacttaaagaaaattggtttgaataaaatgcataaaagtttataatgcaaaacacgttttagatagtttttgatggaagtttctaatcaaatcctttttagaaaatctatcatgactcaattgtattactccttgtaatatttgtgtttatttttaatatttgaattattacttagcacatggatataagaggcactttattagaatttgacaacgtcattaagaaggatacacttaggtgataaggaatcatttttggtgaactgttgtgtcctttaaaaaatggaggaggataggttctttgggtaaattgaggaacatggaaaatggagggccaccacttaggttccatggagaatatgtggcatgatcttgacgtgaagcatgggtgtttccgtgacttagctgtgtccctgtagctctggaactgaaggaactaggtaggagaggaaggatttgagaaataggcaactcatggttaaagacctttgatcaggactggaggaacaaaggtttgtgtattagtccattttcacactgctgagaaagacatacccaagactgggcaatttacaaaagaaaggtttaatgggctcacagttccacatgactgaggaggcctcacaattgtggtggaaggtgaaaggcatgtctcacatggcagcagacaagagaagaaaacttgtgcagggaaactcccctttataaaaccatcggatctcttgagactcgttcactatcatgagaatagcatgggaaagacctgcctccatgattcagttacctcccactgggtccctcccacaacgtgtggcaattgtgggagctacatacacttcaagatgagatttgggtggggacacagccaaaccataacagtttgctttccacaggtgtgtgcagttgctcccagtgcagttaggggcagatatccagaagcctaggagattttgaagaggcttatcccctctcatcttcctcccctaaaccccaccccagtttaggagattatcaagctggttgtcattcattctctctctctctctctctctctctctctctctctctctctctctctctctctcgccatacctctctgagtatttagctattgttctatatactggatacatctattatgggaacttaaatagataaaatactactaaacacaaagaaccaagtagcctagtaaataagaattaaatccagaataatcattcacttctcatttttaaatcacgttgtactgatcccaggttttttactttctgagtagttgtccatcactttgaggacttgtgtatgggcttgtaccaatttactgacactgtcttaaatcctaaatctgtttttatgaggttttgccaagcaagaactcttgattactaagaggcagttagagacaaaccaatttaattccatgtcttcaattgtcacgcatttcttcttttactctttgaaactattctttgagtcaattttatggttctcagaagccaaaatacacaacttttagcacataaacaccaacgatggcctctttttgaggagttatgcatagacccactctagagtaatgatggtccctgtggtatatactttctcctactctagcaaacatgtagtttaatcttaatgtgttgtttccataagtgacatgaagtggatagattctcaattgttatgtccacttattcactaggtaaattttcagttttaatacttttctccttaccccttcctttgatcatttcatgtgaatattctatttgtatgatacactgtatttcaataaattccttgttgatgtacccttaaattgaagaaatttaagctgcaaaaccaaatctcattgtataagacttttttgaagtatcttgtatcgactacatatgtatttgaccctgtgggaggatggtacttttctttttaacttttattttaag

SEQ ID NO: 5540 - DNA, 2118 bp, Homo sapiens
ataatcacgacacattcaacacagatgtgagcgtttggagagagcttcagccttcagcacaggcaactgtgttctattcaccgggctgtgctcctcggaagggctggtggttcctgtaaaagtttgtgctccccgcgcctttccttccttccctcgtctttggcgcctgcgggcaccgggagtcctgggagagggaggaggaacggcgaatcggcggggcgtgtccttcacgccgccccgtagctcggggccgaagctggcgcagcgcgcgactttttgaaagccaggagggttcgaattgcaacggcagctgccgggcgtatgtgttggtgctagaggcagctgcagggtctcgctgggggccgctcgggaccaattttgaagaggtacttggccacgacttattttcacctccgacctttccttccaggcggtgagactctggactgagagtggctttcacaatggaagggatcagtaatttcaagacaccaagcaaattatcagaaaaaaagaaatctgtattatgttcaactccaactataaatatcccggcctctccgtttatgcagaagcttggctttggtactggggtaaatgtgtacctaatgaaaagatctccaagaggtttgtctcattctccttgggctgtaaaaaagattaatcctatatgtaatgatcattatcgaagtgtgtatcaaaagagactaatggatgaagctaagattttgaaaagccttcatcatccaaacattgttggttatcgtgcttttactgaagccaatgatggcagtctgtgtcttgctatggaatatggaggtgaaaagtctctaaatgacttaatagaagaacgatataaagccagccaagatccttttccagcagccataattttaaaagttgctttgaatatggcaagagggttaaagtatctgcaccaagaaaagaaactgcttcatggagacataaagtcttcaaatgttgtaattaaaggcgattttgaaacaattaaaatctgtgatgtaggagtctctctaccactggatgaaaatatgactgtgactgaccctgaggcttgttacattggcacagagccatggaaacccaaagaagctgtggaggagaatggtgttattactgacaaggcagacatatttgcctttggccttactttgtgggaaatgatgactttatcgattccacacattaatctttcaaatgatgatgatgatgaagataaaacttttgatgaaagtgattttgatgatgaagcatactatgcagcgttgggaactaggccacctattaatatggaagaactggatgaatcataccagaaagtaattgaactcttctctgtatgcactaatgaagaccctaaagatcgtccttctgctgcacacattgttgaagctctggaaacagatgtctagtgatcatctcagctgaagtgtggcttgcgtaaataactgtttattccaaaatatttacatagttactatcagtagttattagactctaaaattggcatatttgaggaccatagtttcttgttaacatatggataactatttctaatatgaaatatgcttatattggctataagcacttggaattgtactgggttttctgtaaagttttagaaactagctacataagtactttgatactgctcatgctgacttaaaacactagcagtaaaacgctgtaaactgtaacattaaattgaatgaccattacttttattaatgatctttcttaaatattctatattttaatggatctactgacattagcactttgtacagtacaaaataaagtctacatttgtttaaaacactgaaccttttgctgatgtgtttatcaaatgataactggaagctgaggagaatatgcctcaaaaagagtagctccttggatacttcagactctggttacagattgtcttgatctcttggatctcctcagatctttggtttttgctttaatttattaaatgtattttccatactgagtttaaaatttattaatttgtaccttaagcatttcccagctgtgtaaaaacaataaaactcaaataggatgataaagaataaaggacactttgggtaccagaag

SEQ ID NO: 5541 - DNA, 2084 bp, Homo sapiens
ggtctcattctgttgcccaggctggagtgcagtggtgcgatctcggctcacagcaacctctctgcctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcccacagtacagcctcacattcttcttccaattctgaagatacagagatgtgatgaaaacaagtaatagctttggctgtttatttgatagctgtttctgggtatttaataggaatcctttctcaaggaatgagttgtgacctgtttactgtctctttagaagaaaaactccactggaaaccattcaccatgtgtgattgtcttctgttatcatttgtcttacaggcggctattgcagacggctaatttatgcttaacttaggaagagataaggcaagagctagatttttttcatgtgatcttttccaagcttcaacttaacttaactacatttctctgtatgatgatgtctcttacttctacaggttccttgagcaccaaagatgattcataactctgtataggtgacagctgcttataaaagcatcttagcagataagcctattaaaattgtgcttttgtaacaatgttgtggttgctagaataaataccattaacaaatgcc

SEQ ID NO: 5542 - DNA, 2032 bp, Homo sapiens
cagagcagctcctcttccatctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcccacagtacagcctcacattcttcttccaattctgaagatacagagatgtgatgaaaacaagtaatagctttggctgtttatttgatagctgtttctgggtatttaataggaatcctttctcaaggaatgagttgtgacctgtttactgtctctttagaagaaaaactccactggaaaccattcaccatgtgtgattgtcttctgttatcatttgtcttacaggcggctattgcagacggctaatttatgcttaacttaggaagagataaggcaagagctagatttttttcatgtgatcttttccaagcttcaacttaacttaactacatttctctgtatgatgatgtctcttacttctacaggttccttgagcaccaaagatgattcataactctgtataggtgacagctgcttataaaagcatcttagcagataagcctattaaaattgtgcttttgtaacaatgttgtggttgctagaataaataccattaac

SEQ ID NO: 5543 - DNA, 1327 bp, Homo sapiens
gcattgggactgactccagcctctgctccgggaggccctcccgggctgcctgacctcccgggaccatgcagaaggcctcccacaaaaacaaaaaagaaagaggagtcagcaacaaggtcaaaacatctgtacacaacttgagcaaaacacagcagaccaaactcactgtgggtagcctgggattaggcctcatcatcatccagcatggaccctacctccagatcacccacctcatcaggaagggggctgcagccaacgacgggaaactccagccaggctgtacaggaagcatggctggggaggcctcaggaaacttacaatcatggcagaaggtgaagaggaaggaggtgatgttctgattagtgttggccatgccaatgtgttaggatatactcttcgagaatttttacagcttttgcaacatatcactattggaacagtgctacaaatcaaggtttaccgagattttattaacattcctgaagaatggcaagaaatatatgatttaatccctgaggccaaattcccagtaacaagcacaccaaagaaaattgagctggcaaaagatgaatctttcacaagcagtgatgataatgaaaatgtagatttagataaaagacttcaatattatagatatccgtggtcaactgtgcatcaccctgcaaggagaccaatatccatctccagagactggcatggatataagaagaagaaccatactattagtgtaggaaaagacattaattgtgacgtgatgattcacagagacgacaagaaagaagtgagggccccttctccatactggataatggtgaagcaagacaatgaaagctcttcctcctctacctcctctacctcagatgcattttggctggaagattgtgcccaagttgaagagggtaaagcccaactggtatcaaaggttggttagcaaatctgtggtcatatgagcatttatcttgcagacacccaagttttgtgcctcaccaggcacaagtttgctgtacttatcaaggactgtctgtagactcaccaattctcttctcttatgactgcgttataaagcctttagagatgttcttcaacaggattatctaaagacttccttgggttcttgcaggcctcacaaatcttattttcagaataagaccctcctttttgagaagaatttctttcttttagaaaatgccgtagagaaatccaatatcagaatgtctgaacatagtagagaatgtcactttatgtaaacactacatttttctttaaatatttagtttctctcttttttttggtaaacttcaagtactataattaaaataactaagag

SEQ ID NO: 5544 - DNA, 1260 bp, Homo sapiens
attgggactgactccagcctctgctccgggaggccctcccgggctgcctgacctcccgggaccatgcagaaggcctcccacaaaaacaaaaaagaaagaggagtcagcaacaaggtcaaaacatctgtacacaacttgagcaaaacacagcagaccaaactcactgtgggtagcctgggattaggcctcatcatcatccagcatggaccctacctccagatcacccacctcatcaggaagggggctgcagccaacgacgggaaactccagccaggtgatgttctgattagtgttggccatgccaatgtgttaggatatactcttcgagaatttttacagcttttgcaacatatcactattggaacagtgctacaaatcaaggtttaccgagattttattaacattcctgaagaatggcaagaaatatatgatttaatccctgaggccaaattcccagtaacaagcacaccaaagaaaattgagctggcaaaagatgaatctttcacaagcagtgatgataatgaaaatgtagatttagataaaagacttcaatattatagatatccgtggtcaactgtgcatcaccctgcaaggagaccaatatccatctccagagactggcatggatataagaagaagaaccatactattagtgtaggaaaagacattaattgtgacgtgatgattcacagagacgacaagaaagaagtgagggccccttctccatactggataatggtgaagcaagacaatgaaagctcttcctcctctacctcctctacctcagatgcattttggctggaagattgtgcccaagttgaagagggtaaagcccaactggtatcaaaggttggttagcaaatctgtggtcatatgagcatttatcttgcagacacccaagttttgtgcctcaccaggcacaagtttgctgtacttatcaaggactgtctgtagactcaccaattctcttctcttatgactgcgttataaagcctttagagatgttcttcaacaggattatctaaagacttccttgggttcttgcaggcctcacaaatcttattttcagaataagaccctcctttttgagaagaatttctttcttttagaaaatgccgtagagaaatccaatatcagaatgtctgaacatagtagagaatgtcactttatgtaaacactacatttttctttaaatatttagtttctctcttttttttggtaaacttcaagtactataattaaaataactaagagacataa

SEQ ID NO: 5545 - DNA, 1076 bp, Homo sapiens
attgggactgactccagcctctgctccgggaggccctcccgggctgcctgacctcccgggaccatgcagaaggcctcccacaaaaacaaaaaaggtgatgttctgattagtgttggccatgccaatgtgttaggatatactcttcgagaatttttacagcttttgcaacatatcactattggaacagtgctacaaatcaaggtttaccgagattttattaacattcctgaagaatggcaagaaatatatgatttaatccctgaggccaaattcccagtaacaagcacaccaaagaaaattgagctggcaaaagatgaatctttcacaagcagtgatgataatgaaaatgtagatttagataaaagacttcaatattatagatatccgtggtcaactgtgcatcaccctgcaaggagaccaatatccatctccagagactggcatggatataagaagaagaaccatactattagtgtaggaaaagacattaattgtgacgtgatgattcacagagacgacaagaaagaagtgagggccccttctccatactggataatggtgaagcaagacaatgaaagctcttcctcctctacctcctctacctcagatgcattttggctggaagattgtgcccaagttgaagagggtaaagcccaactggtatcaaaggttggttagcaaatctgtggtcatatgagcatttatcttgcagacacccaagttttgtgcctcaccaggcacaagtttgctgtacttatcaaggactgtctgtagactcaccaattctcttctcttatgactgcgttataaagcctttagagatgttcttcaacaggattatctaaagacttccttgggttcttgcaggcctcacaaatcttattttcagaataagaccctcctttttgagaagaatttctttcttttagaaaatgccgtagagaaatccaatatcagaatgtctgaacatagtagagaatgtcactttatgtaaacactacatttttctttaaatatttagtttctctcttttttttggtaaacttcaagtactataattaaaataactaagagac

SEQ ID NO: 5546 - DNA, 5582 bp, Homo sapiens
cttgcgcctgtccaggcactgccaatcgagactccgccgttccgctagtcccagctagccgccagccgaacaccggcctcgccagaaacctgaaaccagccgcgtgagtcggcgacgcggattgcgcctgcgcgcttggggagagggggacccgaggaagagactggttcgccgcggggaccgggcagggctccccgtcggagtgcactgcgccggacacttcaagccctggagggacaggaaagccagaaatggacttcgtgagactcgctcgactgttcgccagggcccgccccatgggactgttcatcctgcaacacctggacccctgtagagccaggtgggcaggaggcagggaggggctgatgcggccaatgtgggcgcccttcagcagctcctcctctcagctgcccctcggccaggagcgtcaggaaaacacgggcagcctgggctctgacccgagccactccaactccacggccacgcaggaagaagacgaggaggaggaggagagttttgggaccctctctgacaaatactcctcccggagactattccgcaaatccgcagcccagttccataacctgcggtttggggaacggagagatgagcaaatggaaccggagcccaaattatggcgaggccggagaaacaccccgtactggtacttcttgcagtgcaaacacctgatcaaggaagggaagctggttgaagccctggacctgtttgagaggcagatgctgaaggaggagcgattgcagcccatggagagcaactacacggtgctgattgggggctgcgggcgggttggctacctgaagaaggccttcaacctctacaaccagatgaaaaagcgggacctggagccctcggacgccacctacacggccctgttcaacgtctgtgccgagtccccctggaaggactcagctctacagagcgccctgaagctccggcagcagctgcaggccaaaaacttcgagctcaacttgaaaacataccacgcgctgctgaagatggctgccaagtgcgcagaccttaggatgtgcctcgatgtgttcaaggaaatcatccacaaagggcacgtggtcacagaggagaccttcagtttcctgctcatgggctgcatccaagacaagaagacaggcttccggtacgccctccaggtgtggcggctgatgctgagtctagggctacagccgagccgggacagctacaacctgctgttggtggcagctcgggactgtggcctaggggacccccaggtggcctcagagctgcttctgaagcccagggaggaggcgactgtgcttcagcccccagtgagcaggcagcggccaaggaggacagcccaggccaaggcaggcaacctcatgtcagccatgctgcatgtggaggccctggagaggcagctgtttctggaaccttctcaggcacttgggcctccagagcctccggaagccagagtgcccggcaaggcccaaccagaggtggatactaaggcagagcccagccacacagcagccctcaccgcagtggccctgaagccacctcccgtggagctggaagtcaacctcctgacccccggggccgttccccctacagtggtctcctttggaacggtgaccaccccagctgaccggctggccttgatagggggcctggagggcttcctgagcaagatggcagagcacaggcagcagcccgacatcaggaccctcacgctactggccgaggtggtggagtccgggagtcctgcagagtccttgctgctggccctcctggatgagcaccaggtagaggccgacctgacattctttaacacgctggtgagaaagaagagcaagctgggagacctggagggggccaaggcgctgttgccggtcctggcaaagaggggcctcgtccccaacctgcagacattctgcaacctggccatcgggtgccacaggccgaaggacggtctacagcttctcacagacatgaagaagtcccaggtgacccccaacactcacatctacagtgccctcatcaacgcggccatcaggaagctgaactacacctatctcatcagcatcttgaaggacatgaagcagaacagggtcccggtgaacgaagtggtcatccgccagctggagtttgcagcccagtaccctcccacctttgaccggtaccaagggaagaacacctacctggagaagattgacggcttccgagcctattacaagcagtggctgacagtgatgcccgcagaggaaaccccgcacccctggcagaagttccggaccaagccccagggggaccaggacaccggcaaggaggctgatgacggatgtgcccttgggggcaggtgatgggagcacagctggaacaatgtgctcggcccccagtgctctgtgggagccccaggacaagtgagctggtgtcacctcctgcctgggggaagagccaggccctgaggaacagccgcagcgtgtcacaggtgttggtgaggacacacactaggcccaaggtgcctgtgctcccagcaggtccaagtgcagctccagccacctttgcgtgtcaccttcacgggacttccagctccagctacctttgtgtgtcacctcacacaccacaagggggctggggcatctggtccctggggcctgggccgccccgccgggttccataggccgatgctctgaaagaagagacgtggggctcgagagatttaaagattttatttttacaaatcacagctgatagacagcgaagccttccccatagagaccgtgctccaactcgggcctggggcactgctcgctgctcccaggaagggggtggcgtgacaggcaggaacctgcgaagtccagagtccagggtggagcgcgccagcctcagccagagcagccacgacagccacagtgtgtgcactcgatgatgcggccctgcaacggaggaggacagtgagacgatgccactgcgccacgctcgcccctgcacactcacatatgtggcaaccctcccacgaaggacctgccaccatgccatatagggacacacctcagaaacccttccttgacagctctggacagggaaaatttggctccctcatgaaggtagaaccagctgctgttgacaccgaggttacatctgtatgtctatttataatatgttctgcaaatccaacacacgtttgccaatcaagaaaaagaaatcggtgtgaatgagtctcgttattctgctaagtgagcatgacagaccctgcgatgagcagacgtggctctgctactgtttggggacttcaggggggcctctgggctggtacactctggtgggggaagagggcaggagactatgcacttgagtcacacccttctggcccagagccccccagaaagaagggtcttgtcccccaggcctggtgcggcccaacacttggccagccagaaagccctagaacagtggcttgtgtttattttactttttcaagttctttttttggaagaacaagaccatagtttaagtaaacaggatcctctggtgaaacccaggtaagtctacagcgggctgttttggccacagggctgaagcagcaccccagcccaccagcccctgacctggactccttgtggaatctgggcactcagaggaagggggcttctgccactctgccacctgtccctgcctccatcagaaaaccaacaccccagtcttccgtcggggaggcggcccttgctcgcccccactgctcagtacccaagtcctcagcatccagccacagctctccattgtcagtctcactgcagcataaaggggactcatgtgaagaggcccctgtgtggagctggggaaaagaaggccaggctggcagatgggcggtggggccaacaactgtgctgaggggctgcactgagcggccactgctgtgactctgcctcgggccacagctgcctttcagaggggcttggaaccggatggagctcagctcctgtccctcagcaccactcctgaggcgcctggcctaggagtggtacttggaacagaaagttctgaaagaagaaacacagtgggctgggcgcagtagctcatgcctgtaatcccggcactttgggaggctgaggcgggtggatcacctgaggtcgggagttcgagaccagcctgagcaacattgagaaaccccgtctctactaaaaatacaaaattagccaggcgtggtggtgcatgcctgtagtcccagctactcaggaggatgaggcaggagaaccgcttgaacccgggaggtggaggttgcagtgagccaagatggcatcactgcactccagcctgggcgacaaagcaagactccgtcttgggggggcgggaaagatagtgatggtaatgttaaagtatcactgtgaggactgaaagggacaggaactcactggttgtccttccctgatgtcaccctgccaccaccttgggattagggctccccaccaccatttcctaagtgaggaaaggggttcagtaatttgcccaaaagtggagttgagattgaccccagacctaacaaacacacagccacacgctgcctcacatggattcctgaatacagggacccactcccacgagggagagccagcaggacatccagggacaaaacgacattccagcccaaccaaataacataagatcccttgcagtcgactaaggcagaattttgagctgaaaacaacaccaagcttgagtgtcagacattaccacttccagcttgcttttgggcacgcggcagatgcagttcgtcccgaagttggtgtcccgtgtctgaatgcaccgcaggcagcacaagttctcatatccttgctttttccattttgcaatcaggtttttgtctgcatagccttctttaatacaatattcatagagttctgtcaaaaagatggggaaagagcatcaggccatggtctaaaaaccttccccacccttgatcaaaaaaagcattcaggccgggtgcagtggctcacacctgtaatcccagcactttgggaggccgaggcaggcggatcacctgaggtcaggagttcaggaccagcccggccaacatggtaaaaccccgtctctactaaaaatacaaaaattactcgggcgtggtagcagctgtaatcccagctacttaggaggctgaggcaggagaatcacttgaacccaggaggcggaggttgtagtgacctgaggtcgtgccactggactccagcctgggtgacagcgaaactccatctcaaaaaaaaaaaggcattcagtattgcaacgggacagtccttggaggaggaacaaaaaaaaaaagtacttaggccaggcaaggtgcctcacacctgtaatcccagcacttttggaagccaacgccagaggatcatttgagttaagaaaccagcctgggccaagggcccatctccacaaaaaatttaaaaattagctgggtgtggtggtgcacacctgtagtcacagctactcaggaggttgaggtgagaggatcccttgagcccagaaggttgaggctgcagtgagccatcattgcaccactgcactccagcctgtggaacagagcaagaccctgtttc

SEQ ID NO: 5547 - DNA, 533 bp, Homo sapiens
gactggttcgccgcggggaccgggcagggctccccgtcggagtgcactgcgccggacacttcaagtgagttcctgtgtgatcctcgcaggagccccgggacccgggccaagacacgccagaggggaaggaagtgcccgagccgggattggagccgggggcgtctgaggagggaaactgaggctgcagaagccctggagggacaggaaagccagaaatggacttcgtgagactcgctcgactgttcgccagggcccgccccatgggactgttcatcctgcaacacctggacccctgtagagccaggtgggcaggaggcagggaggggctgatgcggccaatgtgggcgcccttcagcagctcctcctctcagctgcccctcggccaggagcgtcaggaaaacacgggcagcctgggctctgacccgagccactccaactccacggccacgcaggaagaagacgaggaggaggaggagagttttgggaccctctctgacaaatactcctcccggagactattccgcaaatccgca

SEQ ID NO: 5548 - DNA, 556 bp, Homo sapiens
aagacacgccagaggggaaggaagtgcccgagccgggattggagccgggggcgtctgaggagggaaactgaggctgcagaagtccgtgtggagaggggccctggagggacaggaaagccagaaatggacttcgtgagactcgctcgactgttcgccagggcccgccccatgggactgttcatcctgcaacacctggacccctgtagagccaggtgggcaggaggcagggaggggctgatgcggccaatgtgggcgcccttcagcagctcctcctctcagctgcccctcggccaggagcgtcaggaaaacacgggcagcctgggctctgacccgagccactccaactccacggccacgcaggaagaagacgaggaggaggaggagagttttgggaccctctctgacaaatactcctcccggagactattccgcaaatccgcagcccagttccataacctgcggtttggggaacggagagatgagcaaatggaaccggagcccaaattatggcgaggccggagaaacaccccgtactggtacttcttgcagtgcaaac

SEQ ID NO: 5549 - DNA, 571 bp, Homo sapiens
cagcggacaccaggactccaaaatggcgtcagttggtgagtgtccggccccaggccctggagggacaggaaagccagaaatggacttcgtgagactcgctcgactgttcgccagggcccgccccatgggactgttcatcctgcaacacctggacccctgtagagccaggtgggcaggaggcagggaggggctgatgcggccaatgtgggcgcccttcagcagctcctcctctcagctgcccctcggccaggagcgtcaggaaaacacgggcagcctgggctctgacccgagccactccaactccacggccacgcaggaagaagacgaggaggaggaggagagttttgggaccctctctgacaaatactcctcccggagactattccgcaaatccgcagcccagttccataacctgcggtttggggaacggagagatgagcaaatggaaccggagcccaaattatggcgaggccggagaaacaccccgtactggtacttcttgcagtgcaaacacctgatcaaggaagggaagctggttgaagccctggacctgtttgagaggcagatgctg

SEQ ID NO: 5550 - DNA, 544 bp, Homo sapiens
attccctacccagcagccctcgcgcggtccggcacagcggacaccaggactccaaaatggcgtcagttggccacgcagccagtgtttgcacacaactgtcttctcaccactgatgtggcgaaacggacacatgccccctgccggcaagatagggacagggtgtcagcagagaggccaccctgagcctgggggacacggcctgaagaagctgaggtaccttcacttcctaactcctggagccacctgaaggcatcacgtcctggaaaggggcagaggtccccctcacagaaggcaacatgatttgaggccctggagggacaggaaagccagaaatggacttcgtgagactcgctcgactgttcgccagggcccgccccatgggactgttcatcctgcaacacctggacccctgtagagccaggtgggcaggaggcagggaggggctgatgcggccaatgtgggcgcccttcagcagctcctcctctcagctgcccctcggccaggagcgtcaggaaaacacgggcagcctgggctctgacccgag

SEQ ID NO: 5551 - DNA, 2282 bp, Homo sapiens
aggaagagactggttcgccgcggggaccgggcagggctccccgtcggagtgcaccagctgcaggccaaaaacttcgagctcaacttgaaaacataccacgcgctgctgaagatggctgccaagtgcgcagaccttaggatgtgcctcgatgtgttcaaggaaatcatccacaaagggcacgtggtcacagaggagaccttcagtttcctgctcatgggctgcatccaagacaagaagacaggcttccggtacgccctccaggtgtggcggctgatgctgagtctagggctacagccgagccgggacagctacaacctgctgttggtggcagctcgggactgtggcctaggggacccccaggtggcctcagagctgcttctgaagcccagggaggaggcgactgtgcttcagcccccagtgagcaggcagcggccaaggaggacagcccaggccaaggcaggcaacctcatgtcagccatgctgcatgtggaggccctggagaggcagctgtttctggaaccttctcaggcacttgggcctccagagcctccggaagccagagtgcccggcaaggcccaaccagaggtggatactaaggcagagcccagccacacagcagccctcaccgcagtggccctgaagccacctcccgtggagctggaagtcaacctcctgacccccggggccgttccccctacagtggtctcctttggaacggtgaccaccccagctgaccggctggccttgatagggggcctggagggcttcctgagcaagatggcagagcacaggcagcagcccgacatcaggaccctcacgctactggccgaggtggtggagtccgggagtcctgcagagtccttgctgctggccctcctggatgagcaccaggtagaggccgacctgacattctttaacacgctggtgagaaagaagagcaagctgggagacctggagggggccaaggcgctgttgccggtcctggcaaagaggggcctcgtccccaacctgcagacattctgcaacctggccatcgggtgccacaggccgaaggacggtctacagcttctcacagacatgaagaagtcccaggtgacccccaacactcacatctacagtgccctcatcaacgcggccatcaggaagctgaactacacctatctcatcagcatcttgaaggacatgaagcagaacagggtcccggtgaacgaagtggtcatccgccagctggagtttgcagcccagtaccctcccacctttgaccggtaccaagggaagaacacctacctggagaagattgacggcttccgagcctattacaagcagtggctgacagtgatgcccgcagaggaaaccccgcacccctggcagaagttccggaccaagccccagggggaccaggacaccggcaaggaggctgatgacggatgtgcccttgggggcaggtgatgggagcacagctggaacaatgtgctcggcccccagtgctctgtgggagccccaggacaagtgagctggtgtcacctcctgcctgggggaagagccaggccctgaggaacagccgcagcgtgtcacaggtgttggtgaggacacacactaggcccaaggtgcctgtgctcccagcaggtccaagtgcagctccagccacctttgcgtgtcaccttcacgggacttccagctccagctacctttgtgtgtcacctcacacaccacaagggggctggggcatctggtccctggggcctgggccgccccgccgggttccataggccgatgctctgaaagaagagacgtggggctcgagagatttaaagattttatttttacaaatcacagctgatagacagcgaagccttccccatagagaccgtgctccaactcgggcctggggcactgctcgctgctcccaggaagggggtggcgtgacaggcaggaacctgcgaagtccagagtccagggtggagcgcgccagcctcagccagagcagccacgacagccacagtgtgtgcactcgatgatgcggccctgcaacggaggaggacagtgagacgatgccactgcgccacgctcgcccctgcacactcacatatgtggcaaccctcccacgaaggacctgccaccatgccatatagggacacacctcagaaacccttccttgacagctctggacagggaaaatttggctccctcatgaaggtagaaccagctgctgttgacaccgaggttacatctgtatgtctatttataatatgttctgcaaatccaacacacgtttgccaatc

SEQ ID NO: 5552 - DNA, 2491 bp, Homo sapiens
acagcggacaccaggactccaaaatggcgtcagttgtaccagtgaaggacaagaaacttctggaggtcaaactgggggagctgccaagctggatcttgatgcgggacttcagtcctagtggcattttcggagcgtttcaaagaggccctggagggacaggaaagccagaaatggacttcgtgagactcgctcgactgttcgccagggcccgccccatgggactgttcatcctgcaacacctggacccctgtagagccaggtgggcaggaggcagggaggggctgatgcggccaatgtgggcgcccttcagcagctcctcctctcagctgcccctcggccaggagcgtcaggaaaacacgggcagcctgggctctgacccgagccactccaactccacggccacgcaggaagaagacgaggaggaggaggagagttttgggaccctctctgacaaatactcctcccggagactattccgcaaatccgcagcccagttccataacctgcggtttggggaacggagagatgagcaaatggaaccggagcccaaattatggcgaggccggagaaacaccccgtactggtacttcttgcagtgcaaacacctgatcaaggaagggaagctggttgaagccctggacctgtttgagaggcagatgctgaaggaggagcgattgcagcccatggagagcaactacacggtgctgattgggggctgcgggcgggttggctacctgaagaaggccttcaacctctacaaccagatgaaaaagcgggacctggagccctcggacgccacctacacggccctgttcaacgtctgtgccgagtccccctggaaggactcagctctacagagcgccctgaagctccggcagcagctgcaggccaaaaacttcgagctcaacttgaaaacataccacgcgctgctgaagatggctgccaagtgcgcagaccttaggatgtgcctcgatgtgttcaaggaaatcatccacaaagggcacgtggtcacagaggagaccttcagtttcctgctcatgggctgcatccaagacaagaagacaggcttccggtacgccctccaggtgtggcggctgatgctgagtctagggctacagccgagccgggacagctacaacctgctgttggtggcagctcgggactgtggcctaggggacccccaggtggcctcagagctgcttctgaagcccagggaggaggcgactgtgcttcagcccccagtgagcaggcagcggccaaggaggacagcccaggccaaggcaggcaacctcatgtcagccatgctgcatgtggaggccctggagaggcagctgtttctggaaccttctcaggcacttgggcctccagagcctccggaagccagagtgcccggcaaggcccaaccagaggtggatactaaggcagagcccagccacacagcagccctcaccgcagtggccctgaagccacctcccgtggagctggaagtcaacctcctgacccccggggccgttccccctacagtggtctcctttggaacggtgaccaccccagctgaccggctggccttgatagggggcctggagggcttcctgagcaagatggcagagcacaggcagcagcccgacatcaggaccctcacgctactggccgaggtggtggagtccgggagtcctgcagagtccttgctgctggccctcctggatgagcaccaggtagaggccgacctgacattctttaacacgctggtgagaaagaagagcaagctgggagacctggagggggccaaggcgctgttgccggtcctggcaaagaggggcctcgtccccaacctgcagacattctgcaacctggccatcgggtgccacaggccgaaggacggtctacagcttctcacagacatgaagaagtcccaggtgacccccaacactcacatctacagtgccctcatcaacgcggccatcaggaagctgaactacacctatctcatcagcatcttgaaggacatgaagcagaacagggtcccggtgaacgaagtggtcatccgccagctggagtttgcagcccagtaccctcccacctttgaccggtaccaagggaagaacacctacctggagaagattgacggcttccgagcctattacaagcagtggctgacagtgatgcccgcagaggaaaccccgcacccctggcagaagttccggaccaagccccagggggaccaggacaccggcaaggaggctgatgacggatgtgcccttgggggcaggtgatgggagcacagctggaacaatgtgctcggcccccagtgctctgtgggagccccaggacaagtgagctggtgtcacctcctgcctgggggaagagccaggccctgaggaacagccgcagcgtgtcacaggtgttggtgaggacacacactaggcccaaggtgcctgtgctcccagcaggtccaagtgcagctccagccacctttgcgtgtcaccttcac

SEQ ID NO: 5553 - DNA, 4708 bp, Homo sapiens
gggtcctggaggcctctgggcgcgtgcgcgggcggtcgctacctgcggccgagccagggagcgagagggcgcagagggcagcgggcttgggcagcatgaggcccggaggggagcggcccgtggaagggggcgcgtgcaatggccgctccgagctggagctactgaagctgcgctcggcggagtgcatcgacgaggcggccgagcggctgggggccctgagccgcgcgatctggagccagcccgagctggcctacgaggagcaccatgcccaccgcgtgctgacgcacttcttcgagcgggagccgcccgcggcctcctgggcagtgcagccgcactaccagctgcccacggccttccgcgccgagtgggagccgccggaggcccgggcaccgagcgccacgccacgcccgctgcacctgggcttcctctgcgagtacgacgcgctgcccggcatcggccacgcctgcggccacaacctcatcgctgaggtcggggcggcggccgcgctgggcgtgaggggggccttagagggcctccccaggccgcctccgcccgtgaaggtagttgtcctgggaacccctgcagaagaagatggtggtggcaaaattgatttaattgaagcaggggcttttacaaatcttgatgttgtttttatggcccacccatcacaagagaatgctgcttatctaccagatatggctgaacatgatgtgactgtgaaatactatggaaaagcatctcattctgcttcttatccctgggaaggattaaatgcattagatgctgctgtgctggcctataacaatctgtctgtgttcagacagcaaatgaaaccaacctggagagttcatggtataataaaaaatggtggtgtaaaacccaatatcattccctcttattctgaattaatctattacttccgtgcaccctcaatgaaagaacttcaagttttgaccaaaaaggcagaagattgcttcagagctgcagctttggcttcagggtgcacagtggaaattaaaggtggagcacatgattattacaatgttcttcccaataagagcctatggaaagcctatatggaaaatggaagaaagctaggaatagagttcatttcagaagatacaatgttgaatggcccttcaggatctacggattttggaaatgttagttttgtggttcctggaattcatccatattttcacattggatctaatgccttgaatcatactgaacagtacactgaagctgctgggtcacaggaagctcagttctacactctgcggacggccaaagctctggcaatgacggcactggatgttatttttaaaccagagttactggaaggaatcagagaggactttaaactgaaacttcaagaagaacagtttgtaaatgcagtagaataaaagacttaggggccacttataaatcaagaagacgtgatgatttttttcttttaatctcttttaatgaaggcatgcttgttttttaatcttaaaggagtaaaattctttttacctgataagtgaggacagggtgtggagaaaacatattaattacctcatatctaaagtgaaaatttttgcaaatccgtacttgataggattatgatattacaggagctggtatgtgatgccattctttctttttttttaccccgcaaccactcaccttcacagtagtgataccatttcttaacctggaggatacatggcatcatttttataaaatatgttagtaaacctttttgtaagccttaaatgttatgtgtatttttaaaagcttaagagatttcaaaccttatattcagaattgacacccatgagagtgttttgtggtatagggtggtaaacttgttctctaatcgtatattaattcctctaccagattgtatatttgaagccagtgtctttcctttttttgttttaagatagagcctcgctctgttgcccaggctgaagtgtagtggcacaatctcggctcactgcaacctctgcctcccaggttcaagtgattctcctgcctcagcctaccaagtagctgggattacaggtgtgtggcaccatgcccagctaatttttgtatttttagtagagacggcatttcaccatgttggccaggctggtctcgaactcctgacctcaggtgatgcacctgcctcggcctcctaaagtgctgggattacaggcatgagccaccgcacccggcctgccagtgtctttttaatacacatgtgtgttggtatttttaaattgttacagtatctagcatattgcttactctgaatattcagtactttttgaataagcaaatattgcttccttgcttggaatcatcagagtttaaagtagcttcgtggatggaccatgatcctaagatgagttttaattttgtgtttacagtcatctcttgtacaacgtggagaagaaaagatatacttactactttgcttcaggtacacataagaaaacctcttttttaaaaaaatttttatttttttacataatagagacaggggctcgctgtagcttccaggctggcctcaaactcctgggctcaagcaatcctcctgtcttggcctcccaaagtgttgggatttcaggtatgagacaccacacctgcccatttttgtttggttttttaatgggcaggttcttgctctcccaggctggagtgcagtggtgtaatcacagctcactgcagtctcgaactcctggactcaagcagtcctcccacctcagcctcctaaagcactgggattacaggcttgaggcactgcacctggccctgaccattttttaaaaaggttaggcttagtgcaaagtttaaaattatatgattcttaaaatactgaattagtttctaaactaaactagaggtataggtggacctgcttgaggtatctttgtttttatggaacatttttattacatgcctttataatttttcattgttcacaccctgtactgaaacctttttctcaaataccaactcttggctatgttaaatttgtagactttaaaagatgttatctaaattaatggtttaaatatacaaattgaaaatattttctttttagtggcaattttaaaagcaggccttaatatgggacctgcttttaaagtaaaatatgtggtactatgaattactaaattgctatataccatgtaatagtgagtatagctaatatttagtatgccttttaaaaattttggactgcttttcggttttaacaaattctccacatgtgaactactcaagaaattttccctttttaattgcctctatagcactcataagagctagggcattaggataaactagaatattttatgtttatgaatacttgtataaacttaaaagtgttttgatttcccacaatttcccaaaggaatgtttatttattaagagttgtgttgataatttaactgttacaatttcagcagttgaattcagtgaacactggttgaggagtgcctatttctaagcactgggtgtaagaagaaaagacacttgcaaaggaagagctaagattaacataatttctttggtttttctattgcttgttattattatgtaaaaactgggtggcagttcacaaggaagattgttgtaacagaagagtgacaaccaatagttttttgatcattaaatcaaattttgtaaacagtggcaggagcgtggacttaaaacaaggcttgcttatttggttttgtcaaagttttacgaaaatatatgatatatatttatactaaaactatataatccttagatttaggaaagcaatcagttaatgtctttagcacactaaagcagtattaaacacaggtacaagttggaaattgtagaaaactgaaagaaaacaagacaaaatgtctatggtagggaataaaagagtttaagatattatgtaaaattatgtgtattttcttctcttttacataaattgtttgtgaaaagtgtgctcaacttttttacaagagtgatattaacttggatttatttttcaatataatttggagaccctttgttatccaaataaaattgatgagtttctgtgcctgtaaaaaaaaaaaaaaaaaaaagaaaagaaaagacactgttgcatgccccagaaagcttgtggtgggtggtaagttctcacgagatttatttatctgagcaacattgggactgagggaacatctgaaagctaccatcttgaaaatttttgaggaagtgtttctgaaatatttaaaaatacttaagtcagtcattttgaacaaaagaaattgatacaataagtttttttttttaaggatgattgtctaattttgtaatatgttgttttttaaaaacctgtctgatggtgttttatacatttctaactttttacctgagttatctctttagtcttttggaaaataccctacacaatactaacctttaaaactatcaaatttttgttataagataaatgttatctttgtactagatagcaaccctttataaggttgtaaggtataataaactgcttatttttttacatacttcatatcaagcattttgcagtccaattatatagttgaggatggtgtattttgatatgtatgaagttaatattttcaagtaagcaatcagtctactaccatcagattataagcttttttgtaataataggtacataaaatgtgtatgaaaaatctacaataaacatgtttatctgata

SEQ ID NO: 5554 - DNA, 4031 bp, Homo sapiens
cagcagttgaggttgaagatccgcagtcgcagggagaagttgggcttcatggttggggagctccaggggcgctaggcggctcgaactctccagcgacggccgcggtggggacgggggcggccggcggcgccttctccccagaccgttccttcttcgcaggcggcgcgcacaggtgggcaccaagcccgcgtggctcaggtcgggcccgactcccgcgttcccccggcaaccggccggctgttcccaatcaggcgggccgccaacccggaaaggcgatccgctgccgaaatccgggcgcccaggctcggtaagggccgcgcgctaggaccctgggggtccggagagcgcccccgggtgggcggctcccggttccttttcctccaagctcgtccccggcggtcgcggccgcccgcgcgccggcggcccagcaacaggcgcaaagttgaggaaaggcccagccgccacgggccgccctcgacccgcccctgggccccgcctcctgcgagcggcggaggcggggccgcgcggttgccggagcgacgcgcagtgtttggggtcaccgggcgtccccgggcgcggccatggcaaggccgcagccgtgcgggcccccgcacgctaggtgcggctcgccgtcgctgccggagcggccgctgcaggtgaaggtggtggggctcttcagctgccccaactttcagattgcgaagagcgccgctgaggaactcaaaaatgaaacctgggaatattcttcctctgtgatttcttttgttaatggtcagtttctgggtgatgcattggatctgcagaaatgggcccacgaggtgtgggatatagttgacattaaaccctctgcactttatgacgcactcactgaggatttttccgctaagttcttaagagacaccaagcatgatttcgtgtttttggacatttgtattgattcttctccaattggaagattgatttttgagctatactgtgatgtgtgtcccaaaacatgtaaaaattttcaggtcttgtgcacaggaaaagcagggttttctcaacgtggcataagactacattacaaaaattccatttttcatcgaatagtacagaatggctggatacaaggaggggatatagtgtatggaaaaggagataatggagagtcgatttatggtccaacatttgaagatgaaaacttttcagttcctcataataaaagaggagtacttggaatggccaacaaaggccgtcacagcaacgggtcacaattctatatcacactgcaagcaactccttatctagatagaaaatttgtggcttttgggcaactgattgaaggaacagaagtgcttaaacaactagaattagttccaacacagaatgaaagaccaatacatatgtgtagaattactgacagtggagatccttatgcttgattttcatatcaatattttctgtgataatttattactttgtatctgatcagctgtttgtggatttaattaaaaagtacttgataaattgtaatttgaaagccgtggcagacactgtaggttgcctcatctacacccaatccctccccatcttcctttcctgtctctgtcatagagactgtgaaagggtggtactcaatttcctagactcctttgcagccacgggtggccatgagagatggttctggccagtgggacaggaatagaacgccagtggtcctgccccttccccttcatccagtctggaatgtggagaggctggagctacagctgtcatcttgtggccataaagaaaaggctgaggccaggtgtggtagctcacgcctgtaatcccagcacttgggaggccgaggcaggtggatcacaagatcaagagattgagaccatcctggccaacatggtgaaaccctgtctctactaaaactacagaaattagctgggcatggtggcatgcacttgtagtcccagctacttgggaagctgaggcagaagaatctcttgaacccgggaggcggaggttgcagtgagccgagatgccgccactgcactccagcctggcgacagagagagactgtctcaaaaaaaaagaaaggccaagtactgcagagatgtcagccccagtctcttgagctgcgggaccaataccagcaaccacctactctggacttcttattataggagactaacagagccctgtgttgtgttgtttatgttactgttggttgagaattttgttacttgtggacaaaaaattcttaatttagcaacacacctgatagcctaagacatttgtaatagaattatgttcttgtttgtaactacatgtactcctaggagaaacttggtaagtaaccaaataggaatgatgcagaagaaaaagcaattcattgtaatatttcattgtttataccagcattcagaaagagtatctacactttggatgttttcatatatgacatgaacatcatccttatctctctgagccataccaaccctatgaaaaccaagggcttgttttacagtgtccgtggtggctgactcatgtgatgttattggagattcagctttatcactactctgtaatctaaagttctcaagctcatatcacctggggagcttttaaaatgtaacctaacagaccttgtccttgacctactgaggcagagttcccaggcgtggggcagagattctgtgttcatttggttctttccccagggttcccaggcgtggggcacagattctgtgttcatttagctctttccccagggttcccatttagacagctgggcactagtcatctgggaatcactgcaagacataaggaactggttccagtccccatggtgtaatgtagtcagcagagtgcttgactctgctattggtgaccttgctcagctcctgttaccaccactaccctgtgcccctgctctgcccagactaagagtgcttttctttttttttttttttttttttttttttttgagacggaatctcactctgtcgcccaggctggagtgcagtggcacaatctcggctcactgcaagctctgcctccctgattcatgccattctcctgcctcagcctcccgagtagctgggactacaggcgcctgccaccacgcctggctaattttttgtatttttagtagagatgggatttcaccatgttagccaggatggtcccgatcttgtgacctcgtgatccgcccgcctcggcctcccaaagtgctgagattacaaaggcgtgagccaccgcacccggctgagagtgcttttcttaccctaagcagaatgaggtttgtcttccaagaacaatctctatttacatcagtcttaaagaggcaggcttctaatggatatgaggcttgccaaaagtaggcgtaggcttttttaactttttattttgaaatatagattcacaggaagttgcaaaaatagtacagagcagtcctgtgtacctttcacccattttccccagtggctacgcttacaaaacggtagtacaatatcaaaccaggcagctgacattggtacaatgtgtgtgatgccattttatcatgagtatattcatgtaaccaacactatagagaaaatatagaacctttccagcacctcaaagacccccttccagtacccctttacagtcaacccactcccctgccctctgccatccctaactcctgacaactggcatttgcttttccttttaatgacagctttattgctatatgacatatgctttatgctaagacctgaggtggatgggaggaagcagaccgcctatgttacattctcaactgacccagagcaacatagtgttaagaatgtgtgttctagggccagaatcctggctctgccattccctagctgcacaaactcaggcaagaacttttctgtgcctcaattccttcatctgagaaacagtggtacctaccacataagattgctgtgagggttccatgaatcaataatttctataaagaacctataagagacctggtctgctgtaagcactcgataaatttaataataaattactaatgtgtaaccttc

SEQ ID NO: 5555 - DNA, 1615 bp, Homo sapiens
cagcagttgaggttgaagatccgcagtcgcagggagaagttgggcttcatggttggggagctccaggggcgctaggcggctcgaactctccagcgacggccgcggtggggacgggggcggccggcggcgccttctccccagaccgttccttcttcgcaggcggcgcgcacaggtgggcaccaagcccgcgtggctcaggtcgggcccgactcccgcgttcccccggcaaccggccggctgttcccaatcaggcgggccgccaacccggaaaggcgatccgctgccgaaatccgggcgcccaggctcggtaagggccgcgcgctaggaccctgggggtccggagagcgcccccgggtgggcggctcccggttccttttcctccaagctcgtccccggcggtcgcggccgcccgcgcgccggcggcccagcaacaggcgcaaagttgaggaaaggcccagccgccacgggccgccctcgacccgcccctgggccccgcctcctgcgagcggcggaggcggggccgcgcggttgccggagcgacgcgcagtgtttggggtcaccgggcgtccccgggcgcggccatggcaaggccgcagccgtgcgggcccccgcacgctaggtgcggctcgccgtcgctgccggagcggccgctgcaggtgaaggtggtggggctcttcagctgccccaactttcagattgcgaagagcgccgctgagaatctgaagaataatcatccatccaaatttgaagatcctatattagttcctcttcaagaatttgcatggcatcaatatctacaggagaaaaaaagggaactcaaaaatgaaacctgggaatattcttcctctgtgatttcttttgttaatggtcagtttctgggtgatgcattggatctgcagaaatgggcccacgaggtgtgggatatagttgacattaaaccctctgcactttatgacgcactcactgaggatttttccgctaagttcttaagagacaccaagcatgatttcgtgtttttggacatttgtattgattcttctccaattggaagattgatttttgagctatactgtgatgtgtgtcccaaaacatgtaaaaattttcaggtcttgtgcacaggaaaagcagggttttctcaacgtggcataagactacattacaaaaattccatttttcatcgaatagtacagaatggctggatacaaggaggggatatagtgtatggaaaaggagataatggagagtcgatttatggtccaacatttgaagatgaaaacttttcagttcctcataataaaagaggagtacttggaatggccaacaaaggccgtcacagcaacgggtcacaattctatatcacactgcaagcaactccttatctagatagaaaatttgtggcttttgggcaactgattgaaggaacagaagtgcttaaacaactagaattagttccaacacagaatgaaagaccaatacatatgtgtagaattactgacagtggagatccttatgcttgattttcatatcaatattttctgtgataatttattactttgtatctgatcagctgtttgtggatttaattaaaaagtacttgataaattgtaatttgaaa

SEQ ID NO: 5556 - DNA, 1693 bp, Homo sapiens
cagcagttgaggttgaagatccgcagtcgcagggagaagttgggcttcatggttggggagctccaggggcgctaggcggctcgaactctccagcgacggccgcggtggggacgggggcggccggcggcgccttctccccagaccgttccttcttcgcaggcggcgcgcacaggtgggcaccaagcccgcgtggctcaggtcgggcccgactcccgcgttcccccggcaaccggccggctgttcccaatcaggcgggccgccaacccggaaaggcgatccgctgccgaaatccgggcgcccaggctcggtaagggccgcgcgctaggaccctgggggtccggagagcgcccccgggtgggcggctcccggttccttttcctccaagctcgtccccggcggtcgcggccgcccgcgcgccggcggcccagcaacaggcgcaaagttgaggaaaggcccagccgccacgggccgccctcgacccgcccctgggccccgcctcctgcgagcggcggaggcggggccgcgcggttgccggagcgacgcgcagtgtttggggtcaccgggcgtccccgggcgcggccatggcaaggccgcagccgtgcgggcccccgcacgctaggtgcggctcgccgtcgctgccggagcggccgctgcaggtgaaggtggtggggctcttcagctgccccaactttcagattgcgaagagcgccgctgagaatctgaagaataatcatccatccaaatttgaagatcctatattagttcctcttcaagaatttgcatggcatcaatatctacaggagaaaaaaagggaactcaaaaatgaaacctgggaatattcttcctctgtgatttcttttgttaatggtcagtttctgggtgatgcattggatctgcagaaatgggcccacgaggtgtgggatatagttgacattaaaccctctgcactttatgacgcactcactgaggatttttccgctaagttcttaagagacaccaagcatgatttcgtgtttttggacatttgtattgattcttctccaattggaagattgatttttgagctatactgtgatgtgtgtcccaaaacatgtaaaaattttcaggtcttgtgcacaggaaaagcagggttttctcaacgtggcataagactacattacaaaaattccatttttcatcgaatagtacagaatggctggatacaaggaggggatatagtgtatggaaaaggagataatggagagtcgatttatggtccaacatttgaagagctttatggaagcttgaaaagaagtgtaaagaggcagaaggaaagcagaggggttggaaagatcgagaaataccgagatgaaaacttttcagttcctcataataaaagaggagtacttggaatggccaacaaaggccgtcacagcaacgggtcacaattctatatcacactgcaagcaactccttatctagatagaaaatttgtggcttttgggcaactgattgaaggaacagaagtgcttaaacaactagaattagttccaacacagaatgaaagaccaatacatatgtgtagaattactgacagtggagatccttatgcttgattttcatatcaatattttctgtgataatttattactttgtatctgatcagctgtttgtggatttaattaaaaagtacttgataaattgtaatttgaaa

SEQ ID NO: 5557 - DNA, 785 bp, Homo sapiens
actataaagacagtgaaaagatcagtggttatctttgcagacgccaccatcgctgtgagccctgtactatcagccatggtcaactccgtcgtcttttttgaaatcaccagggatggcaagcccttgggccgcatctccatcaaactgtttgcagacaagattccaaagacagcagaaaactttcgtgctctgagcactggagagaaaggatttcgttataagggttcctgctttcacagaattattccagggtttatgtgtcagggtggtgacttcacacgccctaatggcaccggtgacaagtccatctatggggagaaatttgatgatgagaacctcatccgaaagcatacaggttctggcatcttgtccatggcaaatgctggacccaacacaaatggttcccagtttttcatctgcgctgccaagactgagtggttggatggcaagcatgtggcgtttggcaaggtgaaagaacgtgtgaatattgtggaagccacggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatctttgtgctcttgctgcagttccctttgggttccatgttttccttgttcccttccatgcctagctggattgcagagttgagttaagtttatgattatgaaataaaaactaagtaacaa

SEQ ID NO: 5558 - DNA, 785 bp, Homo sapiens; identical to SEQ ID NO: 5557

SEQ ID NO: 5559 - DNA, 853 bp, Homo sapiens
ccaagatgcaccggggagtaggtccggcctttcgggtggtcaggaagatggcggcctctggggcggagccgcaggtcctggtacaatacttggtgttacgaaaggatctatcacaagctccgttctcctggccggcgggcgcactggtagcgcaggcttgtcacgcggccaccgcggccttgcacactcaccgcgaccacccgcacacagccgcttacctccaagagctggggcgcatgcgcaaagtggtcctcgaggccccagatgagaccaccctaaaggagctggccgagaccctgcaacagaagaacattgaccacatgctgtggcttgagcaaccagagaatatcgccacttgtattgctctccggccctaccccaaggaagaagtgggccagtatttgaagaagttccgattgttcaagtaactgctgctttgatgtgtttgaatacgcaggccacccattccaaagcatcatgtgttccttgcagtgtcagcttgctcccgtctttcagttgtgacaatttcttgagggttaagcacatgttcatattaaagttgtcattaataactacttcctcttattaataagttcaagtggggaaggtgggagagcagtattgtctggggatcattgctcaaatagaagatttggttagactctcctgtggggctcaaggaaactcccttccagtcactcgggtttgaaactttgcttttgaattccttcttattcacatccagttatcatatttcattgaatctaagataacatcaactttaagatgcggtagtattttatgtattgttaaaaaatatgccggcaaattaaacacttgtatttcaataaca

SEQ ID NO: 5560 - DNA, 2183 bp, Homo sapiens
gggaggccgcggcggggaaaatggcggacgggaaggcgggagacgagaagcctgaaaagtcgcagcgagctggagccgccggaggacctgaagaagaagcagaaaaacctgtgaaaactaagactgtttcttccagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtaagcctaaagaaactgttccaactcttgctccaaaaactctttcagtagcagcagcttttaatgaagatgaagatggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagtacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgttttttgtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactc

SEQ ID NO: 5561 - DNA, 719 bp, Homo sapiens
agcttcagcaatggagcgtgcaaaacaccagtgagcttctgtcttgctggagggtcggctttgggcggaactggctttgttgaccgggagaaacgagatgggggtgaagctggagatatttcggatgataatctacctcactttccctgtggctatgttctgggtttccaatcaggccgagtggtttgaggacgatgtcatacagcgcaagagggagctgtggccacctgagaagcttcaagagatagaggaattcaaagagaggttacggaagcggcgggaggagaagctccttcgcgacgcccagcagaactcctgaggcctccaagtgggagtcctagcccctcccctgatgaaatatacatatactcagttccttgttattcatttaagtgttttattcttttatcagtttttgggggccgagtgagacccaggatgcctcaggccctcagggggcttgtgtcgggggctgggggctgctgttccgacggaagccgagagcggtcgggtcctgaggggtgagcaggggttggggactgagggtcccagctcgtttctgtgctccgtcctgtggatgaagaggggtcagccagggggagggctcaagggcagtgccggccacaggtggcgaacaatggagagagggtgcaggtagccaccgtgtcccacctcattgtgagcactggtctatgtttaccctcaatatctgccattta

SEQ ID NO: 5562 - DNA, 4276 bp, Homo sapiens
acttccttttcagagctgtatccgggtcgctgctttccctattgtctgaggcagccgccctcgcgctgtgcaatttctggtctttcgttgcttctggtccaggctaataaagtttttctttctttaattttttttcttctagttttaacgggagaaattaactccccggggccgccgggttgactgcgctgcctgggccggaggtcttctccggccagggagcgctgtgggaaggggctcgagcggccagggccaggcgaggccgggggggcggggggttaggggaccgcggggctactcttgggagcgcccctgtccggctggctgcgcgccggttttaaatagcatctttcggacttgtcttcgcggccccagtccccgacctcggcgctgcctgggctcctgcagcctctccctaagtcttctccaaacgaccacctcacggattccttatggatcgcagctccaagaggaggcaggtgaagcctttggcagcttctctgctggaagctcttgattatgatagttcagatgacagtgattttaaagttggagatgcctcagattctgaagggagtggtaatggaagtgaagatgcttcaaaggacagtggagaaggttcctgtagtgattctgaagaaaatattttagaagaagaactgaatgaagatattaaagtaaaagaagaacaacttaaaaattctgcagaggaagaagtactatcatcagaaaaacaattaattaaaatggaaaagaaggaagaagaagaaaatggagaaagacctagaaagaaaaaggagaaagagaaggaaaaagaaaaggaaaaggagaaagagaaggaaagagagaaggaaaaagaaaaagcaacagtatctgagaatgtggctgcttctgctgctgccaccacaccagccacaagtcctcctgctgttaacacatccccttctgttcccactacgacaaccgctacagaggaacaagtcagcgagccaaaaaaatggaaccttcgacgaaaccgaccacttctggattttgtgtccatggaagagctgaatgacatggatgactatgacagtgaggatgacaatgattggcgacctactgtagtaaagagaaaagggagatctgcgtctcagaaagagggaagtgatggagacaatgaggatgatgaagatgagggaagcgggagtgatgaagacgagaatgatgaaggcaatgatgaagatcatagtagccctgccagtgaagggggttgcaagaagaagaagagtaaagttcttagcagaaacagtgctgatgatgaggaactgaccaatgatagcctgaccctatctcaaagcaagagtaatgaggactcgctgattcttgagaagagtcaaaactggagctctcaaaaaatggaccatattctgatttgctgtgtttgtctgggagataatagtgaggacgctgatgaaataattcagtgtgacaattgtggcattacagtccatgaaggttgttatggagttgatggagagagtgactctattatgagttcagcttctgaaaactccactgaaccttggttttgtgatgcctgtaaatgtggtgtttctcctagctgtgaactgtgtcctaatcaggatggaattttcaaggagacagatgctggaagatgggttcatattgtttgtgccctgtatgttcctggagtagcctttggagatattgacaaattacgaccagtaacactaacggaaatgaactattccaaatatggtgccaaggagtgtagcttttgtgaagaccctcgctttgctagaactggggtttgcattagctgtgatgcagggatgtgcagagcctatttccatgtgacctgtgctcaaaaggaaggtctgctttcagaggcagcggcggaagaggatatagcagatccattctttgcttattgtaagcaacatgcagataggttagacagaaagtggaagagaaaaaactacttggctctacagtcctattgtaaaatgtctttgcaagagagagagaagcaactatcaccagaagcacaggcaaggatcaatgcccggcttcagcagtatcgtgccaaagcagaactagctcgatctaccagaccccaggcctgggttccaagggaaaaattgcccagaccactcaccagcagtgcttcagctattcgtaaacttatgcggaaagcagaactcatggggatcagtacagatatctttccagtggacaattcagatactagttctagtgtggatggaaggagaaaacataagcaaccagctctcactgcagattttgtgaattattattttgagagaaatatgcgcatgattcaaattcaggaaaatatggctgaacaaaagaatataaaagataaattagagaatgaacaagaaaagcttcatgtagaatataataagctatgtgaatctttagaagaactacaaaacctgaatggaaaacttcgaagtgaaggacaaggaatatgggctttactaggcagaatcacagggcagaagttgaatataccggcaattttgcgagcacccaaggagagaaaaccaagtaaaaaagaaggaggcacacaaaagacatctactcttcctgcagtactttatagttgtgggatttgtaagaagaaccatgatcagcatcttcttttattgtgtgatacctgtaaactacattaccatcttggatgtctggatcctcctcttacaaggatgccaagaaagaccaaaaacagttattggcagtgctcggaatgtgaccaggcagggagcagtgacatggaagcagatatggccatggaaaccctaccagatggaaccaaacgatcaaggaggcagattaaggaaccagtgaaatttgttccacaggatgtgccaccagaacccaagaagattccgataagaaacacgagaaccagaggacgaaaacgaagcttcgttcctgaggaagaaaaacatgaggaaagagttcctagagagagaagacaaagacagtctgtgttgcaaaagaagcccaaggctgaagatttaagaactgaatgtgcaacttgcaagggaactggagacaatgaaaatcttgtcagatacccttcatgagacccaactctgccacagctcatcctcggaggcaatcccggaaacctcttttataagtgtgattttaaaaatgtggattaaactctcgatagagtacataaagtaaaggagaacagctatattgtcctttctataagcttgtcactgcaaaaagttgccttttgcttgtcaggtttggatagaatataattgattggtttgttacttggactaacaaggcagtagatttgcctgtgtggaattttttttcctatttttcttctttttgctttttttgcacttatcagaaatatttgatgtgtgcattgttgaaaaatactggatacatgtcttgtcagaattgtcgtattaagtaatgtctttccctcttgcttctttggcaaatgttgatacacagtgtttggacttactgaagagttactgaagcctgtgggacttaataaatacaatatgctactccctgttgtgattgaacaatacaaataacaaacaagaaagacaatgcattccattagtctgctattctgtttccttcaacttcatacatagattcatatatgaagtactgcattgtaaaacaactatagactcatattaaatgttatttctatttataatattcagcaaaagtgaaagacttgtgaagcatatgacattctatttttgacttattagtcctagtgtgaaagcattaatattattagcatgaaatttttacttcagattttaagctcatgaataaagatatatctgtgttgatctctagatatttttagtaatacccaaatatattcagtccttattgttttaatataagctttctgtgttcagtataattttatttttctcaaccttaaatatgaacttaggaaataaggagggaagtacaaagattattgactatacaacctaccagctgaaagaaagatcttcatcaacatctgtatctttccagaggtatacagaattaaaatttgatcttcaagctttaatgatccagttttaagtcaacggcagaagtatgttgaatatttcatcactcaatcttgaactgatttagaagagactctttgctgaaattgaattgcacttatacatgtaaattgtcaacatgtaatttggaattttctgattaataaatgtggttttggacatct

SEQ ID NO: 5563 - DNA, 2511 bp, Homo sapiens
acttccttttcagagctgtatccgggtcgctgctttccctattgtctgaggcagccgccctcgcgctgtgcaatttctggtctttcgttgcttctggtccaggctaataaagtttttctttctttaattttttttcttctagttttaacgggagaaattaactccccggggccgccgggttgactgcgctgcctgggccggaggtcttctccggccagggagcgctgtgggaaggggctcgagcggccagggccaggcgaggccgggggggcggggggttaggggaccgcggggctactcttgggagcgcccctgtccggctggctgcgcgccggttttaaatagcatctttcggacttgtcttcgcggccccagtccccgacctcggcgctgcctgggctcctgcagcctctccctaagtcttctccaaacgaccacctcacggattccttatggatcgcagctccaagaggaggcaggtgaagcctttggcagcttctctgctggaagctcttgattatgatagttcagatgacagtgattttaaagttggagatgcctcaggactcgctgattcttgagaagagtcaaaactggagctctcaaaaaatggaccatattctgatttgctgtgtttgtctgggagataatagtgaggacgctgatgaaataattcagtgtgacaattgtggcattacagtccatgaaggttgttatggagttgatggagagagtgactctattatgagttcagcttctgaaaactccactgaaccttggttttgtgatgcctgtaaatgtggtgtttctcctagctgtgaactgtgtcctaatcaggatggaattttcaaggagacagatgctggaagatgggttcatattgtttgtgccctgtatgttcctggagtagcctttggagatattgacaaattacgaccagtaacactaacggaaatgaactattccaaatatggtgccaaggagtgtagcttttgtgaagaccctcgctttgctagaactggggtttgcattagctgtgatgcagggatgtgcagagcctatttccatgtgacctgtgctcaaaaggaaggtctgctttcagaggcagcggcggaagaggatatagcagatccattctttgcttattgtaagcaacatgcagataggttagacagaaagtggaagagaaaaaactacttggctctacagtcctattgtaaaatgtctttgcaagagagagagaagcaactatcaccagaagcacaggcaaggatcaatgcccggcttcagcagtatcgtgccaaagcagaactagctcgatctaccagaccccaggcctgggttccaagggaaaaattgcccagaccactcaccagcagtgcttcagctattcgtaaacttatgcggaaagcagaactcatggggatcagtacagatatctttccagtggacaattcagatactagttctagtgtggatggaaggagaaaacataagcaaccagctctcactgcagattttgtgaattattattttgagagaaatatgcgcatgattcaaattcaggaaaatatggctgaacaaaagaatataaaagataaattagagaatgaacaagaaaagcttcatgtagaatataataagctatgtgaatctttagaagaactacaaaacctgaatggaaaacttcgaagtgaaggacaaggaatatgggctttactaggcagaatcacagggcagaagttgaatataccggcaattttgcgagcacccaaggagagaaaaccaagtaaaaaagaaggaggcacacaaaagacatctactcttcctgcagtactttatagttgtgggatttgtaagaagaaccatgatcagcatcttcttttattgtgtgatacctgtaaactacattaccatcttggatgtctggatcctcctcttacaaggatgccaagaaagaccaaaaacagttattggcagtgctcggaatgtgaccaggcagggagcagtgacatggaagcagatatggccatggaaaccctaccagatggaaccaaacgatcaaggaggcagattaaggaaccagtgaaatttgttccacaggatgtgccaccagaacccaagaagattccgataagaaacacgagaaccagaggacgaaaacgaagcttcgttcctgaggaagaaaaacatgaggaaagagttcctagagagagaagacaaagacagtctgtgttgcaaaagaagcccaaggctgaagatttaagaactgaatgtgcaacttgcaagggaactggagacaatgaaaatcttgtcaggtgtgatgaatgcagactctgctaccattttggctgtttggatcctcctttgaaaaagtctcctaaacagacaggctacggatggatatgtcaggaatgtgattcttcatcttccaaggaagatgaaaatgaagctgaaagaaaaaatatatctcaggagctcaacatggaacagaaaaatccaaagaaataa

SEQ ID NO: 5564 - DNA, 3734 bp, Homo sapiens
gagaggaggccgagtcggtagtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtcc

SEQ ID NO: 5565 - DNA, 2226 bp, Homo sapiens
cggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcggtagtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggtgaaatcccagcatccactaagctggtgttgtcctatcgacccagctggatcgtgtaaccagtctatgggaagtgaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtatcaggagttgggatttctcagcactgctaatgaagatcccctcttatagtccaataagcttatcaggacttccagagtcatgacatgaacagtttaattgaacccatccactctgggcaggtgactggaatagctgattaaaacataaatgctgcttttaggttaaccacaaaggaacaactcaggatcagtcgtgattgctaaagtattcacttttatcttttaggtaagagaaaagaaaaagataaggaaagaagagagaagagagacaaagatcactacagaccaaaacagaagaagaaga

SEQ ID NO: 5566 - DNA, 1776 bp, Homo sapiens
gagaggaggccgagtcggtagtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggtgaaatcccagcatccactaagctggtgttgtcctatcgacccagctggatcgtgtaaccagtctatgggaagtgaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtatcaggagttgggatttctcagcactgctaatgaagatcccctcttatagtccaataagcttatcaggacttccagagtcatga

SEQ ID NO: 5567 - DNA, 2311 bp, Homo sapiens
gcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggtatgaaatggtagcatttgatttttttcaaggttcccactggaatgatcacggagctctagtatctacgtaattgaaattccccttttgatcagatatgggaataggaagctaattaattgatgatatatttttaactctgccttctccaaggtatacagataactacagacttcattagtgtttgatttcatagactggcattaaagcctttgtctccaaaatttgaaggcctggagacaggcatcccagggtataagcttccagctggatcacctttaactagcttacaaaaagacccttacacaaatactttccatttgtgagttaaaacagggttttttgacatcgaataaagcttcttttgtaagaagtttcttttatattgtaacaattggtgttgttagactgactatgtgttttatgaattgatcaatgagccatacatttttgctaggatgtatattttaataactacaaaaaaagagagtttaaaaaactattaagggtctgtctttaaaccacctaatagaggaatttaaaagtgaaggttgcagttgctagattttgccttggctaccttcagattcccacaatacttgtacataatgaactgtgcatgcttttacattctctaagggcttaacttcttaggcactgtaagactataagaacgcagtaatagccataactggatttccttggttctcctgttttaaaatctgagccttaatgtagttttaatatatcctttttgtattacttttctttattagtagcctaataaagaagactttgagtatcttttgctctcctctagatgcgttttaaaaactattccaaatttaattgatattgtattgagtttttcagggttattttaggcctgatttgataacaatgcgttgttttggtgcctccattaatgttgtattaaatcaatgggtcttttaaattgattaatatgtcattgaatcataccttctgattttctgtgatcatccaacggttaagtctttgccgttattgtcaatatatcaaccaaattttaaataactttttttactgtgtattactatattcaacgtcccagatataacaatattttgtattttcaccactgtttatggtattctcagaatgcgataaatcagggacttgggtaataaaatgtttctggaaaattca

SEQ ID NO: 5568 - DNA, 6237 bp, Homo sapiens
cgtcagggctggccggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcggtagtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggtgaaatcccagcatccactaagctggtgttgtcctatcgacccagctggatcgtgtaaccagtctatgggaagtgaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcacactcaaaacttttagctttgatcacaagtggacaaatttctgaaaccaaaggcaactaagttgctgtgttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacatatcctaaaatttcagcttgcctttttgcggccttatattttgatgtaaagattaaaagaatgtgcaaaacagtcagaaatttttattgccttttgagattctccaacttgacaaatgtgccaaagatcaacagacagaaaatatcatcctgtgtatttacttgtcatactttaactttgtgaaagatcttactgataaatgaaaagctttagcagaggtggtattgtggggtaattgcttaaatttacatatcaaagtaaaaaagtagtgcctgtattccatgtgtggagtaaatttgctaatgtctatattttatgattgatactattatttttcctttgcattttaaaatagtggctctaatattttccctgtcatggctacattctagacattgaatttatatcttctttttttcagatacggagcaaatagcatccttaacctatgaataatggtgttgcctagattcttgtcacacacacagaagaccctttgtacctagtaacattcatcctcttgattcctggtgaacacggttaaattcatgcacatttgttcttgtagtttctaaaaattagatcaatttatttgttagccagcaaattgaaaattccattattagattaatgaaatttttgctctgcttatatgtatacgaactggaaatctgaatttttaaatttagatctttaaatcaaattatttttatgcatattttcatttaatatagagtataccaatcgattgaagcctttcacaagtagtgcgctgagcttttcttattgaagagagtgaattagtttctgagaagtcagtctattgtgaaaagtttcagatgagattattttcttttagtctttttaaatatcactatatgtatttaaatagaagcaataaactagagagagtgtttcttgaaaagacaatgttttatttgccaccaggcagaacagaatgagcattggtagagaaggctccctcttggtatgttactgataaacttgtacttcctcatacttgtttgtggttctactgacttatttccaaacttaagagtaatgtacttcgaaaacaacttggttattctttaaatttcaggtaaaaccccttttcctaacactcatcttatttccactgtcttatttcctctcagatgttcatatttcacatgttcaaaatgaagcgtactatttcccctccaataaacgaagtctcctgccaa

SEQ ID NO: 5569 - DNA, 3671 bp, Homo sapiens
tccctttcggccgtgggggagggggctcgtgtcccccccaacccagcccggaggccgcgtccgcccgcgcccgctctggcccccgcggagccgcgcaacttcccgggagcccgggccaaagtgagcgcaaagtgctgcccaagttgccgggatggagctgcagagccggcccgaggcgctcgccgtggaactcgcgcgccaccagaacggcgacctcaagaagcagctccacgaaaggcagccgcggatcgccgcgctcagcgacaaacaagctttgggaacgatcactgcagtgcctgtcacgggtcctcaggtcagctccttgcagaggttggccgggcaaggagcggcagtgctacctcaggttaggccaaagactctgattccagacagcctccccgttgccccgggccgggaccggccacccaagcagcccccaacattccagaaggccaccgtggtcagcgtcaagaaccccagcccagccctccccaccgccaacaacactgtcagccatgtgccagcgcccggcagccagccccaggccctcgccgagcccgccgccctcgcctctccgctgagcagtgcgggggtggcctacgccatcatctccacctcccccagcaatgccgccgccatggcccccagcaccgccgtgtctgtggtcagtgacagcatcaaagtccagcccctcctcatcagtgctgacaacaagcctcctccacgcctcctctcttcccctcaccccgcaacccatcactgtcccctccacccctcctctcttcccctcacccctccctccccatcactgtccccttcacccctccatggcatcttccaggtcatcatcattcagcctcaagtgcagacgcagcccgagagcacggcagagtcgcggccgcccacagaggagccatctcagggagctcaggccaccaaaaagaagaaggaagaccggcccccgacccaggagaaccccgagaaaatcgccttcatggtagcgctaggcctggttaccacggaacatttggaagaaatccagagcaagcgacaggagcggaagagaagaagcacagccaaccctgcctacagcggcctcctggagaccgagaggaaacggctggcctccaactatctcaacaaccccctgttcctcacagcgagagccaatgaggacccctgctggaagaacgagatcacccacgatgagcactgtgccgcctgcaagcgaggggccaacctgcagccctgcggcacctgcccgggggcctaccacctcagctgcctggagccgcccctcaagacggcgcccaagggcgtgtgggtgtgccccaggtgccagcagaaggccttaaagaaagacgagggtgtgccctggactgggatgctggccatcgtgcactcttatgtcacccacaagacagtcaaagaagaggagaagcagaagctgctgcaacgaggcagtgagctgcagaacgagcaccagcagctggaggagcgggaccggcggctggcgtcagcagtgcagaaatgcctggagttgaagacaagcctgctggcccgccagaggggcacccagtcatccctggaccgcctgcgggccctcctgagactgatacagggcgagcagctgctccaggtcaccatgacgaccactagccctgccccactgctggccgggccctggaccaagccctcagtggcagccacacaccccaccgtccagcacccccagggccacaactgaccccgagggaccagtcttcatacccacggaaagttattgggaccctgcttacacagcctgggggttctgtcggccttaattcataaacactatgaatttcagacaaaaattaaccagacagaggagaggagggaggaagagctgggcgagaggcctagagccaggaccaggtgggggtgcggccctgtgccctccaaattcacagggggtacctaggagccaggtggggtacgacaggctggggcacacagtctccccccggccacctcggggctgcctgggcctctggcttccaggccctgctctccacggcctccctctggcccgttggaggggcaggctgaggctgtggaggggacaagcacgccccccagaacgcagtctccactgagggcaccgcctattggtgtcctgtgggagggcgagctgagaacacatggactagctgagtggtagcggtagttgggacgagaagcggggtagtggatctaggtagttcctcaatgccccacgctcctaggaggtccccctggggtgggcgggcgggcctggggcactccgtcgcctttgcagaaccacctgggcccctttctgtcagtattattagggttacgaattgcagctgtttaacttgaaagacactgtcggaggtgagcatctgggcgccgggacgctgcagtgatccccgccagagcctgtgcccttcctgctccgtctttggggtcctcaaggctgcctccttccttttgccaatctcttggactcagtttgccgttgatgcgtttttctcatggagtttctgggcagagtggagctgcaaccctgttgtggggggcagcatttggcaggttttctccttggggttgaatcattcaacttaacgactgaagccctttcttgtctcctttggaagagccgataagtattccactcctcccttcttgccagtgcagacactatgccaaaaaataacttcacacttttgtatggcgtttttattgtgagatatttaatgtgaatggttggggggactctggctgacttcctttctgcttctagtagtctctgcttcaaggtacaaatgggaacacctcccctcgggaagcctggccaagctggaagatccggcaggttttttacgagccgggtggagggttggggaggaaagaaagggcggtggctcgggaggttccggccttcggggaccagacttgctgccaagggcttctgcatccagggtgggcagtggcagcttgtcacccttgcccgattcccacatcccagtcctgagggactcagcacaacaggataagcgtccaggagccacgggctcccaccccgagcatatcacatggtgccgaattgcactgaacacgcgtgtgtgcatcgcacgcggccacgaccacagacacgcatgcacacacgcagaggtgcagagcgaggaggccggcaaatcccgcagctgccacggtccctcctgtcattctcacgactccgggagaaactgtgctgtatgatacagatctattttaatacacttaccactgggtgaacaagatttttatattcttttattgatgaacaaagtgaaccgtgtgaggcacacgtcttctatattggctactctgtgccaagtatgcattaccgcgtggcttgcgatgtccatgtcttcagcttccttttctgttggtttggttttcttcgcggatggattgagttacatgttttaacagtgtaatgggaggatctgaaaggttggacccgggaggggtagctgccgatgtgtcttgagattgttaggttttttttggaccaaggaggaccgtccagtgggtagtgaggatagagaaaaagtgtttgtcttaaatacgccaatgtagttttccttctttacaatgtattaaactcgatcgatgatttcaaa

SEQ ID NO: 5570 - DNA, 3460 bp, Homo sapiens
ccgcggagccgcgcaacttcccgggagcccgggccaaagtgagcgcaaagtgctgcccaagttgccgggatggagctgcagagccggcccgaggcgctcgccgtggaactcgcgcgccaccagaacggcgacctcaagaagcagctccacgaaaggcagccgcggatcgccgcgctcagcgacaaacaagctttgggaacgatcactgcagtgcctgtcacgggtcctcaggtcagctccttgcagaggttggccgggcaaggagcggcagtgctacctcaggttaggccaaagactctgattccagacagcctccccgttgccccgggccgggaccggccacccaagcagcccccaacattccagaaggccaccgtggtcagcgtcaagaaccccagcccagccctccccaccgccaacaacactgtcagccatgtgccagcgcccggcagccagccccaggccctcgccgagcccgccgccctcgcctctccgctgagcagtgcgggggtggcctacgccatcatctccacctcccccagcaatgccgccgccatggcccccagcaccgccgtgtctgtggtcagtgacagcatcaaagtccagcccctcctcatcagtgctgacaacaaggtcatcatcattcagcctcaagtgcagacgcagcccgagagcacggcagagtcgcggccgcccacagaggagccatctcagggagctcaggccaccaaaaagaagaaggaagaccggcccccgacccaggagaaccccgagaaaatcgccttcatggtagcgctaggcctggttaccacggaacatttggaagaaatccagagcaagcgacaggagcggaagagaagaagcacagccaaccctgcctacagcggcctcctggagaccgagaggaaacggctggcctccaactatctcaacaaccccctgttcctcacagcgagagccaatgaggacccctgctggaagaacgagatcacccacgatgagcactgtgccgcctgcaagcgaggggccaacctgcagccctgcggcacctgcccgggggcctaccacctcagctgcctggagccgcccctcaagacggcgcccaagggcgtgtgggtgtgccccaggtgccagcagaaggccttaaagaaagacgagggtgtgccctggactgggatgctggccatcgtgcactcttatgtcacccacaagacagtcaaagaagaggagaagcagaagctgctgcaacgaggcagtgagctgcagaacgagcaccagcagctggaggagcgggaccggcggctggcgtcagcagtgcagaaatgcctggagttgaagacaagcctgctggcccgccagaggggcacccagtcatccctggaccgcctgcgggccctcctgagactgatacagggcgagcagctgctccaggtcaccatgacgaccactagccctgccccactgctggccgggccctggaccaagccctcagtggcagccacacaccccaccgtccagcacccccagggccacaactgaccccgagggaccagtcttcatacccacggaaagttattgggaccctgcttacacagcctgggggttctgtcggccttaattcataaacactatgaatttcagacaaaaattaaccagacagaggagaggagggaggaagagctgggcgagaggcctagagccaggaccaggtgggggtgcggccctgtgccctccaaattcacagggggtacctaggagccaggtggggtacgacaggctggggcacacagtctccccccggccacctcggggctgcctgggcctctggcttccaggccctgctctccacggcctccctctggcccgttggaggggcaggctgaggctgtggaggggacaagcacgccccccagaacgcagtctccactgagggcaccgcctattggtgtcctgtgggagggcgagctgagaacacatggactagctgagtggtagcggtagttgggacgagaagcggggtagtggatctaggtagttcctcaatgccccacgctcctaggaggtccccctggggtgggcgggcgggcctggggcactccgtcgcctttgcagaaccacctgggcccctttctgtcagtattattagggttacgaattgcagctgtttaacttgaaagacactgtcggaggtgagcatctgggcgccgggacgctgcagtgatccccgccagagcctgtgcccttcctgctccgtctttggggtcctcaaggctgcctccttccttttgccaatctcttggactcagtttgccgttgatgcgtttttctcatggagtttctgggcagagtggagctgcaaccctgttgtggggggcagcatttggcaggttttctccttggggttgaatcattcaacttaacgactgaagccctttcttgtctcctttggaagagccgataagtattccactcctcccttcttgccagtgcagacactatgccaaaaaataacttcacacttttgtatggcgtttttattgtgagatatttaatgtgaatggttggggggactctggctgacttcctttctgcttctagtagtctctgcttcaaggtacaaatgggaacacctcccctcgggaagcctggccaagctggaagatccggcaggttttttacgagccgggtggagggttggggaggaaagaaagggcggtggctcgggaggttccggccttcggggaccagacttgctgccaagggcttctgcatccagggtgggcagtggcagcttgtcacccttgcccgattcccacatcccagtcctgagggactcagcacaacaggataagcgtccaggagccacgggctcccaccccgagcatatcacatggtgccgaattgcactgaacacgcgtgtgtgcatcgcacgcggccacgaccacagacacgcatgcacacacgcagaggtgcagagcgaggaggccggcaaatcccgcagctgccacggtccctcctgtcattctcacgactccgggagaaactgtgctgtatgatacagatctattttaatacacttaccactgggtgaacaagatttttatattcttttattgatgaacaaagtgaaccgtgtgaggcacacgtcttctatattggctactctgtgccaagtatgcattaccgcgtggcttgcgatgtccatgtcttcagcttccttttctgttggtttggttttcttcgcggatggattgagttacatgttttaacagtgtaatgggaggatctgaaaggttggacccgggaggggtagctgccgatgtgtcttgagattgttaggttttttttggaccaaggaggaccgtccagtgggtagtgaggatagagaaaaagtgtttgtcttaaatacgccaatgtagttttccttctttacaatgtattaaactcgatcgatgatttc

SEQ ID NO: 5571 - DNA, 1814 bp, Homo sapiens
agctttgctcgacacggactcgccgtgtttacttggctctttgttcctcccccctcccccggcacacactcacactcacactcactcgcacacgcaccccggcctgcaaacttgcacggctcggggcgcgccgccgggtggcctcggcccccgccccgccccgcgagctgccccgatgaggcggcagccacagaacggcgacctcaagaagcagctccacgaaaggcagccgcggatcgccgcgctcagcgacaaacaagctttgggaacgatcactgcagtgcctgtcacgggtcctcaggtcagctccttgcagaggttggccgggcaaggagcggcagtgctacctcaggttaggccaaagactctgattccagacagcctccccgttgccccgggccgggaccggccacccaagcagcccccaacattccagaaggccaccgtggtcagcgtcaagaaccccagcccagccctccccaccgccaacaacactgtcagccatgtgccagcgcccggcagccagccccaggccctcgccgagcccgccgccctcgcctctccgctgagcagtgcgggggtggcctacgccatcatctccacctcccccagcaatgccgccgccatggcccccagcaccgccgtgtctgtggtcagtgacagcatcaaagtccagcccctcctcatcagtgctgacaacaaggtcatcatcattcagcctcaagtgcagacgcagcccgagagcacggcagagtcgcggccgcccacagaggagccatctcagggagctcaggccaccaaaaagaagaaggaagaccggcccccgacccaggagaaccccgagaaaatcgccttcatggtagcgctaggcctggttaccacggaacatttggaagaaatccagagcaagcgacaggagcggaagagaagaagcacagccaaccctgcctacagcggcctcctggagaccgagaggaaacggctggcctccaactatctcaacaaccccctgttcctcacagcgagagccaatgaggacccctgctggaagaacgagatcacccacgatgagcactgtgccgcctgcaagcgaggggccaacctgcagccctgcggcacctgcccgggggcctaccacctcagctgcctggagccgcccctcaagacggcgcccaagggcgtgtgggtgtgccccaggtgccagcagaaggccttaaagaaagacgagggtgtgccctggactgggatgctggccatcgtgcactcttatgtcacccacaagacagtcaaagaagaggagaagcagaagctgctgcaacgaggcagtgagctgcagaacgagcaccagcagctggaggagcgggaccggcggctggcgtcagcagtgcagaaatgcctggagttgaagacaagcctgctggcccgccagaggggcacccagtcatccctggaccgcctgcgggccctcctgagactgatacagggcgagcagctgctccaggtcaccatgacgaccactagccctgccccactgctggccgggccctggaccaagccctcagtggcagccacacaccccaccgtccagcacccccagggccacaactgaccccgagggaccagtcttcatacccacggaaagttattgggaccctgcttacacagcctgggggttctgtcggccttaattcataaacactatgaatttcagacaaaaattaaccagacagaggagaggagggaggaagagctgggcgagaggcctagagccaggaccaggtgggggtgcggccctgtgccctccaaattcacag

SEQ ID NO: 5572 - DNA, 1069 bp, Homo sapiens
tctttgttcctcccccctcccccggcacacactcacactcacactcactcgcacacgcaccccggcctgcaaacttgcacggctcggggcgcgccgccgggtggcctcggcccccgccccgccccgcgagctgccccgatgaggcggcagccacagaacggcgacctcaagaagcagctccacgaaaggcagccgcggatcgccgcgctcagcgacaaacaagctttgggaacgatcactgcagtgcctgtcacgggtcctcaggtcagctccttgcagaggttggccgggcaaggagcggcagtgctacctcaggttaggccaaagactctgattccagacagcctccccgttgccccgggccgggaccggccacccaagcagcccccaacattccagaaggccaccgtggtcagcgtcaagaaccccagcccagccctccccaccgccaacaacactgtcagccatgtgccagcgcccggcagccagccccaggccctcgccgagcccgccgccctcgcctctccgctgagcagtgcgggggtggcctacgccatcatctccacctcccccagcaatgccgccgccatggcccccagcaccgccgtgtctgtggtcagtgacagcatcaaagtccagcccctcctcatcagtgctgacaacaaggtcatcatcattcagcctcaagtgcagacgcagcccgagagcacggcagagtcgcggccgcccacagaggagccatctcagggagctcaggccaccaaaaagaagaaggaagaccggcccccgacccaggagaaccccgagaaaatcgccttcatggtagcgctaggcctggttaccacggaacatttggaagaaatccagagcaagcgacaggagcggaagagaagaagcacagccaaccctgcctacagcggcctcctggagaccgagaggaaacggctggcctccaactatctcaacaaccccctgttcctcacagcgagagaacgagatcacccacgatgagcactgtgccgcctgcaagcgaggggccaacctgcagccctgcggcacctgcccgggg

SEQ ID NO: 5573 - DNA, 1740 bp, Homo sapiens
atggattatcccaaaatggattattttctggatgtagagtctgctcacagactcttggatgttgagtcagctcaaagattcttctacagtcaaggagctcaagctcgccgggcgaccctgctcctgcctcccacattaatggcggcatcctcggaggatgatatagaccggcggcccatccggagagtgcgctccaagagcgacacgccgtacctcgcagaggccaggatctcctttaacctgggggcagctgaggaagtggagaggctggcggcgatgcgttctgactccctcgtcccaggcacccacaccccacccatccgcaggagaagtaagtttgccaacctgggaaggattttcaagccttggaaatggaggaagaagaaaagcgaaaagttcaaacacacgtcagcagccctggaaaggaaaatatctatgaggcaaagcagagaagagctgataaagcgaggagtcctgaaggaaatctatgataaagatggggaactctctatatccaatgaagaggactccctagaaaatgggcagtccctgagctccagccagctgtctctgcctgccctgtccgaaatggagccagtcccaatgcccagggatccctgctcatatgaggtgctccaaccgtcagacatcatggatgggccagatcctggcgcccctgtgaaattgccttgtctgccagtgaaactgtcgcctccgctacctccaaagaaagtcatgatctgtatgcccgtgggggggccagacctctcactggtgtcctacacagcccagaagagtggccagcagggtgtggcccagcaccaccacactgtcctgccctcccagatccagcaccagctgcagtacggcagccacggccagcacctcccctccaccaccggctccctccccatgcacccctcgggctgcagaatgatagacgagctcaacaaaacgctggccatgaccatgcagaggctggaaagctctgagcagcgggtcccctgttccacttcttaccacagctctgggttgcactcgggtgatggggtcaccaaagcaggacctatgggccttccagaaataagacaagtgccaactgttgtgattgaatgtgatgacaataaagaaaatgtgcctcatgagtcagactacgaagactcttcttgcctgtatacaagagaagaggaggaagaggaggaggacgaagacgacgacagctcattatacaccagctccctggccatgaaggtctgcaggaaggactccttagccatcaaactcagcaacaggccctccaagcgagagctggaagaaaagaacatccttcccaggcagacggatgaggagcggctggagctgaggcaacagattggcaccaagctcaccaggcggctgagccagaggccaactgcagaggaactggaacagaggaacattttgaaacctcggaatgaacaagaggaacaggaggagaagagagagatcaagaggaggctaacccgaaagctcagtcaaaggcccacggtggaagagcttcgggaaagaaagatcctcatccgcttcagtgactacgtggaggtggctgacgctcaggactatgaccgcagggcagataagccgtggacccgcctcaccgctgcagacaaagctgccatccgaaaggagctcaatgaattcaaaagcactgagatggaagttcatgaattgagtagacacttaacaagctttcgatttcct

SEQ ID NO: 5574 - DNA, 707 bp, Homo sapiens
ctccagccactgactgtctcatgtatctgcaagggccgaggaaattaatgacccaaggaggctatgatatggtccaaaaacttttcctggattttttccgtaggcggctgagccagaggccaactgcagaggaactggaacagaggaacattttgaaacctcggaatgaacaagaggaacaggaggagaagagagagatcaagaggaggctaacccgaaagctcagtcaaaggcccacggtggaagagcttcgggaaagaaagatcctcatccgcttcagtgactacgtggaggtggctgacgctcaggactatgaccgcagggcagataagccgtggacccgcctcaccgctgcagacaaagtaagcagaggggagtgctggagagtgggaggcaggaccgtctgctgggtctcgctgggctcaccgctggggagcgtgtagggagacctgcagccaggcctcagccgcagtccccataatggagtgttgagaccccaacacctttccccaggggccacagataatctgcggaaaggctgctgaatcggagaaaacacaaggcacataatactgtgcccattttacaggaggaggagcagcagcctgggaggctgtgcccagagaaagagaatagcactggataggtgtagacaggtgaaggcaagaggctccaggctcatcacagcccttccgtataggggatgg

SEQ ID NO: 5575 - DNA, 943 bp, Homo sapiens
gtgcctctcctgggcttgaaattgaggaactgaggaggcggtggtggcgagagtcagtctttcagagcacaggatggaacaagaactccagccactgactgtctcatgtatctgcaagggccgaggaaattaatgacccaaggaggctatgatatggtccaaaaacttttcctggattttttccgtaggcggctgagccagaggccaactgcagaggaactggaacagaggaacattttgaaacctcggaatgaacaagaggaacaggaggagaagagagagatcaagaggaggctaacccgaaagctcagtcaaaggcccacggtggaagagcttcgggaaagaaagatcctcatccgcttcagtgactacgtggaggtggctgacgctcaggactatgaccgcagggcagataagccgtggacccgcctcaccgctgcagacaaagctgccatccgaaaggagctcaatgaattcaaaagcactgagatggaagttcatgaattgagtagacacttaacaaggtttcaccgaccttaacagtcgaattcctcttgagtgctatgctgtcttcaaaacataaatttataagaaccataagtgctggtatttattcacttccccattacgatgtaaatcttctgaactgccttttttttaaaaagaagaaaaatcaaggaaacacaatcaggattttatgtgtgaaaacgcaaaagtgatggctcggcggtccgagctgctggtcccacttctgacaccaaaatgcatcccaacccccggcagtgccaagggcaccagcagggccctgactgaagactgtctggcaggtggaacggtccttgtcctctccagccaggcccagcaggcactaccttcatgaagtctccagcaaacctcttcctcacaagtgtctgtcatctgagtccaaagaaagctgaagggg

SEQ ID NO: 5576 - DNA, 841 bp, Homo sapiens
acagacccagagaggcggatgcatgtgggagcaaagagctttgggcagcctttaagctgaggaagtggagaggctggcggcgatgcgttctgactccctcgtcccaggcacccacaccccacccatccgcaggagaagtaagtttgccaacctgggaaggattttcaagccttggaaatggaggaagaagaaaagcgaaaagttcaaacacacgtcagcagccctggaaaggaaaatatctatgaggcaaagcagagaagagctgataaagcgaggagtcctgaaggaaatctatgataaagatggggaactctctatatccaatgaagaggactccctagaaaatgggcagtccctgagctccagccagctgtctctgcctgccctgtccgaaatggagccagtcccaatgcccagggatccctgctcatatgaggtgctccaaccgtcagacatcatggatgggccagtgtctgaagagagtccctctgccagtgagtctggagtcctcctgtcccaagatccttcagccaaaccagtcctgctactgccccccaaaaaacctgctgctttccctggagaccatgaagagaccccagtgaagcagctgccccttctcaagcagcccccggccctgcctcccaaacccactaccaggattgccaaccacttaacagattggcaccaagctcaccaggtaggacagcggcaccctctgcctccctggcagtgggcctttagctctccaggttctagcaaaagaattcagtctcggccgggcgcagtagcttatgcctgtaatcccagcactttgggaggccgaggcaggtggatcacatga

SEQ ID NO: 5577 - DNA, 795 bp, Homo sapiens
gatgagctgaggatcaacactcacaacggctgacacttaatgacgctatttatcaaatagaccttttgaaaactgatagcatgtgaatttaacagtatatgttccagagaatataaagcaaggaaaggctggtgttccagtgttttctctcaaaactctgtgtttggaacatcaaggatggattatcccaaaatggattattttctggatgtagagtctgctcacagactcttggatgttgagtcagctcaaagattcttctacagtcaaggagctcaagctcgccgggcgaccctgctcctgcctcccacattaatggcggcatcctcggaggatgatatagaccggcggcccatccggagagtgcgctccaagagcgacacgccgtacctcgcagaggccaggatctcctttaacctgggggcaggcgtttccctttttggggatatggatgaagcaagaatgggaccagcagtgccaactcttgggcgtcctcttgggctcgaactgtgttccctggaaaaccacggcctcctgaagacagcccctacatacactacatcagcccacatctgctcaggccccagtacaggtggacaattctctactcagggtatgagccctgttcaaggagctaagagaaggagggtggtttggctgcctttagagggggaagagtttggctgagaggacatttactctttggtccatatgggaagggaaaatgcgggttggcgtgtgtattcatttcctagagttgctgtaacaaagtaccacaaactacatgacataaaa

SEQ ID NO: 5578 - DNA, 4784 bp, Homo sapiens
tatttagcaagatcaaagacactctggctggaacggctcttgttttaccgctgacagatagcctttgatttttattttttgcagtgttccagtgttttctctcaaaactctgtgtttggaacatcaaggatggattatcccaaaatggattattttctggatgtagagtctgctcacagactcttggatgttgagtcagctcaaagattcttctacagtcaaggagctcaagctcgccgggcgaccctgctcctgcctcccacattaatggcggcatcctcggaggatgatatagaccggcggcccatccggagagtgcgctccaagagcgacacgccgtacctcgcagaggccaggatctcctttaacctgggggcagctgaggaagtggagaggctggcggcgatgcgttctgactccctcgtcccaggcacccacaccccacccatccgcaggagaagtaagtttgccaacctgggaaggattttcaagccttggaaatggaggaagaagaaaagcgaaaagttcaaacacacgtcagcagccctggaaaggaaaatatctatgaggcaaagcagagaagagctgataaagcgaggagtcctgaaggaaatctatgataaagatggggaactctctatatccaatgaagaggactccctagaaaatgggcagtccctgagctccagccagctgtctctgcctgccctgtccgaaatggagccagtcccaatgcccagggatccctgctcatatgaggtgctccaaccgtcagacatcatggatgggccagatcctggcgcccctgtgaaattgccttgtctgccagtgaaactgtcgcctccgctacctccaaagaaagtcatgatctgtatgcccgtgggggggccagacctctcactggtgtcctacacagcccagaagagtggccagcagggtgtggcccagcaccaccacactgtcctgccctcccagatccagcaccagctgcagtacggcagccacggccagcacctcccctccaccaccggctccctccccatgcacccctcgggctgcagaatgatagacgagctcaacaaaacgctggccatgaccatgcagaggctggaaagctctgagcagcgggtcccctgttccacttcttaccacagctctgggttgcactcgggtgatggggtcaccaaagcaggacctatgggccttccagaaataagacaagtgccaactgttgtgattgaatgtgatgacaataaagaaaatgtgcctcatgagtcagactacgaagactcttcttgcctgtatacaagagaagaggaggaagaggaggaggacgaagacgacgacagctcattatacaccagctccctggccatgaaggtctgcaggaaggactccttagccatcaaactcagcaacaggccctccaagcgagagctggaagaaaagaacatccttcccaggcagacggatgaggagcggctggagctgaggcaacagattggcaccaagctcaccaggcggctgagccagaggccaactgcagaggaactggaacagaggaacattttgaaacgtaagtgactaagcccatggcaatccctgatgttttgtggcggcttttgttattatttaatggtaggccacaaggtttctaccttgcgcctctgcggaaagcattgaaaacctttctaacggttgaagcttcatgtgtgcatgttagaacaccaaagacgacctccccaaagagaaggcaaattttattccactttattctttagaagctcacgggcggcaggcagaaccttccttttagtgagttgtaaagtcagagagaagctgaaaaattagagtgagaccacttattatttaatgatttttaagagcagggtcacctttaaaccagaattggcttgaaaatggagactgtgatatgcacggctaaaataagggaaatgtccatttgaactgagactagaaagcatgactttgcattgcagctggctgctgttgataaaaatccctcatccctttgaatgttaaattgaaagactaagaaagcatttccaagtgaagtgcttcatgtctgtctctcaggattcccacagctggtcccgggcatgcctgtctgatgctctcattcgaggaaaactgcctttcaccattgctgcagacagaaaaaaataaatgagccccttgtttggtttaggacacagagacatttgaatatgtacagaggatccacttggtgctttaaaaaaaaaaagagaaaacaggatacaaaatactaaaagagatcaagcatttgatggacagcagtatgcgtcagtttagtggtagatattaaataacttaaatatcaaaccattctattcattcattgctaccattctcgccaacactggcctcaagatagtgaacaaatatttctggcttaattcatgaccctgttccccctaccccacaacacacttctaatttctctccagaagagaaagatatatactatgcagagttttctagaaatgctatgttgtacagactgactccttgcctcccccggcccccccgccccgccccgccccgtgcccagtaaatcacatgcaaccgcagtgtgagtttgccgggaatttccactgaaaccacactaagatattcttgactttacctttctaccgtgctcactgtggccttgtgacttggtcggcatttcgtagtctgctgaaggtgggtgctgggttccgctttggtggggagacctgttgcctacagcacccacccccgcccgacgcccccgcatgtccgtttatgtcaactctgcctttatcaatgtcttgcctcccgtccccacgccagccgccacttcctcaactctcagtagaagttattttcaggattagccttcctcagtcgtgggggaaccctacgctttgcctaggtctctaggaatgtgtgtttacttttttctgcccaaggggtaccctttaaagtttccaagcttaatattctatataatgaattcagagctttttcaaagcatttccaaggtcagggaagcatttggcttgtaggatgtcttcctttcggccccaatctggtacctgagccattataaacttcccattgttggagagaaagataaacagccaggtgaacctgtacaacttactcacagcccgctgctgtacttgtggcctctgacctgagacctaaactcaaagaagctaaaagcctccgggggattatttaggtttcagaaaatagtgcttatcacaccaggagtacggtttctggagagatctaaaatcccctagctcagctctgggctctctcaaagatatcagatccccgctgtggcttgtccagatccctgggagactacaggtcctttgagcttgggtttttaccgccatcaaccagggaacttagattcaggggaccaaaaaggagttgtgaaagattgttcccatggttctcttttattctcttccctaatccctcttgtcctggccacatagttgcaaattaaagaactacttgaccaattctaacaggttggtcatttcatagttttgaaacttttcagaaatcaacttgttttcccataggttcttatttttccctgtattctggaactatgttctcctaaatatttttttaaatttaatctattgcgattgttaaacaaaaaaaatgtctagtggtataagaaaacatcctccaatagtttgttttaaaactgattttctgagctttcagccatttgaggaactgctcggtgttgggtggtggggaacagggcacagagatgccatggctcagccctggagctttgagagccttgggttggtttccagccccaccctgcctggtcctgggagcagcccctgttctgtccagcagccagtgaggccctgtgcacctctgagcacataatgaaccctctgacggtggcagctgtaatgacgacatcgtaggcctttcctggcctgtcttcctagttgcctaatggggttgtcttggtaccttctgcctgaaaattcatgaacctgggttggtcaatggctttgaactaaaggtatcaattctgtaggtggtagcttgtggccccacccctcagagtgacctaagaaacgcacataggagatgaaggctccatgctgtgtcagctgtgtcacaggatgcccgccttcacggctctgaagggacctgtaggatcagaagtctgaggctagtaatgaggaggagagccggccccacacaaaacatgaccacaggaaaaaacctatctgtgtaaccactgagccaggtagggtgtgactggccacttaacacccctgaggcttcagatcctcagttataaaccaggagtggtagacgaggtggtcactaggtcccctcatggccctagtattctgtgcttctgtaaattttcaccgtgtgccctctagctgtccctggtgacccaacatccagaccaccttttcttccatccgttttcccacctgagacatcgcaaaatgggagttccctccttctggttcttgctgtctgcctccccatttaactctgctagattaattcatactaagatattaatggctgactagtttaataggttttatcccactgaaatttgcatttgtacaaatgtcactgtctgggggctccctacttccgggtgttgctgtctgccccccagtttatctctactagattaattcatactgagctattaatggctgactagtttaatgggcttttattcaagagaaatttgcatt

SEQ ID NO: 5579 - DNA, 792 bp, Homo sapiens
ctctcccttcacccctttctctcctttgctctctttctttctctctcccttttttttcctttttccctctctttcccactccctccccaccccttcccttcctctcccctcccccttcccctccccctcccccgtgcgcgagcctcttcctctcccctcctcccccttccgcctctctccctctccctccgtctccttctccctctcagctcgccgggcgaccctgctcctgcctcccacattaatggcggcatcctcggaggatgatatagaccggcggcccatccggagagtgcgctccaagagcgacacgccgtacctcgcagaggccaggatctcctttaacctgggggcagctgaggaagtggagaggctggcggcgatgcgttctgactccctcgtcccaggcacccacaccccacccatccgcaggagaagtaagtttgccaacctgggaaggattttcaagccttggaaatggaggaagaagaaaagcgaaaagttcaaacacacgtcagcagccctggaaaggaaaatatctatgaggcaaagcagagaagagctgataaagcgaggagtcctgaaggaaatctatgataaagatggggaactctctatatccaatgaagaggactccctagaaaatgggcagtccctgagctccagccagctgtctctgcctgccctgtccgaaatggagccagtcccaatgcccagggatccctgctcatatgaggtgctccaaccgtcagacatcatggatgggccagtgtctgaagagagtccctctgc

SEQ ID NO: 5580 - DNA, 2012 bp, Homo sapiens
atggggaactctctatatccaatgaagaggactccctagaaaatgggcagtccctgagctccagccagctgtctctgcctgccctgtccgaaatggagccagtcccaatgcccagggatccctgctcatatgaggtgctccaaccgtcagacatcatggatgggccagatcctggcgcccctgtgaaattgccttgtctgccagtgaaactgtcgcctccgctacctccaaagaaagtcatgatctgtatgcccgtgggggggccagacctctcactggtgtcctacacagcccagaagagtggccagcagggtgtggcccagcaccaccacactgtcctgccctcccagatccagcaccagctgcagtacggcagccacggccagcacctcccctccaccaccggctccctccccatgcacccctcgggctgcagaatgatagacgagctcaacaaaacgctggccatgaccatgcagaggctggaaagctctgagcagcgggtcccctgttccacttcttaccacagctctgggttgcactcgggtgatggggtcaccaaagcaggacctatgggccttccagaaataagacaagtgccaactgttgtgattgaatgtgatgacaataaagaaaatgtgcctcatgagtcagactacgaagactcttcttgcctgtatacaagagaagaggaggaagaggaggaggacgaagacgacgacagctcattatacaccagctccctggccatgaaggtctgcaggaaggactccttagccatcaaactcagcaacaggccctccaagcgagagctggaagaaaagaacatccttcccaggcagacggatgaggagcggctggagctgaggcaacagattggcaccaagctcaccaggcggctgagccagaggccaactgcagaggaactggaacagaggaacattttgaaacctcggaatgaacaagaggaacaggaggagaagagagagatcaagaggaggctaacccgaaagctcagtcaaaggcccacggtggaagagcttcgggaaagaaagatcctcatccgcttcagtgactacgtggaggtggctgacgctcaggactatgaccgcagggcagataagccgtggacccgcctcaccgctgcagacaaagctgccatccgaaaggagctcaatgaattcaaaagcactgagatggaagttcatgaattgagtagacacttaacaaggtttcaccgaccttaacagtcgaattcctcttgagtgctatgctgtcttcaaaacataaatttataagaaccataagtgctggtatttattcacttccccattacgatgtaaatcttctgaactgccttttttttaaaaagaagaaaaatcaaggaaacacaatcaggattttatgtgtgaaaacgcaaaagtgatggctcggcggtccgagctgctggtcccacttctgacaccaaaatgcatcccaacccccggcagtgccaagggcaccagcagggccctgactgaagactgtctggcaggtggaacggtccttgtcctctccagccaggcccagcaggcactaccttcatgaagtctccagcaaacctcttcctcacaagtgtctgtcatctgagtccaaagaaagctgaaggggtgggtttgttttgggggtactgtgcaaagctaatgatctggttggacttctacacttggccaaatgtactggctccagacatgacatttggtttgggggccctttgaagttgatgccaagaaggagtgaacacttctcagttgcccctggcttttccctcctttcagccaccacccacacaatgaacaaaagggaagggcccatttctgggggagtctggctgcctcttggctacgaaggctggcactgagcacccatcctgctccctctgcctgagctgagctgcctttcaggaagctctggtttagaaggggaaagatgtcatatgctcagttcaaataatcaacccaactgtgtccaga

SEQ ID NO: 5581 - DNA, 1644 bp, Homo sapiens
atggattatcccaaaatggattattttctggatgtagagtctgctcacagactcttggatgttgagtcagctcaaagattcttctacagtcaaggagctcaagctcgccgggcgaccctgctcctgcctcccacattaatggcggcatcctcggaggatgatatagaccggcggcccatccggagagtgcgctccaagagcgacacgccgtacctcgcagaggccaggatctcctttaacctgggggcagctgaggaagtggagaggctggcggcgatgcgttctgactccctcgtcccaggcacccacaccccacccatccgcaggagaagtaagtttgccaacctgggaaggattttcaagccttggaaatggaggaagaagaaaagcgaaaagttcaaacacacgtcagcagccctggaaaggaaaatatctatgaggcaaagcagagaagagctgataaagcgaggagtcctgaaggaaatctatgataaagatggggaactctctatatccaatgaagaggactccctagaaaatgggcagtccctgagctccagccagctgtctctgcctgccctgtccgaaatggagccagtcccaatgcccagggatccctgctcatatgaggtgctccaaccgtcagacatcatggatgggccagtgtctgaagagagtccctctgccagtgagtctggagtcctcctgtcccaagatccttcagccaaaccagtcctgctactgccccccaaaaaacctgctgctttccctggagaccatgaagagaccccagtgaagcagctgccccttctcaagcagcccccggccctgcctcccaaacccactaccaggattgccaaccacttaacagatcctggcgcccctgtgaaattgccttgtctgccagtgaaactgtcgcctccgctacctccaaagaaagtcatgatctgtatgcccgtgggggggccagacctctcactggtgtcctacacagcccagaagagtggccagcagggtgtggcccagcaccaccacactgtcctgccctcccagatccagcaccagctgcagtacggcagccacggccagcacctcccctccaccaccggctccctccccatgcacccctcgggctgcagaatgatagacgagctcaacaaaacgctggccatgaccatgcagaggctggaaagctctgagcagcgggtcccctgttccacttcttaccacagctctgggttgcactcgggtgatggggtcaccaaagcaggacctatgggccttccagaaataagacaagtgccaactgttgtgattgaatgtgatgacaataaagaaaatgtgcctcatgagtcagactacgaagactcttcttgcctgtatacaagagaagaggaggaagaggaggaggacgaagacgacgacagctcattatacaccagctccctggccatgaaggtctgcaggaaggactccttagccatcaaactcagcaacaggccctccaagcgagagctggaagaaaagaacatccttcccaggcagacggatgaggagcggctggagctgaggcaacagattggcaccaagctcaccagaaacaagttcagaagagactttgggagacagctggaaggaaaatag

SEQ ID NO: 5582 - DNA, 760 bp, Homo sapiens
aacctgggaaggattttcaagccttggaaatggaggaagaagaaaagcgaaaagttcaaacacacgtcagcagccctggaaaggaaaatatctatgaggcaaagcagagaagagctgataaagcgaggagtcctgaaggaaatctatgataaagatggggaactctctatatccaatgaagaggactccctagaaaatgggcagtccctgagctccagccagctgtctctgcctgccctgtccgaaatggagccagtcccaatgcccagggatccctgctcatatgaggtgctccaaccgtcagacatcatggatgggccagtgtctgaagagagtccctctgccagtgagtctggagtcctcctgtcccaagatccttcagccaaaccagtcctgctactgccccccaaaaaacctgctgctttccctggagaccatgaagagaccccagtgaagcagctgccccttctcaagcagcccccggccctgcctcccaaacccactaccaggattgccaaccacttaacagattggcaccaagctcaccaggtaggacagcggcaccctctgcctccctggcagtgggcctttagctctccaggttctagcaaaagaattcagtctcggccgggcgcagtagcttatgcctgtaatcccagcactttgggaggccgaggcaggtggatcacatgaggtcaggagttcaagaccagcctggccaacatggtgaaaccccatctctactaaaaatgcaaaaatt

SEQ ID NO: 5583 - DNA, 1546 bp, Homo sapiens
acagacccagagaggcggatgcatgtgggagcaaagagctttgggcagcctttaagctgaggaagtggagaggctggcggcgatgcgttctgactccctcgtcccaggcacccacaccccacccatccgcaggagaagtaagtttgccaacctgggaaggattttcaagccttggaaatggaggaagaagaaaagcgaaaagttcaaacacacgtcagcagccctggaaaggaaaatatctatgaggcaaagcagagaagagctgataaagcgaggagtcctgaaggaaatctatgataaagatggggaactctctatatccaatgaagaggactccctagaaaatgggcagtccctgagctccagccagctgtctctgcctgccctgtccgaaatggagccagtcccaatgcccagggatccctgctcatatgaggtgctccaaccgtcagacatcatggatgggccagatcctggcgcccctgtgaaattgccttgtctgccagtgaaactgtcgcctccgctacctccaaagaaagtcatgatctgtatgcccgtgggggggccagacctctcactggtgtcctacacagcccagaagagtggccagcagggtgtggcccagcaccaccacactgtcctgccctcccagatccagcaccagctgcagtacggcagccacggccagcacctcccctccaccaccggctccctccccatgcacccctcgggctgcagaatgatagacgagctcaacaaaacgctggccatgaccatgcagaggctggaaagctctgagcagcgggtcccctgttccacttcttaccacagctctgggttgcactcgggtgatggggtcaccaaagcaggacctatgggccttccagaaataagacaagtgccaactgttgtgattgaatgtgatgacaataaagaaaatgtgcctcatgagtcagactacgaagactcttcttgcctgtatacaagagaagaggaggaagaggaggaggacgaagacgacgacagctcattatacaccagctccctggccatgaaggtctgcaggaaggactccttagccatcaaactcagcaacaggccctccaagcgagagctggaagaaaagaacatccttcccaggcagacggatgaggagcggctggagctgaggcaacagattggcaccaagctcaccaggcggctgagccagaggccaactgcagaggaactggaacagaggaacattttgaaacctcggaatgaacaagaggaacaggaggagaagagagagatcaagaggaggctaacccgaaagctcagtcaaaggcccacggtggaagagcttcgggaaagaaagatcctcatccgcttcagtgactacgtggaggtggctgacgctcaggactatgaccgcagggcagataagccgtggacccgcctcaccgctgcagacaaagctgccatccgaaaggagctcaatgaattcaaaagcactgagatggaagttcatgaattgagtagacacttaacaagctttcgatttcct

SEQ ID NO: 5584 - DNA, 1851 bp, Homo sapiens
atgaagtatgctcagtgtgccagcaagggctgataatcagcagaaggacagggtgcttcgttagtcagaagagccagggcttcccggctgccaggctacagaactcgcctcgccactcctgagacatggacaacgccgttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcagtattagaaaggaagatatccacacgacaaagtagagaggagctgataagaaggggagtgcttaaggaattgcctgatcaagatggagatgtaacagttaactttgaaaattcaaacgggcacatgatacccatcggagaggaatctacccgagaggaaaatgtagtaaagtctgaagaaggtaatggctctgtatctgaaaaaacaccacctctggaggaacaggcagaagataagaaagctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtggagagtttcaaactcgaacagactgtccctggagctgaggagcagaacacaggcaaattcaagtccatggtccctccaccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatgtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggaggctgagccagaggcccacaactgaagaattagagcaaagaaacatcctaaaacaaaagaatgaagaagaggaacaagaagcaaaaatggaacttaaacgcagactcagcagaaagctcagcctgagacccacagtggcagagctacaagctcgaaggatcctgcgatttaacgagtatgtagaagtcacggattctcctgactatgaccgccgagcagacaagccctgggccaggttaacacctgcagacaaggcagcaataaggaaagaactaaatgaatttaaaagcacagaaatggaagttcatgaagagagtcgacagtttacaaggtttcatcgtccataacgaagagtgagactatttggaaacagagactgatcatctttgggggaagccctgcttcctg

SEQ ID NO: 5585 - DNA, 4367 bp, Homo sapiens
gccgcgccggctgcggccggccgggctgggagacccgcgcggggtagaaggtgaggggacccggcgggccgctcggcacaggccgggacatgaacgcctggaagtctggctgggagcggacccatgatcgaaggaccaaaggagccgcttgatcgctggacctggccctgcgaccccagtcatgggccagacctcggtgtccacgctgtccccgcagcccggcagcgttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcagtattagaaaggaagatatccacacgacaaagtagagaggagctgataagaaggggagtgcttaaggaattgcctgatcaagatggagatgtaacagttaactttgaaaattcaaacgggcacatgatacccatcggagaggaatctacccgagaggaaaatgtagtaaagtctgaagaaggtaatggctctgtatctgaaaaaacaccacctctggaggaacaggcagaagataagaaagctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtggagagtttcaaactcgaacagactgtccctggagctgaggagcagaacacaggcaaattcaagtccatggtccctccaccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatgtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggaggctgagccagaggcccacaactgaagaattagagcaaagaaacatcctaaaacaaaagaatgaagaagaggaacaagaagcaaaaatggaacttaaacgcagactcagcagaaagctcagcctgagacccacagtggcagagctacaagctcgaaggatcctgcgatttaacgagtatgtagaagtcacggattctcctgactatgaccgccgagcagacaagccctgggccaggttaacacctgcagacaaggcagcaataaggaaagaactaaatgaatttaaaagcacagaaatggaagttcatgaagagagtcgacagtttacaaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtagttattcggtagctgagaacttattaagggatttaggaatttaacctcctgatgtggattcctcaaagacttgatcggagaatactcttgtttcaccattatgttggtacagtatagtaccattattttatgttgtgccagtgaatccagttgccagaaataagtctgaatgttttcatgcatctttttcttaaatgcaagagcttctactgactcttaacaagcatgcttacccaaattttgttgcatgcttttaagtagcattagctatgcacacttgacatttttaaatatccctttcctagtgtaccagccttcacaggataagaggactgggaataaagtcagatgtaatgtgaccctagaaaactgtagcaagcttcagaaataaatcttttgatctttccctatcttgattagatccaaagtcaaagcaaccatacttcacctagagaagacagtattggcaatcatgacacctgtaataaaaacttgaatccaaagtcaaaacttaagcaagatacaaatgtgctgcctgcagttagtcctgcatgggaataaggactagttatttttttagtgctgcatttttttaaagttggattgctgctatttaaaaaaaaaaaaaggacacagatcaaaaaaacacccaaaggcttaacagaacatggaaagttcccactaagttgtgtgtgaggaaatcctcatcttgtattttaagaatctgcagatggcatccatagatacagtacagtatttactgtcaatgcaaaagaatcagtgaggttaaagtagtggaagttttccctatgagcctacagtctgtattgtttacattaagaaactctctattattgtgttgctattttccatggagtcacaggcacactatgacttctgctcccaaatacatatgaccatatgtaaataccaccttgcatttcattgttcttcacaagtgctttgtgcccctttaattaaaaacacatgaaatgaataacaaaacaagacccaaatagagtttattttattctcagagtttggactacaattttctaagatgtttctggttcaagactgtcattttctatttcaaccgaaaagtaagcatttaacccggtgaataaatgtagatcctgccattcattggtattttaaagaaccacttgaaatcggatcattttatttaaaaataaaaaatgttaatgccagttggcctactataaaaagccaggaccatgttagaattaggaaaagtaaccagcattactgcacctcttgttagactctgtgcattaataaaacacacctagagtctgttgtcatttcactaataggataagacaaattttttgctttgaaaaaatttttctgcatgcccaggtgtctgtctctggctgaggttttgtctattttacagtgtttcaatccagccataaaaattaacttgtgattttttttttcccaaagtcatgcttttccttaattatatttttattttattattttagtgtcttgagaaaaataccaagagatataatgtttcttttaattgtctatgcttaatcatctttaaacactttttaaatttctaaccacaagacctctctataatggtaaatgtaagacatcaccattttatcactcaaagtatgttattgaaagtttctatttggttgataaaaggaacaattttttcccacttttgatgcctgtgatgcaattttttattgcctacaatgagatacacttagtacaaaaaatgaaaatctggtatttcaaaattgcatttcttgtataataggtcagatttattaactactcatactttttctttacactaatcgatacatttagaaaaaattttctaagttagagacaagtttaaaagtaaaaaaaaaaaaaaattagccactgctagtctactgtttaggtaatcggaatcaccaattattttattagaatgatggcttgagtaaaaagctgtggaaagaattaaaggattatgagctaa

SEQ ID NO: 5586 - DNA, 3905 bp, Homo sapiens
atgggccagacctcggtgtccacgctgtccccgcagcccggcagcgttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcagtattagaaaggaagatatccacacgacaaagtagagaggagctgataagaaggggagtgcttaaggaattgcctgatcaagctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtggagagtttcaaactcgaacagactgtccctggagctgaggagcagaacacaggcaaattcaagtccatggtccctccaccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatgtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggaggctgagccagaggcccacaactgaagaattagagcaaagaaacatcctaaaacaaaagaatgaagaagaggaacaagaagcaaaaatggaacttaaacgcagactcagcagaaagctcagcctgagacccacagtggcagagctacaagctcgaaggatcctgcgatttaacgagtatgtagaagtcacggattctcctgactatgaccgccgagcagacaagccctgggccaggttaacacctgcagacaaggcagcaataaggaaagaactaaatgaatttaaaagcacagaaatggaagttcatgaagagagtcgacagtttacaaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtagttattcggtagctgagaacttattaagggatttaggaatttaacctcctgatgtggattcctcaaagacttgatcggagaatactcttgtttcaccattatgttggtacagtatagtaccattattttatgttgtgccagtgaatccagttgccagaaataagtctgaatgttttcatgcatctttttcttaaatgcaagagcttctactgactcttaacaagcatgcttacccaaattttgttgcatgcttttaagtagcattagctatgcacacttgacatttttaaatatccctttcctagtgtaccagccttcacaggataagaggactgggaataaagtcagatgtaatgtgaccctagaaaactgtagcaagcttcagaaataaatcttttgatctttccctatcttgattagatccaaagtcaaagcaaccatacttcacctagagaagacagtattggcaatcatgacacctgtaataaaaacttgaatccaaagtcaaaacttaagcaagatacaaatgtgctgcctgcagttagtcctgcatgggaataaggactagttatttttttagtgctgcatttttttaaagttggattgctgctatttaaaaaaaaaaaaaggacacagatcaaaaaaacacccaaaggcttaacagaacatggaaagttcccactaagttgtgtgtgaggaaatcctcatcttgtattttaagaatctgcagatggcatccatagatacagtacagtatttactgtcaatgcaaaagaatcagtgaggttaaagtagtggaagttttccctatgagcctacagtctgtattgtttacattaagaaactctctattattgtgttgctattttccatggagtcacaggcacactatgacttctgctcccaaatacatatgaccatatgtaaataccaccttgcatttcattgttcttcacaagtgctttgtgcccctttaattaaaaacacatgaaatgaataacaaaacaagacccaaatagagtttattttattctcagagtttggactacaattttctaagatgtttctggttcaagactgtcattttctatttcaaccgaaaagtaagcatttaacccggtgaataaatgtagatcctgccattcattggtattttaaagaaccacttgaaatcggatcattttatttaaaaataaaaaatgttaatgccagttggcctactataaaaagccaggaccatgttagaattaggaaaagtaaccagcattactgcacctcttgttagactctgtgcattaataaaacacacctagagtctgttgtcatttcactaataggataagacaaattttttgctttgaaaaaatttttctgcatgcccaggtgtctgtctctggctgaggttttgtctattttacagtgtttcaatccagccataaaaattaacttgtgattttttttttcccaaagtcatgcttttccttaattatatttttattttattattttagtgtcttgagaaaaataccaagagatataatgtttcttttaattgtctatgcttaatcatctttaaacactttttaaatttctaaccacaagacctctctataatggtaaatgtaagacatcaccattttatcactcaaagtatgttattgaaagtttctatttggttgataaaaggaacaattttttcccacttttgatgcctgtgatgcaattttttattgcctacaatgagatacacttagtacaaaaaatgaaaatctggtatttcaaaattgcatttcttgtataataggtcagatttattaactactcatactttttctttacactaatcgatacatttagaaaaaattttctaagttagagacaagtttaaaagt

SEQ ID NO: 5587 - DNA, 9531 bp, Homo sapiens
agtgcatgaagtatgctcagtgtgccagcaagggctgataatcagcagaaggacagggtgcttcgttagtcagaagagccagggcttcccggctgccaggctacagaactcgcctcgccactcctgagacatggacaacgccgttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcagtattagaaaggaagatatccacacgacaaagtagagaggagctgataagaaggggagtgcttaaggaattgcctgatcaagatggagatgtaacagttaactttgaaaattcaaacgggcacatgatacccatcggagaggaatctacccgagaggaaaatgtagtaaagtctgaagaaggtaatggctctgtatctgaaaaaacaccacctctggaggaacaggcagaagataagaaagagaacactgaaaaccactctgaaacaccggcagctcctgctctacctccttctgctcctcctaagcctagacccaaacctaaacccaaaaaatcacctgtgcctccgaaaggggccactgctggggccagccacaaaggtgatgaagtgcctcccattaaaaaaaataccaaggctcctggtaagcaggcccccgtccctccacccaagccagcaagccgaaacacgacccgagaggctgctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtggagagtttcaaactcgaacagactgtccctggagctgaggagcagaacacaggcaaattcaagtccatggtccctccaccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatgtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggaggctgagccagaggcccacaactgaagaattagagcaaagaaacatcctaaaacaaaagaatgaagaagaggaacaagaagcaaaaatggaacttaaacgcagactcagcagaaagctcagcctgagacccacagtggcagagctacaagctcgaaggatcctgcgatttaacgagtatgtagaagtcacggattctcctgactatgaccgccgagcagacaagccctgggccaggttaacacctgcagacaaggcagcaataaggaaagaactaaatgaatttaaaagcacagaaatggaagttcatgaagagagtcgacagtttacaaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtagttattcggtagctgagaacttattaagggatttaggaatttaacctcctgatgtggattcctcaaagacttgatcggagaatactcttgtttcaccattatgttggtacagtatagtaccattattttatgttgtgccagtgaatccagttgccagaaataagtctgaatgttttcatgcatctttttcttaaatgcaagagcttctactgactcttaacaagcatgcttacccaaattttgttgcatgcttttaagtagcattagctatgcacacttgacatttttaaatatccctttcctagtgtaccagccttcacaggataagaggactgggaataaagtcagatgtaatgtgaccctagaaaactgtagcaagcttcagaaataaatcttttgatctttccctatcttgattagatccaaagtcaaagcaaccatacttcacctagagaagacagtattggcaatcatgacacctgtaataaaaacttgaatccaaagtcaaaacttaagcaagatacaaatgtgctgcctgcagttagtcctgcatgggaataaggactagttatttttttagtgctgcatttttttaaagttggattgctgctatttaaaaaaaaaaaaaggacacagatcaaaaaaacacccaaaggcttaacagaacatggaaagttcccactaagttgtgtgtgaggaaatcctcatcttgtattttaagaatctgcagatggcatccatagatacagtacagtatttactgtcaatgcaaaagaatcagtgaggttaaagtagtggaagttttccctatgagcctacagtctgtattgtttacattaagaaactctctattattgtgttgctattttccatggagtcacaggcacactatgacttctgctcccaaatacatatgaccatatgtaaataccaccttgcatttcattgttcttcacaagtgctttgtgcccctttaattaaaaacacatgaaatgaataacaaaacaagacccaaatagagtttattttattctcagagtttggactacaattttctaagatgtttctggttcaagactgtcattttctatttcaaccgaaaagtaagcatttaacccggtgaataaatgtagatcctgccattcattggtattttaaagaaccacttgaaatcggatcattttatttaaaaataaaaaatgttaatgccagttggcctactataaaaagccaggaccatgttagaattaggaaaagtaaccagcattactgcacctcttgttagactctgtgcattaataaaacacacctagagtctgttgtcatttcactaataggataagacaaattttttgctttgaaaaaatttttctgcatgcccaggtgtctgtctctggctgaggttttgtctattttacagtgtttcaatccagccataaaaattaacttgtgattttttttttcccaaagtcatgcttttccttaattatatttttattttattattttagtgtcttgagaaaaataccaagagatataatgtttcttttaattgtctatgcttaatcatctttaaacactttttaaatttctaaccacaagacctctctataatggtaaatgtaagacatcaccattttatcactcaaagtatgttattgaaagtttctatttggttgataaaaggaacaattttttcccacttttgatgcctgtgatgcaattttttattgcctacaatgagatacacttagtacaaaaaatgaaaatctggtatttcaaaattgcatttcttgtataataggtcagatttattaactactcatactttttctttacactaatcgatacatttagaaaaaattttctaagttagagacaagtttaaaagtaaaaaaaaaaaaaaattagccactgctagtctactgtttaggtaatcggaatcaccaattattttattagaatgatggcttgagtaaaaagctgtggaaagaattaaaggattatgagctaagctgtattttgcagaatatggttctattttagtagagcagagatgagacatatccccaccggccacccagccagaggtctcctacctgggggccctaaagggatgcagaggtctggcccaccctccgtgcataggcacctctgtccaccaccagcgtttcagcaatccaaccagtaagcatatgctgtataggaaaaataaaagtgtgtgggaattggatttcttttgttgtaacacaattccaggtttttggctatttaaagtttgacattaggctgacatcgaggaagtaagtgggttttcctgagttcccaagatatgattaaggaagaaaacaaacccatctccaggaagatcccaggcaggaaagaactagacagatgtagaaaccaaagtgaccattttagtttttttattggagaataaaacattaatattagggtattaagaagatgctcagcaagcttgatcagaatcttcatggtcattaccaatcagtctgacaaaatagttctctggtagtcagcattcatttaaggcagcttgcctgataatttcctgtgttatgtgaagtgtcttgcactttcacatgttagctataattccttaaattacttaactgaaatctgtaatagagaaccattttggcatttgaacagctattttacatggagaaaaagcaaacacatctgtttgctttacccagaaaaactgactttctggtttcatcttcatattgtttagtagcataatgagagtagtcctttatctttctctaatgttagtaaatatattctgttagtaggaagttctgaaattgaagggaaaatatatttaaggaaataaaggaattcaatacacccttcaaaagtcaccaaatactgaaaataagagatgagtccttaaaacctgagtcaaaaaaggtccagttttacagcctgcaattaattcagggctgcgttggcattaaaaaagaaaatatatatatatatatatatatatatatatatatatatatatatgtatattatatatacagtagcttacacttaaaagaggaaaaatttgcattaacattgcatattctgatatgtaccatattaacacataacaggcattttatttatgcttcatagaatcagacagacacaactttcaaaaatcttactgtattcacaatagaaaagggtagtcttgtctaccacagaggagtatgtccacacttaataatgaaaactttcttcctttcctgcccaaaaatttcttcagtctgttattatttttaagtgccccttgctgcaaatttcaaacagagcaagaaatcttcctcagagtaggtggtatgaaattaaactagtacaatatatatgaattcatgtcatttacccctgagtatggtagaattgttaaagcattcttaaattccaattatatgaagcctatcattactaggaaaagtatattctttgggataagaattaatttcttcacactattagagcatgttgtgagtagtaaggaactacttagatgcaatttatttacagaattgtcccttgacctcttgaaatggctagatctttcactactgtgtaggtagtctctacttactggtaggatagattacattgctttactggacaaagcagaatgaacttatataactaaaatatgtcctatattggctgggtgcggtggcttacacctgtaataccagcactttgggaggccaaggtgggtggatcagttgaggtcaggagttcgagaccagcctggccaacatggtgaaaccctgtctctactgaaaatacaaaaaaaaaaaagtatctgggcatggtggcttgtgcctgtaatcccagctacttgggaggctgaggcagggaaatcgcttaaacccgggaggtggaggttgcagtgggcccagatcgtgccactccactccagcctgggagacagagcaagactccatctcaaaataataataatagtaataatgaataaaataaaataaaatatgtcctccagggaaaagcaatgacagagtaatcaccaaattaataggaacatctttctagagaaagtacatgcccagttagttcaaacccaggtttcaaagaagtagcactgggctctactgtaaaggcaggcagtgaccaagaggtggtggggagagaggtagagtaccctcaaatcattcccattttcacttccaatttcccttttgtaatcattaagcttaagctatgtatggaaatgcaaagcaccattagcatttctagaaagcagctggaaccttacccaccaatgcttttttgaagacagtatcatcccaaatttaaaaatcctattgtatatgttgtaaaatttctggcaaagaaatggaggatcctgtggcagctattcccacctaaagccaaccctataaggatgggtcattttttagccatgctaggatttactgcacacacaaaaaatgtcatttagcttgtcacattgctagcacagctgcacatatgagcaaagcactgttggtctgtgtttctcagtgggggtactcttggcatttggagctggataggtctttgctgtacagaatcatcccatgcattgccagatgtttaatatcccaggcccctgctgactaaatgtcagtagcattctcagtcattgtaaacaccaagaataaaaagcattcccccaggttcaaatgccctccctgggaggttggtatcacctcccctgaatgccactgtctactgcattttgaggacacagggagaaaaagtgcctatcctcaaacattgtctctgctgccttgcatttctttgggccctgaatggtttttctcccttcatttttcgagcctttctctcagtgcagctgttcttcagggaggaggttactgggcagccttggccattcagtgggcatggggacttggcctagtccctatatatatatacttaaagtccctatatatacttaaaggagagatcatacatgaagaaagcttttttttttttttttttttttgccttacaacttttctttagaaccacattattggtcataatccttgttactgtcatgaggattgttgcatgggttaaacacaaacacagactagcaatgcacttgaacaaacctggtggtctttggaaataaatcaccattagatttcacctggttatgctgcatcccataagttccaaatgaatcacctgcttatcctattaacgaagcatttaattcacacacaaatgcttgaatttcccctgtataaatgtagtcatgcgattcaacttttctaataagatttgtgaatgctgcatcatgatgaaaatgtggattaactgtgggttgcatgcctgttgttcatacttcagtgatggtcacacacaaaacaagatgagttttacttaggtgaaacattattaaactgtactaacaatacagaaacatattctctttgtcgctttttatcaccaaaactgaatggcaaatatgtcttgacattacttggatgaactgtggctagcaaaatggaattaacttagccactataattttttaaaacattaaagtttctaaattgtttttggggccgagtaacgcagagtcaataaaggtggttatattgtaagcttttagatggtgcttaagaattcttatctttttaaatagcagtattttttttttaagaataaattgtaaggagcaaataaggcagaatgccactctaccctcaggtcaattttatggtatatgaaaatgccagtaatatttgtgccacttgccaactcgggggaggaggggcttttcccttactggatacttttgttatagtttgactatgtcattatgttgtttagagagcctccacaatgagaagttgccactgcagggctaactcgccttcagaaataatcagaatgattcaagggtcaaaccactttcatcccttaaaatatagggactaatatttctttttcttttttttaaaaaaaacatttcttctgtggcttagaaatgtgccagtgtgttcaaaacatttacaccaatttcaccagatttaggacctattaaaaattcaaacaagtttcttttttttttttttttttctgtgtaacagggatttttaaataacggactatatgcattcttttgttatttcacacttcagttaaagtgataacaatggtaaactgtgatcattatcagactgactgaatgctttctgatttccagtgagtgatctagttctacgtattacacaggtgtaatatctgtgagtgtaaataactggaactgtacactgattaacatgacagtttctcttttgttgttcttatctgtactgtattatagtatgtgggtataaatatctacaagtatacacacatatgtacttgtattccactattgtaacctgaaagaaagactatgtattcccttttttaattccgtactggtatttgtgttatttaaaaagcaaaattctgctctatttagttgtataatattagaggatactttgctgtgcacaattccaagtgccttagaacattgtttagctttcctaagtatatataaatgcatatatgtataaaattgggaaaagttacctcaataaaatcattgggaaatccccagttttagtttgttccagtttctcttatatttggatagtgctcagcctttttaaatgaaaaaagaaaaaagagtaagacaacttccctaattgcctgttatttcagcttcacctaagtttttaacacctctttgtatgtaaggtcttgagacatgtaaggcctggtactttttatttaaaatgtctgtctaaagaattactgctcttaaaagaaacttccagtattttttttaacttgctatctttttatgtctgaggtatttgatattgatgtttttattgccattattatatgtaaacataaaagatagtccatttagagtttataatatagaaaataaacagacttcctcatta

SEQ ID NO: 5588 - DNA, 2569 bp, Homo sapiens
atccgctgggcaggatccgccgcgccggctgcggccggccgggctgggagacccgcgcggggtagaaggtgaggggacccggcgggccgctcggcacaggccgggacatgaacgcctggaagtctggctgggagcggacccatgatcgaaggaccaaaggagccgcttgatcgctggacctggccctgcgaccccagtcatgggccagacctcggtgtccacgctgtccccgcagcccggcagcgttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcagtattagaaaggaagatatccacacgacaaagtagagaggagctgataagaaggggagtgcttaaggaattgcctgatcaagatggagatgtaacagttaactttgaaaattcaaacgggcacatgatacccatcggagaggaatctacccgagaggaaaatgtagtaaagtctgaagaaggtaatggctctgtatctgaaaaaacaccacctctggaggaacaggcagaagataagaaagagaacactgaaaaccactctgaaacaccggcagctcctgctctacctccttctgctcctcctaagcctagacccaaacctaaacccaaaaaatcacctgtgcctccgaaaggggccactgctggggccagccacaaaggtgatgaagtgcctcccattaaaaaaaataccaaggctcctggtaagcaggcccccgtccctccacccaagccagcaagccgaaacacgacccgagaggctgctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtggagagtttcaaactcgaacagactgtccctggagctgaggagcagaacacaggcaaattcaagtccatggtccctccaccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatgtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggaggctgagccagaggcccacaactgaagaattagagcaaagaaacatcctaaaacaaaagaatgaagaagaggaacaagaagcaaaaatggaacttaaacgcagactcagcagaaagctcagcctgagacccacagtggcagagctacaagctcgaaggatcctgcgatttaacgagtatgtagaagtcacggattctcctgactatgaccgccgagcagacaagccctgggccaggttaacacctgcagacaaggcagcaataaggaaagaactaaatgaatttaaaagcacagaaatggaagttcatgaagagagtcgacagtttacaaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaat

SEQ ID NO: 5589 - DNA, 6112 bp, Homo sapiens
gtgtgaagacagttttgtaagaactgcaagtgctcaggctgtatgggaaacagaaacttcagcagatgaactgaccttatgccatttcctgatgtttggcagtgacactgaaagaggaccgcatgtcccctctttatgtggatttatcttttatgaaaagtttgcttttgtccgggacagtttgttgtcgtgagatacatcagacaatataatcatgggacaagctgatgtctccagaccggtaaatccagatgcagttgaggaagcagaccagcccactacagagccaggcatggtcctggacagtgtggaagcaggagacacaacacctcctaccaaaaggaagagcaagttctcaggctttggcaagatcttcaagccctggaaatggaggaaaaaaaaaagtagtgataaatttaaagagacttcagaagttttagaacggaaaatatctatgcgaaagccaagagaagagctggttaaaagaggggttctgttggaagaccctgagcaaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattgctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaaagttccagacgatgaagaagaagaggagcaaacctgtccatccacattcagtgaagaaatgacacctacctcagtcattcctaaattaccacagtgtctacgggaggaagaagagaaggagagcgactctgattcagaaggtcccattcagtaccgagatgaagaagatgaagatgaaagctatcagagtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggcgactgagtcaaagaccaacaccagaagaactagaacaacgcaatatattgcaacctaaaaatgaagctgatcgtcaggcagaaaaacgagaaattaaacgtcggctcactagaaagctcagtcaaaggccaactgtcgctgaactccttgccaggaagattctgaggtttaatgaatatgtagaggtaacagatgctcaagattatgaccggcgagccgacaaaccttggaccaaactgacccctgctgacaaggctgccataagaaaagaattaaatgaatttaaaagctccgagatggaggttcatgaagagagcaaacattttacacgctaccatcgtccatgatgccaaaggttgagagaggaatcaacatggctgctttgctgcttccttctccaaagtgacatatggagggaactttagcacttcccagcacagccagaattgcatcctctgggatcttctgaggtggacagcactttgaatgtagcatttcactggaacagagtcttatgtgctgcaccgggggcaaaacaacactttgtcagtgcttttgaacctttcaatattgtagcatgcttgaggagtttttcccttactggccaccaaagttctgaaccacttgcaggttccaggttttactggctgcaccacaccccttcccctagatgactgcctgtgcagagacacagtttgcaccattagccttacctgccctgccctgattgtgagacccaaatgtgtaggctctaaattccagccatcaaatccaattcctggtggggaaaaccttctggagacccccaaccttctgataaaagagtctctacctccagggaaagccttcttaccacactggcatatcagatgaaagcattgcactgtacctctcgtaacacagcaatacagtcctcttgaggcactcaagcctgagaggaagctcaggatctgacatgttcttccttttcctcacaagtcatcatgattttttattttaaaataatctggaagtaatgggaacttagtttttcctgaactccaaccagaatccaaattggttagatgaggccaggcgcggtggctcacgcctgtaatcccagcactttgggaggccgaggtgggtggatcacctgaggtcaggagttcaagaccagcctggccaacatggtgaaaccccatctctactaaaaatacaaaaattagccaggtgtggtggcgcctggttgaggcatgagaatcgcttgaacccaggaggtggaggttgcagtgagccaagatcatgcctactgcactccagcctgggcaacaaagtgggactctgtcttaaaaaaaaaaaaaaaaaaaaaatcggttagatgagaaagcatgtatattttctatatacaaaaacaagaaaggcgttttgagcccctgtgctcaggcccactcccacactgtggagtgtactttcattttcaataaatccccttattccttccttgcaaaaaaaaaaaaaaaaaaagccttagccagattcagtggctcacgcctgtaatcccaacactttgggaggctgaggcgggtggatcacctgagttcaggagttcaagaccagcctggccaacatggcaaaaccctgtctctactaaaaagtaaaaaaaattagccgggcatggtggcttgtgccttgtagtcccagccactggggaggctgaggcgggagaattgcttgaacctgggaggtggagattgcagtgagccgagatcgcgccactgcactccagcctgggtgacagagcgagactccgtctcaaaaaaaaaaaaaaagccttaatattaatgctaacgtggcagaaaactagcaggttacattttataggctattgtagttttatttaccaaatgatattctctaaatcacttcgaccaataaatgtattctcctccttaaagcagagttgtatcaactctgtgggagcatttatgagctgtcagtccccacacttctagccagaatcacaataaggtctggctgggtgtggggtgctgcataggaaagggtctctggagaagcaagaagggcacaatcatggcccactgctcccctcttcttctcagtgctctttgccctctcctgctgcgtgcttcctcttcactccagtgctgatcctcctgctctctctggcagcttccacctcacccgcccctcttccacactataaccagtatggttggtgctggggcattgactcagcccccctgctttctgcatttgtaatagatattaatatgatttcctaaaacagaagattttgttgctttctttgaacttgtattgaaaaccatacagtctcactgttttgctttaattcctatccacactataaatggaagaaaaaaattaatagcttctgtttaatctgatgaatgtggctttttttcccttcactttaatgttcaagaagttgtggctatttcatagatttcttctgatttattctgtgggtccctgttatctgttctttatgtaatctttcagtagattttcatcctttcatatccacattcttatgtggacttgctgaagaaacagaatatcagttcaaaacaaaacctaggccaggcatggtggttcacgcctataatctcagcactttgggaagccaaggcggtcaggagtttgagaccagcctgaccaacatgatgaaaccctgtctctactaaaaatacaaaaattagcctggcgtggtggcacgcatctgtaatcccaactactcaggacgctgaggcaggagagtcgcttgaacccaggaggcggagattgcagtgagccaagattgcaccactgcactccagcctgggcaacagagcgagactccatcaaaaaaaaaaaaaaaaaagaaggaaggaaggaaagcaagccctgaatccacatctccttgaagttttttttgttttattttgtttttgagacagaattttgctcttgttgcccaggccggagtgcaatggtgcaatctcagctcactgcaacctccgcctcccgggttgaggcgattctcctacctcagcctcccaagtagctaggattacaggcatgagccaccacgcctggctaattttatatttctagtagagatgaggtttctccatgttggtcaggctggtctcaaactcccgacctcaggtgatccacccacctcagcctcccaaagtggtgggattacaggcatgagccaccgtgccgagccttccttgaagttttttgtttggttttgatttgttttgttttgttttgttttgttttgtttttggagatagggtctcactctgttacccatgctggagtgcagtggcacaatcttggctcagagcaacctctgcctcccaggctcaagcaatcctcccacttcagtctaagtagctgggactacaggcacgtgccaccaggcccagctaatttttgtgttttgttagagatgaggttttgccatattgcccaggctcgtcttgaacaccggggctcaaggaatctgcccatcttcgcctcccaaagttctgagatagcaggtgtgagtcatcatgcccagcctccttgaagtttactaacaattgggataactgagggaagagaagtgacaattccactcagtctattagaggtctggatataaggtagccacacaataactctaacttgacttctaaccattctatcttattgatttggaggctgtcttctgccagattttttgtggcttgagatgatattttcgaacccttctttcactacctttcttacccttaatgtgccaagcttgaaacaggatttgatttcctgagctacttgttcgccttctgtgcgtcaccaagtaatctggttcatctttcgtctcattcatgttattttcaagtgaaacaagacattttgggggtcaagtctctttgggtgttttgtttttatgtatataaaaatggattttgtgttccctttccatgtaagtaccaacttatatggaaactcacaatcataatgtaaagaagaaatgaaagcctggtgtattgtacttcaagatgcctccctgatgtatagaatctccttgtaaaataaataattgcattgta

SEQ ID NO: 5590 - DNA, 2926 bp, Homo sapiens
gagaggccagcagaggaagcagaccagcccactacagagccaggcatggtcctggacagtgtggaagcaggagacacaacacctcctaccaaaaggaagagcaagttctcaggctttggcaagatcttcaagccctggaaatggaggaaaaaaaaaagtagtgataaatttaaagagacttcagaagttttagaacggaaaatatctatgcgaaagccaagagaagagctggttaaaagaggggttctgttggaagaccctgagcaaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattgctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaaagttccagacgatgaagaagaagaggagcaaacctgtccatccacattcagtgaagaaatgacacctacctcagtcattcctaaattaccacagtgtctacgggaggaagaagagaaggagagcgactctgattcagaaggtcccattcagtaccgagatgaagaagatgaagatgaaagctatcagagtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggcgactgagtcaaagaccaacaccagaagaactagaacaacgcaatatattgcaacaatatagagtgaaatttggccttaaaagtctcctcactgagaaggtttgggcttccttggggctatttgtgagcatgttcagtctgaccaatccatcccctgttctctcagcactacttggctaaaaatgaagctgatcgtcaggcagaaaaacgagaaattaaacgtcggctcactagaaagctcagtcaaaggccaactgtcgctgaactccttgccaggaagattctgaggtttaatgaatatgtagaggtaacagatgctcaagattatgaccggcgagccgacaaaccttggaccaaactgacccctgctgacaaggctgccataagaaaagaattaaatgaatttaaaagctccgagatggaggttcatgaagagagcaaacattttacacggcaggggcctggtgcagtggtacacacctgtaatcctagcactttgggaggccgaggtgggaggatcactttgagaccagcctgggaaacacgctaccatcgtccatgatgccaaaggttgagagaggaatcaacatggctgctttgctgcttccttctccaaagtgacatatggagggaactttagcacttcccagcacagccagaattgcatcctctgggatcttctgaggtggacagcactttgaatgtagcatttcactggaacagagtcttatgtgctgcaccgggggcaaaacaacactttgtcagtgcttttgaacctttcaatattgtagcatgcttgaggagtttttcccttactggccaccaaagttctgaaccacttgcaggttccaggttttactggctgcaccacaccccttcccctagatgactgcctgtgcagagacacagtttgcaccattagccttacctgccctgccctgattgtgagacccaaatgtgtaggctctaaattccagccatcaaatccaattcctggtggggaaaaccttctggagacccccaaccttctgataaaagagtctctacctccagggaaagccttcttaccacactggcatatcagatgaaagcattgcactgtacctctcgtaacacagcaatacagtcctcttgaggcactcaagcctgagaggaagctcaggatctg

SEQ ID NO: 5591 - DNA, 6190 bp, Homo sapiens
cccgccattttgttcagcttgccgggcaaccggcccctgctggggactacaagtcccgtaagcctccgcggcggcacgtcctaccctacactgtccagccggctccctttttccccctccccgggggccaagggctccggctgctgcctggcggccaacgggccaggtaggatttccgggagaggctgctgtggaggctgaggaggcggcggcggagatctggaaacagtatctcacctccctaaactggttaatagtggcatggaagatccatttgaggaagcagaccagcccactacagagccaggcatggtcctggacagtgtggaagcaggagacacaacacctcctaccaaaaggaagagcaagttctcaggctttggcaagatcttcaagccctggaaatggaggaaaaaaaaaagtagtgataaatttaaagagacttcagaagttttagaacggaaaatatctatgcgaaagccaagagaagagctggttaaaagaggggttctgttggaagaccctgagcaaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattgctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaaagttccagacgatgaagaagaagaggagcaaacctgtccatccacattcagtgaagaaatgacacctacctcagtcattcctaaattaccacagtgtctacgggaggaagaagagaaggagagcgactctgattcagaaggtcccattcagtaccgagatgaagaagatgaagatgaaagctatcagagtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggcgactgagtcaaagaccaacaccagaagaactagaacaacgcaatatattgcaacctaaaaatgaagctgatcgtcaggcagaaaaacgagaaattaaacgtcggctcactagaaagctcagtcaaaggccaactgtcgctgaactccttgccaggaagattctgaggtttaatgaatatgtagaggtaacagatgctcaagattatgaccggcgagccgacaaaccttggaccaaactgacccctgctgacaaggctgccataagaaaagaattaaatgaatttaaaagctccgagatggaggttcatgaagagagcaaacattttacacgctaccatcgtccatgatgccaaaggttgagagaggaatcaacatggctgctttgctgcttccttctccaaagtgacatatggagggaactttagcacttcccagcacagccagaattgcatcctctgggatcttctgaggtggacagcactttgaatgtagcatttcactggaacagagtcttatgtgctgcaccgggggcaaaacaacactttgtcagtgcttttgaacctttcaatattgtagcatgcttgaggagtttttcccttactggccaccaaagttctgaaccacttgcaggttccaggttttactggctgcaccacaccccttcccctagatgactgcctgtgcagagacacagtttgcaccattagccttacctgccctgccctgattgtgagacccaaatgtgtaggctctaaattccagccatcaaatccaattcctggtggggaaaaccttctggagacccccaaccttctgataaaagagtctctacctccagggaaagccttcttaccacactggcatatcagatgaaagcattgcactgtacctctcgtaacacagcaatacagtcctcttgaggcactcaagcctgagaggaagctcaggatctgacatgttcttccttttcctcacaagtcatcatgattttttattttaaaataatctggaagtaatgggaacttagtttttcctgaactccaaccagaatccaaattggttagatgaggccaggcgcggtggctcacgcctgtaatcccagcactttgggaggccgaggtgggtggatcacctgaggtcaggagttcaagaccagcctggccaacatggtgaaaccccatctctactaaaaatacaaaaattagccaggtgtggtggcgcctggttgaggcatgagaatcgcttgaacccaggaggtggaggttgcagtgagccaagatcatgcctactgcactccagcctgggcaacaaagtgggactctgtcttaaaaaaaaaaaaaaaaaaaaaatcggttagatgagaaagcatgtatattttctatatacaaaaacaagaaaggcgttttgagcccctgtgctcaggcccactcccacactgtggagtgtactttcattttcaataaatccccttattccttccttgcaaaaaaaaaaaaaaaaaaagccttagccagattcagtggctcacgcctgtaatcccaacactttgggaggctgaggcgggtggatcacctgagttcaggagttcaagaccagcctggccaacatggcaaaaccctgtctctactaaaaagtaaaaaaaattagccgggcatggtggcttgtgccttgtagtcccagccactggggaggctgaggcgggagaattgcttgaacctgggaggtggagattgcagtgagccgagatcgcgccactgcactccagcctgggtgacagagcgagactccgtctcaaaaaaaaaaaaaaagccttaatattaatgctaacgtggcagaaaactagcaggttacattttataggctattgtagttttatttaccaaatgatattctctaaatcacttcgaccaataaatgtattctcctccttaaagcagagttgtatcaactctgtgggagcatttatgagctgtcagtccccacacttctagccagaatcacaataaggtctggctgggtgtggggtgctgcataggaaagggtctctggagaagcaagaagggcacaatcatggcccactgctcccctcttcttctcagtgctctttgccctctcctgctgcgtgcttcctcttcactccagtgctgatcctcctgctctctctggcagcttccacctcacccgcccctcttccacactataaccagtatggttggtgctggggcattgactcagcccccctgctttctgcatttgtaatagatattaatatgatttcctaaaacagaagattttgttgctttctttgaacttgtattgaaaaccatacagtctcactgttttgctttaattcctatccacactataaatggaagaaaaaaattaatagcttctgtttaatctgatgaatgtggctttttttcccttcactttaatgttcaagaagttgtggctatttcatagatttcttctgatttattctgtgggtccctgttatctgttctttatgtaatctttcagtagattttcatcctttcatatccacattcttatgtggacttgctgaagaaacagaatatcagttcaaaacaaaacctaggccaggcatggtggttcacgcctataatctcagcactttgggaagccaaggcggtcaggagtttgagaccagcctgaccaacatgatgaaaccctgtctctactaaaaatacaaaaattagcctggcgtggtggcacgcatctgtaatcccaactactcaggacgctgaggcaggagagtcgcttgaacccaggaggcggagattgcagtgagccaagattgcaccactgcactccagcctgggcaacagagcgagactccatcaaaaaaaaaaaaaaaaaagaaggaaggaaggaaagcaagccctgaatccacatctccttgaagttttttttgttttattttgtttttgagacagaattttgctcttgttgcccaggccggagtgcaatggtgcaatctcagctcactgcaacctccgcctcccgggttgaggcgattctcctacctcagcctcccaagtagctaggattacaggcatgagccaccacgcctggctaattttatatttctagtagagatgaggtttctccatgttggtcaggctggtctcaaactcccgacctcaggtgatccacccacctcagcctcccaaagtggtgggattacaggcatgagccaccgtgccgagccttccttgaagttttttgtttggttttgatttgttttgttttgttttgttttgttttgtttttggagatagggtctcactctgttacccatgctggagtgcagtggcacaatcttggctcagagcaacctctgcctcccaggctcaagcaatcctcccacttcagtctaagtagctgggactacaggcacgtgccaccaggcccagctaatttttgtgttttgttagagatgaggttttgccatattgcccaggctcgtcttgaacaccggggctcaaggaatctgcccatcttcgcctcccaaagttctgagatagcaggtgtgagtcatcatgcccagcctccttgaagtttactaacaattgggataactgagggaagagaagtgacaattccactcagtctattagaggtctggatataaggtagccacacaataactctaacttgacttctaaccattctatcttattgatttggaggctgtcttctgccagattttttgtggcttgagatgatattttcgaacccttctttcactacctttcttacccttaatgtgccaagcttgaaacaggatttgatttcctgagctacttgttcgccttctgtgcgtcaccaagtaatctggttcatctttcgtctcattcatgttattttcaagtgaaacaagacattttgggggtcaagtctctttgggtgttttgtttttatgtatataaaaatggattttgtgttccctttccatgtaagtaccaacttatatggaaactcacaatcataatgtaaagaagaaatgaaagcctggtgtattgtacttcaagatgcctccctgatgtatagaatctccttgtaaaataaataattgcattgtatatcagtcttcccatcaatattaattattaaatattttagaatttttaaataccaactata

SEQ ID NO: 5592 - DNA, 1816 bp, Homo sapiens
cttccccacttcttacactccaaactcagccgggacagacctctgctgccgccgcccccacgaacgtgtgacgacggctggaggccaacagagtccctacaggtggtgctcacggtaatgcaccgacaatgagtggctgttttccagtttctggcctccgctgcctatctagggacggcaggatggccgcgcagggcgcgccgcgcttcctcctgaccttcgacttcgacgagactatcgtggacgaaaacagcgacgattcgatcgtgcgcgccgcgccgggccagcggctcccggagagcctgcgagccacctaccgcgagggcttctacaacgagtacatgcagcgcgtcttcaagtacctgggcgagcagggcgtgcggccgcgggacctgagcgccatctacgaagccatccctttgtcgccaggcatgagcgacctgctgcagtttgtggcaaaacagggcgcctgcttcgaggtgattctcatctccgatgccaacacctttggcgtggagagctcgctgcgcgccgccggccaccacagcctgttccgccgcatcctcagcaacccgtcggggccggatgcgcggggactgctggctctgcggccgttccacacacacagctgcgcgcgctgccccgccaacatgtgcaagcacaaggtgctcagcgactacctgcgcgagcgggcccacgacggcgtgcacttcgagcgcctcttctacgtgggcgacggcgccaacgacttctgccccatggggctgctggcgggcggcgacgtggccttcccgcgccgcggctaccccatgcaccgcctcattcaggaggcccagaaggccgagcccagctcgttccgcgccagcgtggtgccctgggaaacggctgcagatgtgcgcctccacctgcaacaggtgctgaagtcgtgctgagtctggccgcctgcaggggggtacccgggccaacggcggagggggcggggaagggagattcggcaaagacagctttactactcccttttccctttggctttgttatgtccctctgggaatttctggaatctcgtatttgggggcttggggaagggggctcagagccgtccctatctattcagttaacccacctcggctgcctcccccactccactgtgcacggttgagttctggagtctgacccatcgcggggtggcgcgcaaaccttggaaggcagcagtatttcctggtcctcccaactgggaggaaggggcccccccggcaggtgagagaaggaacatctcccgccgctgtaacttgttgcctcgggctgcgtgaccgcccctcctccagtctactgtggagggaacccaggatcctgaaattctcctggccgcaagaactccccacagaggcagaagagggtctccacctatggccccaggcctttgcgatcttgcttcacccaccgcgaccccacactatttctgtgctgtccacactctcttgcctcccgacccccgcactcccttctagcacccccaaaggaaaagccagaggaacaatcgcctcctggtggtggtacgaggtagcgcaccgtccggctcgggtccggacagccagtaacctcgcagagagtgacggtgtctccttgcatcccagcctcgtctatgcagcaagagaccagggacttcaccaaagtcaccctcgcgggctgggccttccacgcatcccccccaccccccatggaacagaaagccatgtttttaagcagaaccagcgaaacccaagcccctccttcctctggtgttttacaactataaaggaggtgaagggggaagaaa

SEQ ID NO: 5593 - DNA, 2173 bp, Homo sapiens
gcggctccggctccggctccggctcccgggcatttaaaggggacgcggcggctgcccgggggggatgaggggcaagtggaggggacggctcagacgcacatcatcctcagtccctcgggactggagggactcgtgagccggagcccagaaatccgggggtggataagacaccgcgtcccctccaattcccgtaagcaccccttgctccatcctgcgccccaatacctcagctagcccccttccccacttcttacactccaaactcagccgggacagacctctgctgccgccgcccccacgaacgtgtgacgacggctggaggccaacagagtccctacaggtggtgctcacggtaatgcaccgacaatgagtggctgttttccagtttctggcctccgctgcctatctagggtgttggatgtgccagcgcctctggccgtggcccgctaaccagcctctcccgggcgggctcctgccgcgccccctctcgcttgccccctcctcctcctcctcctgctgctctcccccctgctcccaggacggcaggatggccgcgcagggcgcgccgcgcttcctcctgaccttcgacttcgacgagactatcgtggacgaaaacagcgacgattcgatcgtgcgcgccgcgccgggccagcggctcccggagagcctgcgagccacctaccgcgagggcttctacaacgagtacatgcagcgcgtcttcaagtacctgggcgagcagggcgtgcggccgcgggacctgagcgccatctacgaagccatccctttgtcgccaggcatgagcgacctgctgcagtttgtggcaaaacagggcgcctgcttcgaggtgattctcatctccgatgccaacacctttggcgtggagagctcgctgcgcgccgccggccaccacagcctgttccgccgcatcctcagcaacccgtcggggccggatgcgcggggactgctggctctgcggccgttccacacacacagctgcgcgcgctgccccgccaacatgtgcaagcacaaggtgctcagcgactacctgcgcgagcgggcccacgacggcgtgcacttcgagcgcctcttctacgtgggcgacggcgccaacgacttctgccccatggggctgctggcgggcggcgacgtggccttcccgcgccgcggctaccccatgcaccgcctcattcaggaggcccagaaggccgagcccagctcgttccgcgccagcgtggtgccctgggaaacggctgcagatgtgcgcctccacctgcaacaggtgctgaagtcgtgctgagtctggccgcctgcaggggggtacccgggccaacggcggagggggcggggaagggagattcggcaaagacagctttactactcccttttccctttggctttgttatgtccctctgggaatttctggaatctcgtatttgggggcttggggaagggggctcagagccgtccctatctattcagttaacccacctcggctgcctcccccactccactgtgcacggttgagttctggagtctgacccatcgcggggtggcgcgcaaaccttggaaggcagcagtatttcctggtcctcccaactgggaggaaggggcccccccggcaggtgagagaaggaacatctcccgccgctgtaacttgttgcctcgggctgcgtgaccgcccctcctccagtctactgtggagggaacccaggatcctgaaattctcctggccgcaagaactccccacagaggcagaagagggtctccacctatggccccaggcctttgcgatcttgcttcacccaccgcgaccccacactatttctgtgctgtccacactctcttgcctcccgacccccgcactcccttctagcacccccaaaggaaaagccagaggaacaatcgcctcctggtggtggtacgaggtagcgcaccgtccggctcgggtccggacagccagtaacctcgcagagagtgacggtgtctccttgcatcccagcctcgtctatgcagcaagagaccagggacttcaccaaagtcaccctcgcgggctgggccttccacgcatcccccccaccccccatggaacagaaagccatgtttttaagcagaaccagcgaaacccaagcccctccttcctctggtgttttacaactataaaggaggtgaaggg

SEQ ID NO: 5594 - DNA, 868 bp, Homo sapiens
gcggctccggctccggctccggctcccgggcatttaaaggggacgcggcggctgcccgggggggatgaggggcaagtggaggggacggctcagacgcacatcatcctcagtccctcgggactggagggactcgtgagccggagcccagaaatccgggggtggataagacaccgcgtcccctccaattcccgaacgtgtgacgacggctggaggccaacagagtccctacaggtggtgctcacggtaatgcaccgacaatgagtggctgttttccagtttctggcctccgctgcctatctagggacggcaggatggccgcgcagggcgcgccgcgcttcctcctgaccttcgacttcgacgagactatcgtggacgaaaacagcgacgattcgatcgtgcgcgccgcgccgggccagcggctcccggagagcctgcgagccacctaccgcgagggcttctacaacgagtacatgcagcgcgtcttcaagtacctgggcgagcagggcgtgcggccgcgggacctgagcgccatctacgaagccatccctttgtcgccaggcatgagcgacctgctgcagtttgtggcaaaacagggcgcctgcttcgaggtgattctcatctccgatgccaacacctttggcgtggagagctcgctgcgcgccgccggccaccacagcctgttccgccgcatcctcagcaacccgtcggggccggatgcgcggggactgctggctctgcggccgttccacacacacagctgcgcgcgctgccccgccaacatgtgcaagcacaaggtgctcagcgactacctgcgcgagcgggcccacgacggcgtgcacttcgagcgcctcttctacgtgggcgacgg

SEQ ID NO: 5595 - DNA, 733 bp, Homo sapiens
cggctcccgggcatttaaaggggacgcggcggctgcccgggggggatgaggggcaagtggaggggacggctcagacgcacatcatcctcagtccctcgggactggagggactcgtgagccggagcccagaaatccgggggtggataagacaccgcgtcccctccaattcccgtaagcaccccttgctccatcctgcgccccaatacctcagctagcccccttccccacttcttacactccaaactcagccgggacagacctctgctgccgccgcccccacgaacgtgtgacgacggctggaggccaacagagtccctacaggtggtgctcacggtaatgcaccgacaatgagtggctgttttccagtttctggcctccgctgcctatctagggtgttggatgtgccagcgcctctggccgtggcccgctaaccagcctctcccgggcgggctcctgccgcgccccctctcgcttgccccctcctcctcctcctcctgctgctctcccccctgctcccaggacggcaggatggccgcgcagggcgcgccgcgcttcctcctgaccttcgacttcgacgagactatcgtggacgaaaacagcgacgattcgatcgtgcgcgccgcgccgggccagcggctcccggagagcctgcgagccacctaccgcgagggcttctacaacgagtacatgcagcgcgtcttcaagtacctgggcgagcagggcgtgcggccgc

SEQ ID NO: 5596 - DNA, 1587 bp, Homo sapiens
caggaacgtgtgacgacggctggaggccaacagagtccctacaggtggtgctcacggtaatgcaccgacaatgagtggctgttttccagtttctggcctccgctgcctatctagggtgttggatgtgccagcgcctctggccgtggcccgctaaccagcctctcccgggcgggctcctgccgcgccccctctcgcttgccccctcctcctcctcctcctgctgctctcccccctgctcccaggacggcaggatggccgcgcagggcgcgccgcgcttcctcctgaccttcgacttcgacgagactatcgtggacgaaaacagcgacgattcgatcgtgcgcgccgcgccgggccagcggctcccggagagcctgcgagccacctaccgcgagggcttctacaacgagtacatgcagcgcgtcttcaagtacctgggcgagcagggcgtgcggccgcgggacctgagcgccatctacgaagccatccctttgtcgccaggcatgagcgacctgctgcagtttgtggcaaaacagggcgcctgcttcgaggtgattctcatctccgatgccaacacctttggcgtggagagctcgctgcgcgccgccggccaccacagcctgttccgccgcatcctcagcaacccgtcggggccggatgcgcggggactgctggctctgcggccgttccacacacacagctgcgcgcgctgccccgccaacatgtgcaagcacaaggtgctcagcgactacctgcgcgagcgggcccacgacggcgtgcacttcgagcgcctcttctacgtgggcgacggcgccaacgacttctgccccatggggctgctggcgggcggcgacgtggccttcccgcgccgcggctaccccatgcaccgcctcattcaggaggcccagaaggccgagcccagctcgttccgcgccagcgtggtgccctgggaaacggctgcagatgtgcgcctccacctgcaacaggtgctgaagtcgtgctgagtctggccgcctgcaggggggtacccgggccaacggcggagggggcggggaagggagattcggcaaagacagctttactactcccttttccctttggctttgttatgtccctctgggaatttctggaatctcgtatttgggggcttggggaagggggctcagagccgtccctatctattcagttaacccacctcggctgcctcccccactccactgtgcacggttgagttctggagtctgacccatcgcggggtggcgcgcaaaccttggaaggcagcagtatttcctggtcctcccaactgggaggaaggggcccccccggcaggtgagagaaggaacatctcccgccgctgtaacttgttgcctcgggctgcgtgaccgcccctcctccagtctactgtggagggaacccaggatcctgaaattctcctggccgcaagaactccccacagaggcagaagagggtctccacctatggccccaggcctttgcgatcttgcttcacccaccgcgaccccacactatttctgtgctgtccacactctcttgcctcccgacccccgcactcccttctagcacccccaaa

SEQ ID NO: 5597 - DNA, 1125 bp, Homo sapiens
tgctgcagttggcggtcgggctagagaagagaggcgcctgcgcttgcgagctgggcttgtgagtggggctgccgagagggcaggcgtggggcgaggccaaaggactgaacccgcaggagcgtcacgggcgccggggcggctgccgacggcgggactgggttttctatcagatgttccacgtaataatgctggagttaagaagtttccattattttgctccaaaccagaagactctgttccctgtatatagaataggagtaatatttgaaaacaactggctgatgtttaaaactgaagattgtcatgattgtttatcctaatcccaatgctgaagtaagattgtcttggaaatactaagttggggtaatccaaatctatttctggaaccatgaaaattttgctagtttttgactttgacaatacaatcatagatgacaatagtgacacttggattgtacaatgtgctcccaacaaaaagcttcctattgaactacgtgattcttatcgaaaaggattttggacagaatttatgggcagagtctttaagtatttgggagataagggtgtaagagaacatgaaatgaaaagagcagtgacatcattgcctttcactccagggatggtggaactcttcaactttataagaaagaataaggataaatttgactgcattattatttcagattcaaattcggtcttcatagattgggttttagaagctgccagttttcatgacatatttgataaagtgtttacaaatccagcagcttttaatagcaatggtcatctcactgttgaaaattatcatactcattcttgcaatagatgcccaaagaatctttgcaaaaaggtagttttgatagaatttgtagataaacagttacaacagggagtgaattatacacaaattgtttatattggtgatggtggaaatgatgtctgtccagtcacctttttaaagaatgatgatgttgccatgccacggaaaggatataccttacagaaaactctttccagaatgtctcaaaatcttgagcctatggaatattctgttgtagtttggtcctcaggtgttgatataatttctcatttacaatttctaataaaggattaatatgtcagcaa

SEQ ID NO: 5598 - DNA, 908 bp, Homo sapiens
agttggcggtcgggctagagaagagaggcgcctgcgcttgcgagctgggcttgtgagtggggctgccgagagggcaggcgtggggcgaggccaaaggactgaacccgcaggagcgtcacgggcgccggggcggctgccgacggcgggactgggtcagtgagaagcccgtgggcccccgccctgcctgctactcccatccccacctgcgcgctccccatgggggacgacccccgattgggtccgatgcctaccctcggggtggagccggcaggttttctatcagatgttccacgtaataatgctggagttaagaagtttccattattttgctccaaaccagaagactctgttccctgtatatagaataggagtaatatttgaaaacaactggctgatgtttaaaactgaagattgtcatgattgtttatcctaatcccaatgctgaagtaagattgtcttggaaatactaagttggggtaatccaaatctatttctggaaccatgaaaattttgctagtttttgactttgacaatacaatcatagatgacaatagtgacacttggattgtacaatgtgctcccaacaaaaagcttcctattgaactacgtgattcttatcgaaaaggattttggacagaatttatgggcagagtctttaagtatttgggagataagggtgtaagagaacatgaaatgaaaagagcagtgacatcattgcctttcactccagggatggtggaactcttcaactttataagaaagaataaggataaatttgactgcattattatttcagattcaaattcggtcttcatagattgggttttagaagctgccagttttcatgacatatttgataaagtgtttacaaatccagcagcttttaatagcaatggtcatctcactgt

SEQ ID NO: 5599 - DNA, 468 bp, Homo sapiens
agttggcggtcgggctagagaagagaggcgcctgcgcttgcgagctgggcttgtgagtggggctgccgagagggcaggcgtggggcgaggccaaaggactgaacccgcaggagcgtcacgggcgccggggcggctgccgacggcgggactgggttttctatcagatgttccacgtaataatgctgggaaccagtcagaagcatctggattaggcatttagtgatacaaggatccagaataacaaaaactatgtaccagccacattcacacaacagggtaatccaaatctatttctggaaccatgaaaattttgctagtttttgactttgacaatacaatcatagatgacaatagtgacacttggattgtacaatgtgctcccaacaaaaagcttcctattgaactacgtgattcttatcgaaaaggattttggacagaatttatgggcagagtctttaagtatttggg

SEQ ID NO: 5600 - DNA, 631 bp, Homo sapiens
agagaagagaggcgcctgcgcttgcgagctgggcttgtgagtggggctgccgagagggcaggcgtggggcgaggccaaaggactgaacccgcaggagcgtcacgggcgccggggcggctgccgacggcgggactgggttttctatcagatgttccacgtaataatgctggagttaagaagtttccattattttgctccaaaccagaagactctgttccctgtatatagaataggagtaatatttgaaaacaactggctgatgtttaaaactgaagattgtcatgattgtttatcctaatcccaatgctgaagtaagattgtcttggaaatactaagttgggaaagtgaattctgcatttaaatttcagggaaccagtcagaagcatctggattaggcatttagtgatacaaggatccagaataacaaaaactatgtaccagccacattcacacaacagggtaatccaaatctatttctggaaccatgaaaattttgctagtttttgactttgacaatacaatcatagatgacaatagtgacacttggattgtacaatgtgctcccaacaaaaagcttcctattgaactacgtgattcttatcgaaaaggattttggacagaatttatgggc

SEQ ID NO: 5601 - DNA, 2147 bp, Homo sapiens
gttctgggtggcgtcctcgtccggcatgggccggggctggcaggctgcggggctcgcctgccgggagggtcgggctgcagaggctccgcgccctgccgtgggcgaccccgtctacctctggcggaggccccgcccggtcacgccgacctctccggtgcagccaccgcgctgagatctggagccacggcctccctgcttctccgtaaccaccagcaaccagcttgcccggctccggtccaggggttcccctggcctccgggcgagcgtccctgtagctatgacatggtgcattacggccactccaaccagctgcgccaggcacgggccatgggtgactacctcatcgtaggcgtgcacaccgatgctaaagagaaggggcacctgctccccaccactgccagcgaggctcccaagccttcaggggctgagcacctgctcgtcagaaggaatctctgcctttgcctgagaccctcgcagggaagagagccacccagttggccagcactagtgggctaagggccagggtagagagacagcctgcccccaccggccctcttgtgtggctacagctgggtgctgggaaggggcctcctactggaggggccgggtgggctggggtccccagtctccccgttgtccttttcctagaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgcttgccttccttcccggc

SEQ ID NO: 5602 - DNA, 3265 bp, Homo sapiens
agcgggtgaggcccgcgtgacggccgctgagcgtgcgcctggcggggcgggcggcggcgctcggagtcgccgggagctgccaggctgtccgcgccgccgctgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagccccctcacccgatacccgccggggacatactttcctcagaaggctgctcccagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgcttgccttccttcccggcagcttcgccactctccttatggactctgttctgtttgtacatggctgacggaaatctctttggtacaaccgaataaagcctggtggcagtgctgcgcggggctcccagccctgctgggaaggaccagggaaccactcagcaaggagaccctcttggccctgcccccaccatgcacccagcagccgggagtgcagcgggcagcctggcagtgagtgaaacccaggcctccagccctccaaagcctggggccaccccctgtagcaggcgatgctagaataaggaggagagccagagctgaggctccttgccccttggcccctccaggggccatgggatctctgtctcccacacccctgtcacggcccgcctggagcagcccagaggccgaagaggttcttactgcagcctccgggaggtgtctagggaggccatagattgcctggtctcgccgcattcaaaatgaggcttatgatcagtacttttttcagccccacattcctctccagaatggcctctgccctacagcacctggcccatgtggcaccccatgggcctgtcctctgctgttgtgaggtcgacctcacgacccagcacaggagctggaggcgaggtgcacgcgaggctctccacagcccaggaaggcagcctgtcaccctgctctccgagccaggggccaaggtgtggggggcacaggccatcctcatcctgccaggcccccgctttcaggagtggggtggtgccaatgctcccactcagaaccctggactgcggggtcccctgagcagagggaccagccagttccccatagacagattggtgctggacaggggctgcctgggccccaggcttggggagggtagaaaggccctgcagtgctgctgcctgggcccggaggtgggcctggccccgtagcagcattggaggccagagcccaagccagttccggagtcacacccaacggcggagggagaacctacccatctcccaccttcagctctggggaggcatgctctgggcctctggagccagggctcaggcccccaactctcctccttgcccctgcaccctcggacttggcctggccagaagggatgggggcaagaggaaggcagccaggggctccagcccatgccctcacagatttggctctcgagttggggagcgaagggctgggggaggacactgggaaccgggccagccgtggccctgcacttcccccagggagcaccaaggctaggcgcggcttcaccgcggggctgggtcgtggccagcttcgcccctgggtctgaagacctctgggcggcccaggccaaccttgccctgccgccgcacactcggctgccttctcatacccaggcttggggatttccaggtcccgttcccctcgtggcctggctgccagtcctccagcacccctcactccga

SEQ ID NO: 5603 - DNA, 3211 bp, Homo sapiens
agcgggtgaggcccgcgtgacggccgctgagcgtgcgcctggcggggcgggcggcggcgctcggagtcgccgggagctgccaggctgtccgcgccgccgctgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgcttgccttccttcccggcagcttcgccactctccttatggactctgttctgtttgtacatggctgacggaaatctctttggtacaaccgaataaagcctggtggcagtgctgcgcggggctcccagccctgctgggaaggaccagggaaccactcagcaaggagaccctcttggccctgcccccaccatgcacccagcagccgggagtgcagcgggcagcctggcagtgagtgaaacccaggcctccagccctccaaagcctggggccaccccctgtagcaggcgatgctagaataaggaggagagccagagctgaggctccttgccccttggcccctccaggggccatgggatctctgtctcccacacccctgtcacggcccgcctggagcagcccagaggccgaagaggttcttactgcagcctccgggaggtgtctagggaggccatagattgcctggtctcgccgcattcaaaatgaggcttatgatcagtacttttttcagccccacattcctctccagaatggcctctgccctacagcacctggcccatgtggcaccccatgggcctgtcctctgctgttgtgaggtcgacctcacgacccagcacaggagctggaggcgaggtgcacgcgaggctctccacagcccaggaaggcagcctgtcaccctgctctccgagccaggggccaaggtgtggggggcacaggccatcctcatcctgccaggcccccgctttcaggagtggggtggtgccaatgctcccactcagaaccctggactgcggggtcccctgagcagagggaccagccagttccccatagacagattggtgctggacaggggctgcctgggccccaggcttggggagggtagaaaggccctgcagtgctgctgcctgggcccggaggtgggcctggccccgtagcagcattggaggccagagcccaagccagttccggagtcacacccaacggcggagggagaacctacccatctcccaccttcagctctggggaggcatgctctgggcctctggagccagggctcaggcccccaactctcctccttgcccctgcaccctcggacttggcctggccagaagggatgggggcaagaggaaggcagccaggggctccagcccatgccctcacagatttggctctcgagttggggagcgaagggctgggggaggacactgggaaccgggccagccgtggccctgcacttcccccagggagcaccaaggctaggcgcggcttcaccgcggggctgggtcgtggccagcttcgcccctgggtctgaagacctctgggcggcccaggccaaccttgccctgccgccgcacactcggctgccttctcatacccaggcttggggatttccaggtcccgttcccctcgtggcctggctgccagtcctccagcacccctcactccga

SEQ ID NO: 5604 - DNA, 2255 bp, Homo sapiens
acgtagaccgtctgctgggggcgccggcaccatttggagtacgtgaggaagaaaaatgtctgaaaagcagatgaaggaagcttttgtcagtaacctcaatggaaccaccgtgctggaaatcacccagggattgtgctttcctgcattctgtatcctgtgcagagggttcctgatcattttctcacagtacttgtgttctttttcacctacctggaaaactagattcctcactgactttgttgtcctaatagttcccatggtagccactttgaccatttgggcttcatttatcctccttgagcttctcggtgtaattatctttggggcagggctgttgtatcaaatataccgaaggaggacctgctatgccagactgcctttcctaaaaatccttgaaaaattcttgaacatcagtctagaatcagaatacaatccagccatctcctgtttccgtgtaattaccagtgcgtttactgctattgctattttggctgtggacttcccactttttcccagaagatttgccaaaactgagctctatgggacaggagcaatggattttggagtaggtggctttgtttttgggtctgcaatggtttgtctagaggtcaggaggagaaaatatatggaagggtccaaattgcattactttacaaactcattgtactctgtttggccattagtcttcctaggaatcggacgattagccattataaaatcaataggctatcaggaacatttaacagagtatggagttcactggaactttttctttaccataatagttgtgaaattgataacaccactgctgttgattatttttcccctaaataagtcctggattattgccctcggcattactgtattataccagctagcccttgactttacctcactgaagaggttaatattatatggcactgatggtagtggcacacgggttggtctattaaatgccaaccgcgaaggaataatctctaccctggggtatgtggcaatacacatggctggtgtgcaaacagggttatatatgcataagaaccgatcacatatcaaagacttgataaaagtagcctgttttcttttactggcagctattagcctcttcatatctctttacgtagttcaagtaaatgtagaagcagtatctcgaagaatggcaaatttagccttttgtatttggatagttgcttctagcctgatccttcttagtagtttattactgggtgatataattttgagttttgccaaatttctaattaaaggagctctagtaccatgttcttggaaacttatccagtcacctgttacaaataaaaagcattcagaatctctagtccctgaagccgaaagaatggaacccagtctttgtttaatcacagctctaaacagaaaacagttaatatttttcttgctgtcaaatataacaactggcctgatcaacctgatggtagatacattacacagcagtaccttgtgggccttatttgtggtcaatctctatatgttttccaactgtttaattgtatatgtactatatttgcaagataagactgtacaattttggtgatcagcaggagtaggatatataagtatttgggcaatatttaatgaggaatattaattgtaaagaaattgtgcttttggcaacagtgttaaccatattttattataaaatagtttcagtcatctaaacagcagtgatgcttaattatttttttttttgagacagagtcttgctctgttacccaggctggagtgtagtggtgccatctcagctcactgcaacctccacctcccgggttcaagcaattctcctgcctcagcctcctgagtagctggcactgtaggcatgtaccaccatgcccagctaatttttatatttttagtagagatggggttttgccatattggccaggctggtctcaaactcctgaactcaagtgataacacccaccttggcctcccaaagtgctgggattacaggtgtgagccaccacactgggccaatgcttaatattttaatgtatctcaacaataaaaccaagaagaaacaaagccttttgacttgttagaatgtattaagtagtattttaaagaaactttatagttgtgacattgaaagactgttggggtggggggaggaaaatttttactttccatcttaatgtaaccttatgctattctgtatttttactgtatattgcttttacaataaatataaaatgaaatgtttatgttgacatttcagtgtg

SEQ ID NO: 5605 - DNA, 6182 bp, Homo sapiens
gttggaggcgcccggggccccagccgggcagagccgagcggcggcggcggcggcggcttcccttttctccccgagccgagccccggagcggcgcggggaccggccctaaaaagagcaggaaatcttgtttaccgcccgcggagagaagccgatcgagcctttgtctggaaagtcagcatctccggctccggctgcaatgtgttcctggtgacattagcatcgggcagacccgccggaggaggggggtcgccaggttcccgtctgctttcggaggcggatcgagcgggtgacttttgtgcattcgttttaatttttggaaatctctcttttttcctccctcgctcgctgccgggcatgtcctgatctggcggccgctcctaccaccctgggcagccgagcagagtcgtccccagcgggtctccctccctgcctccctgactttgcaacaccgcgttccgggaggaccggcctcggcgagggaggaggcgggggagctgcgaacacccagacccaaaccctgacatgctctggggcggagaggaggaagccaggagctgagcgcgccgcgggggctgcttcgccctccggctccgagcgccgggctccgggcgccctgccctgcgcctgggcagcagccttgctggtcttgggggcgccccccgcttcccgccccgggggtccgcggccggcaggaccatgctgctgaaagagtaccggatctgcatgccgctcaccgtagacgagtacaaaattggacagctgtacatgatcagcaaacacagccatgaacagagtgaccggggagaaggggtggaggtcgtccagaatgagccctttgaggaccctcaccatggcaatgggcagttcaccgagaagcgggtgtatctcaacagcaaactgcctagttgggctagagctgttgtccccaaaatattttatgtgacagagaaggcttggaactattatccctacacaattacagaatacacatgttcctttctgccgaaattctccattcatatagaaaccaagtatgaggacaacaaaggaagcaatgacaccattttcgacaatgaagccaaagacgtggagagagaagtttgctttattgatattgcctgcgatgaaattccagagcgctactacaaagaatctgaggatcctaagcacttcaagtcagagaagacaggacggggacagttgagggaaggctggagagatagtcatcagcctatcatgtgctcctacaagctggtgactgtgaagtttgaggtctgggggcttcagaccagagtggaacaatttgtacacaaggtggtccgagacattctgctgattggacatagacaggcttttgcatgggttgatgagtggtatgatatgacaatggatgatgttcgggaatacgagaaaaacatgcatgaacaaaccaacataaaagtttgcaatcagcattcctcccctgtggatgacatagagagtcatgcccaaacaagtacatgacaatggatgaagtccgagaatttgaacgagccactcaggaagccaccaacaagaaaatcggcattttcccacctgcaatttctatctccagcatccccctgctgccttcttccgtccgcagtgcgccttctagtgctccatccacccctctctccacagacgcacccgaatttctgtccgttcccaaagatcggccccggaaaaagtctgccccagaaactctcacacttccagaccctgagaaaaaagccaccctgaatttacccggcatgcactcttcagataagccatgtcggcccaaatctgagtaactttatataaatatctcatggggttttatattttcatttgttgttgttgtttttttttaagaatcttctgatagagaaaaagactgctttgtcactcaaacatgttccttcgacctttcagtgtgcatgtgactcagtaacttcacatagaatatgattccctaagtatgctacacagcatcatattagatgtaagatgtaagacttgcaaaggacagaaggaatcttctgtaaccacatagctgtatgccagagaggaagccttgttattgggcatttgatgaggtttggcatggacttcaaggataaatgaatgaaaactttgcaccacttttgttacaaggtacggtagaaaatagtgaagtcagtttcctctcatcaaatctaaaattctccaaaatactctcaggcataacatacttagctgttaaattttgaactgctaattactaatacttgaataccaatagttactgagattcctattttgtggttagtctgactcaggatttggagcctaattaactctaaacttttgaaaattttaatcatcaagctatagaggctccaagtgcaattaataataactcatttataccttccacagaatttaataaagattctacttgtttctgtcttttaataactttccccttttgtgcccttgtggcctcagaaatccttaagaattgcatggatgaatgtgaccataactgattttggaatggttcagtttaggaaccaagaggcccaggtgaggcaacatcttttttctctacaggtaccaacaaaccttgacttgtcagcttccatcatcaattaagattctcagaatttgcaattaattgaatagaattcatttactatctgcccactcaaagaagtacaagggtagagtaagctaactgggctttaacatggtcagaatgtctggtgcatgaactataaaaaagagaactgtctcccatccccttccttgttttactcttagtaacatccagaattccctggaacagattgcctaccaccagaccttagaaaagactgtcattctcttgctccttacttgaaatacaaatattgggaatgtcacagacatcaagcaactactgtcaagtgggaggagagaatgagcagaattgctgactcctatttgtagagtgaaaaggaggagtgataatagatgcccttctgtctagctttcctttcttcaactagtggtaatgcaagattagaatcaaggttgacaggaggcaaggtcactcactgaagtgacagaaagacaattctcctttgctccaaagagagaaatctgtcacctttgcacctcactgcctttaaacacagacgggagggcaggccaaatctcagcattgacttttgtcctccaagagaggaagagaagaagtaattgggcaacttggaggcccacgccccagctagccttcctgatcgtaacctccaacctcaggaaagggaccttcccaaaacacagatcccaaaggaaacaaaatagaccaaggagcataatctgcttctctcacacagcctctctgccagtggaccctgcctgcttccctctcagtgctcagcactctgtgtagtgtctttcaggttgatacactctcccaaggtgcaggcgctggccccatgagcccagcaccaaagttttctaagtcataggtcagactgtcaagatcatttctttatctataggttgatatttagcttaaaaaaaaagaataaacctagaactcaaaggaaacctgttgcaaatagcttagatcaacagtgtatctcttccctaagaatgatagtatcttagtaagacaccttctatgcatggtatggaagcatgatttttgcttgtgggaaaacctaatattttatcagacccctcggacttctcaatccctccctctccacacagtagtacttaatgaaaatgttttgctttagagagcaaaatgctactttcagaagacactgaaatagtatatgtatttgcttaccatttgcaagctaaaatcaaggtgggatggggtcattattttcacatagaatgtatttattttgtgcaggctgttaaacacatctggcacctagtttttccattaagagcattgctattttccctttttataaagtagcttctgctgtcaaggttaacaattctatatgctttaggaagctaagttctaatttccttttgtgagtttcatttcttttataaccagtatgttaccacagacatcagttgcaaagctacgatgatagtgtgattcttagccgaaaaaaaagcgtgtgctcttaaagtatgttcagtttttctgtctacatatgctttgtgtgagttaaaaagggggtgggtggtgtaaatattcctttagctgctttgcatatttaacccagtcatcaaaaggcataaatgacttcaatattttatatatcttggttttcaagtatcatttcacattctctatacatgactttgttattgtggaatacaagcctgcaatggatgtatatatacagaacattaataattcttagaaggatggaagccaaatggctgcatgatggaaattagaagaaaaaaaaagcagaaacttgaatttgctaagcatgtttggggggaaatagaatccttaactcagtgcctctgtctgcgatatggaaaccttcaactttgttcaccaaaattgtattatacctgtgtatatatatatatatatatatatataaatataaatatagtatagtgaatcagacaccatcagttttaagtctctggtagccaaacttaaataaataatccatagaatatcacatacgttcactccatcttcatctctgaagttagtggagaccatcaaaatgactgtacatttcataactctgggaagatttcaaatgtgaagtgcccctgtgcattttcttggccatagcacggcattcttgctttagctgtgctttcctgggatgagaagatcttggtgtatttaacacataagctttgttagaaatcacctctgaagatcatttcattttctcactttgggttgttgcaagacaaagcaaaggaaaaggaacacaatgaaggaggccgtgacatttttagttgccaccgttgtaactcaaacaatatgggtttgttggtgaactgatttatcaaggcttctgttacggttttgcatctgtgtgtgaggaaaattttaatttatttggaagtatttattagccatgttgttggtcctgaaaataaatctctaagtagcacagttgtgggtatattatgcagacacttaccacaatacctgcaaaagtaactgtggttttctttcaagacactgtaataaacagtgaactaagagaatagattctgatacatctcgataaatcattctctgcaaaagtttcagggctaatgtatttatgtgtatttttaaattctactttctttggcatctcttcatggctcagcgacaacaaagtaataggtcattggctggcttacgtcgataggaattttactcttaagaagggccagtgtatagctgactctacatataatgtgtaatcagataatccaatagagaggaattgtccaaatagttttagtacctttctgatcatctgactcagtaggctaggagacaatctgtcatctgagccatagttcttgagatttaaaaagtctgtccagtgactgcaatctgattatgaataaactattttaactattcattcttgctgaaactgaagtgtacacaatagcacactgttggcatgctgaggcaaaacattgggttcttttgtgttctaccttcaaaacaatctgtttgcatttgaaatataagtgtttaagctttttaggagttagtgtaataagagaatgtgaatatgttgggaaattttcagatgccattaataattgtaattttgttgttaaattaacaaggactttaggataagcctcttgatgttttttgctttaaattgaaagcatgtctgtcaaattgcaagtctcccttcagtttctatatatcacccaggagagggtctctgagttggtgttgtacctgtaccactcacatgtagctcaagtgtaatttgtagtgtttacattcaagctgggatcttgattggttaaattaatccacataccactgccactgctgaaggaccaggtgttggaatacacagcattacagactataagcaaagcaaacaaaagttgatccttacatatgccatccttctgtgtcattttgtggctgttctgtgtttttcttcctagttatttattattgttaataacttactttttcttacattctgttgtaaataaaatacaaagcaatcttc

SEQ ID NO: 5606 - DNA, 2106 bp, Homo sapiens
cgggcatgtcctgatctggcggccgctcctaccaccctgggcagccgagcagagtcgtccccagcgggtctccctccctgcctccctgactttgcaacaccgcgttccgggaggaccggcctcggcgagggaggaggcgggggagctgcgaacacccagacccaaaccctgacatgctctggggcggagaggaggaagccaggagctgagcgcgccgcgggggctgcttcgccctccggctccgagcgccgggctccgggcgccctgccctgcgcctgggcagcagccttgctggtcttgggggcgccccccgcttcccgccccgggggtccgcggccggcaggaccatgctgctgaaagagtaccggatctgcatgccgctcaccgtagacgagtacaaaattggacagctgtacatgatcagcaaacacagccatgaacagagtgaccggggagaaggggtggaggtcgtccagaatgagccctttgaggaccctcaccatggcaatgggcagttcaccgagaagcgggtgtatctcaacagcaaactgcctagttgggctagagctgttgtccccaaaatattttatgtgacagagaaggcttggaactattatccctacacaattacagaatataagtgttcctttctgccgaaattctccattcatatagaaaccaagtatgaggacaacaaaggaagcaatgacaccattttcgacaatgaagccaaagacgtggagagagaagtttgctttattgatattgcctgcgatgaaattccagagcgctactacaaagaatctgaggatcctaagcacttcaagtcagagaagacaggacggggacagttgagggaaggctggagagatagtcatcagcctatcatgtgctcctacaagctggtgactgtgaagtttgaggtctgggggcttcagaccagagtggaacaatttgtacacaaggtggtccgagacattctgctgattggacatagacaggcttttgcatgggttgatgagtggtatgatatgacaatggatgatgttcgggaatacgagaaaaacatgcatgaacaaaccaacataaaagtttgcaatcagcattcctcccctgtggatgacatagagagtcatgcccaaacaagtacatgacaatggatgaagtccgagaatttgaacgagccactcaggaagccaccaacaagaaaatcggcattttcccacctgcaatttctatctccagcatccccctgctgccttcttccgtccgcagtgcgccttctagtgctccatccacccctctctccacagacgcacccgaatttctgtccgttcccaaagatcggccccggaaaaagtctgccccagaaactctcacacttccagaccctgagaaaaaagccaccctgaatttacccggcatgcactcttcagataagccatgtcggcccaaatctgagtaactttatataaatatctcatggggttttatattttcatttgttgttgttgtttttttttaagaatcttctgatagagaaaaagactgctttgtcactcaaacatgttccttcgacctttcagtgtgcatgtgactcagtaacttcacatagaatatgattccctaagtatgctacacagcatcatattagatgtaagatgtaagacttgcaaaggacagaaggaatcttctgtaaccacatagctgtatgccagagaggaagccttgttattgggcatttgatgaggtttggcatggacttcaaggataaatgaatgaaaactttgcaccacttttgttacaaggtacggtagaaaatagtgaagtcagtttcctctcatcaaatctaaaattctccaaaatactctcaggcataacatacttagctgttaaattttgaactgctaattactaatacttgaataccaatagttactgagattcctattttgtggttagtctgactcaggatttggagcctaattaactctaaacttttgaaaattttaatcatcaagctatagaggctccaagtgcaattaataataactcatttataccttccacagaatttaataaagattctacttgtttctgtctttt

SEQ ID NO: 5607 - DNA, 1987 bp, Homo sapiens
cgggcatgtcctgatctggcggccgctcctaccaccctgggcagccgagcagagtcgtccccagcgggtctccctccctgcctccctgactttgcaacaccgcgttccgggaggaccggcctcggcgagggaggaggcgggggagctgcgaacacccagacccaaaccctgacatgctctggggcggagaggaggaagccaggagctgagcgcgccgcgggggctgcttcgccctccggctccgagcgccgggctccgggcgccctgccctgcgcctgggcagcagccttgctggtcttgggggcgccccccgcttcccgccccgggggtccgcggccggcaggaccatgctgctgaaagagtaccggatctgcatgccgctcaccgtagacgagtacaaaattggacagctgtacatgatcagcaaacacagccatgaacagagtgaccggggagaaggggtggaggtcgtccagaatgagccctttgaggaccctcaccatggcaatgggcagttcaccgagaagcgggtgtatctcaacagcaaactgcctagttgggctagagctgttgtccccaaaatattttatgtgacagagaaggcttggaactattatccctacacaattacagaatataagtgttcctttctgccgaaattctccattcatatagaaaccaagtatgaggacaacaaaggaagcaatgacaccattttcgacaatgaagccaaagacgtggagagagaagtttgctttattgatattgcctgcgatgaaattccagagcgctactacaaagaatctgaggatcctaagcacttcaagtcagagaagacaggacggggacagttgagggaaggctggagagatagtcatcagcctatcatgtgctcctacaagctggtgactgtgaagtttgaggtctgggggcttcagaccagagtggaacaatttgtacacaaggtggtccgagacattctgctgattggacatagacaggcttttgcatgggttgatgagtggtatgacatgacaatggatgaagtccgagaatttgaacgagccactcaggaagccaccaacaagaaaatcggcattttcccacctgcaatttctatctccagcatccccctgctgccttcttccgtccgcagtgcgccttctagtgctccatccacccctctctccacagacgcacccgaatttctgtccgttcccaaagatcggccccggaaaaagtctgccccagaaactctcacacttccagaccctgagaaaaaagccaccctgaatttacccggcatgcactcttcagataagccatgtcggcccaaatctgagtaactttatataaatatctcatggggttttatattttcatttgttgttgttgtttttttttaagaatcttctgatagagaaaaagactgctttgtcactcaaacatgttccttcgacctttcagtgtgcatgtgactcagtaacttcacatagaatatgattccctaagtatgctacacagcatcatattagatgtaagatgtaagacttgcaaaggacagaaggaatcttctgtaaccacatagctgtatgccagagaggaagccttgttattgggcatttgatgaggtttggcatggacttcaaggataaatgaatgaaaactttgcaccacttttgttacaaggtacggtagaaaatagtgaagtcagtttcctctcatcaaatctaaaattctccaaaatactctcaggcataacatacttagctgttaaattttgaactgctaattactaatacttgaataccaatagttactgagattcctattttgtggttagtctgactcaggatttggagcctaattaactctaaacttttgaaaattttaatcatcaagctatagaggctccaagtgcaattaataataactcatttataccttccacagaatttaataaagattctacttgtttctgtctttt

SEQ ID NO: 5608 - DNA, 1319 bp, Homo sapiens
ttcctacgacaaaagatacatcatcaagactattaccagtgaagacgtggccgaaatgcacaacatcctgaagaaataccaccagtacatagtggaatgtcatgggatcacccttcttccccagttcttgggcatgtaccggcttaatgttgatggagttgaaatatatgtgatagttacaagaaatgtattcagccaccgtttgtctgtgtataggaaatacgacttaaagatggccaatctaaaagccactttcacttttcccaagccaactggctctacagtggctagagaagctagtgacaaagaaaaggccaaagaactgccaactctgaaagataatgatttcattaatgagggccaaaagatttatattgatgacaacaacaagaaggtcttcctggaaaaactaaaaaaggatgttgagtttctggcccagctgaagctcatggactacagtctgctggtgggaattcatgatgtggagagagccgaacaggaggaagtggagtgtgaggagaacgatggggaggaggagggcgagagcgatggcacccacccggtgggaacccccccagatagccccgggaatacactgaacagctcaccacccctggctcccggggagttcgatccgaacatcgacgtctatggaattaagtgccatgaaaactcgcctaggaaggaggtgtacttcatggcaattattgacatccttactcattatgatgcaaaaaagaaagctgcccatgctgcaaaaactgttaaacatggcgctggcgcggagatctccaccgtgaacccagaacagtattcaaagcgctttttggactttattggccacatcttgacgtaacctcctgcgcagcctcggacagacatgaacattggatggacagaggtggcttcggtgtaggaaaaatgaaaaccaaactcagtgaagtactcatcttgcaggaagcaaacctccttgtttacatcttcaggccaagatgactgatttgggggctactcgctttacagctacctgattttcccagcatcgttctagctatttctgactttgtgtatatgtgtgtgtgtgtgtgttgggggggggtgagtgtgtgcgcgcgtgtgcattttaaaagtcataaattaattaaaacagatccacttcggtcagtatgtgtcccaacaaagaccctttgattccagctatggccgaatgaatgagtgagtgagtgagtgagtgaatgaacacacgtgtgggggaggggagaaggaagtgcatgatgtcaggcaccgtgttggcatcacacaacaaactgtggatcagt

SEQ ID NO: 5609 - DNA, 1040 bp, Homo sapiens
gcgggctgagcgcggatccgcggcgggcgcaggatacgggccggggcgcgagccgagcgcagtctgccgggccgagcgggcggagcgagccgagtggggctgagcgcgccggcggcggcgggcggagcggagcgcggcgcgccggggccgccgccggggggatgcggctgcctccccgggccggggtgtagagagggcgggtccccggcctcgggagcacggcggtggaggggacataggaggcggccatggcgacccccggcaacctagggtcctctgtcctggcgagcaagaccaagaccaagaagaagcacttcgtagcgcagaaagtgaagctgtttcgggccagcgacccgctgctcagcgtcctcatgtggggggtaaaccactcgatcaatgaactgagccatgttcaaatccctgttatgttgatgccagatgacttcaaagcctattcaaaaataaaggtggacaatcacctttttaacaaagaaaacatgccgagccatttcaagtttaaggaatactgcccgatggtcttccgtaacctgcgggagaggtttggaattgatgatcaagatttccagaattccctgaccaggagcgcacccctccccaacgactcccaggcccgcagtggagctcgttttcacacttcctacgacaaaagatacatcatcaagactattaccagtgaagacgtggccgaaatgcacaacatcctgaagaaataccaccagtacatagtggaatgtcatgggatcacccttcttccccagttcttgggcatgtaccggcttaatgttgatggagttgaaatatatgtgatagttacaagaaatgtattcagccaccgtttgtctgtgtataggaaatacgacttaaagggctctacagtggctagagaagctagtgacaaagaaaagtctcccacccctgctattgtggttcttcctgttccccattctgctgccaccagcgagaaacactgtattgacccgatgagagttctacttcatttctcttcatcaaattgttga

SEQ ID NO: 5610 - DNA, 3802 bp, Homo sapiens
gcggcgggcgcaggatacgggccggggcgcgagccgagcgcagtctgccgggccgagcgggcggagcgagccgagtggggctgagcgcgccggcggcggcgggcggagcggagcgcggcgcgccggggccgccgccggggggatgcggctgcctccccgggccggggtgtagagagggcgggtccccggcctcgggagcacggcggtggaggggacataggaggcggccatggcgacccccggcaacctagggtcctctgtcctggcgagcaagaccaagaccaagaagaagcacttcgtagcgcagaaagtgaagctgtttcgggccagcgacccgctgctcagcgtcctcatgtggggggtaaaccactcgatcaatgaactgagccatgttcaaatccctgttatgttgatgccagatgacttcaaagcctattcaaaaataaaggtggacaatcacctttttaacaaagaaaacatgccgagccatttcaagtttaaggaatactgcccgatggtcttccgtaacctgcgggagaggtttggaattgatgatcaagatttccagaattccctgaccaggagcgcacccctccccaacgactcccaggcccgcagtggagctcgttttcacacttcctacgacaaaagatacatcatcaagactattaccagtgaagacgtggccgaaatgcacaacatcctgaagaaataccaccagtacatagtggaatgtcatgggatcacccttcttccccagttcttgggcatgtaccggcttaatgttgatggagttgaaatatatgtgatagttacaagaaatgtattcagccaccgtttgtctgtgtataggaaatacgacttaaagggctctacagtggctagagaagctagtgacaaagaaaaggccaaagaactgccaactctgaaagataatgatttcattaatgagggccaaaagatttatattgatgacaacaacaagaaggtcttcctggaaaaactaaaaaaggatgttgagtttctggcccagctgaagctcatggactacagtctgctggtgggaattcatgatgtggagagagccgaacaggaggaagtggagtgtgaggagaacgatggggaggaggagggcgagagcgatggcacccacccggtgggaacccccccagatagccccgggaatacactgaacagctcaccacccctggctcccggggagttcgatccgaacatcgacgtctatggaattaagtgccatgaaaactcgcctaggaaggaggtgtacttcatggcaattattgacatccttactcattatgatgcaaaaaagaaagctgcccatgctgcaaaaactgttaaacatggcgctggcgcggagatctccaccgtgaacccagaacagtattcaaagcgctttttggactttattggccacatcttgacgtaacctcctgcgcagcctcggacagacatgaacattggatggacagaggtggcttcggtgtaggaaaaatgaaaaccaaactcagtgaagtactcatcttgcaggaagcaaacctccttgtttacatcttcaggccaagatgactgatttgggggctactcgctttacagctacctgattttcccagcatcgttctagctatttctgactttgtgtatatgtgtgtgtgtgtgtgttgggggggggtgagtgtgtgcgcgcgtgtgcattttaaaagtcataaattaattaaaacagatccacttcggtcagtatgtgtcccaacaaagaccctttgattccagctatggccgaatgaatgagtgagtgagtgagtgagtgaatgaacacacgtgtgggggaggggagaaggaagtgcatgatgtcaggcaccgtgttggcatcacacaacaaactgtggatcagttttttttttttttttttttttttggagttgaaagatgtgagacagtattcagaataatgaagataataatgatgattattataataatgatgatgattccaaggaaaaaacctacagcgaatgttccatttctaccccgcacgcagacactctccctaacactgataacctgagcccccagcactggacggaagaatgctggcgtctccgtgtgtactggttcagggttctggccccagccttgtcaggaccccctggtgtccagagcccccacccctcccgcaacaagcagctgatgccccagtgattctctatacatttttcacctcggccaatatgtccaggaaaactgcttacttctcttttcttgcctggagccttcattgttcacccttacgttgcaatataggaattaatgctacaaaataaaagtaaagcttacctgaaaagtgcatagtttggggcaatggtatctacatctcccactgtgggaaaaccagcaaagcatcaaaactctcaattctcctgttaccaaatgcagatctgaattataagatgtttatgtttgaccattgtttcaacaatgggattttgttacgaattatccctttaactgaaaccctcagttttactgtttacattattaggaaaacagggatatcttttgaatctaaaaatttgatgtacagcatgtgatttttgaagtttacatgtaaagtcacagtataggtgaaataacgtttgtcatattttgagacgtatcctgcagccatgtttttacgtgagtgttttagtcaaagtacatggtagacagtctttcacaataaaaggaaaaggatttttttttcctccaaatgtacatttatcaacctaatgattgatttttttaaaaagagatttcgccccagtctggtttatgaaagttcattgccctaaactgtgctgattgtttttaatcaagttataaatttccaacctagatcatgtatctaccaactctcctgcattttccaaaaggcattgagcttaaatattagtcttgcttagagtaggttatccacttacatgctgcgctaaagccatgcctttgaaactccttgtttaaaacatgatatgatttttgtgggcagtttcagaaaagaaaacaaacaaacaaaaatcgaccctttaattattacttgcaactcaacagatctccctgccgtactgccttttccaggaactttacttcagggctgtccagattgcagctgtgccccgtgtatgtggatctagttcacagagtctttggaagccagcagtcgtgccctccgtatactgtccactcattttatgtagatttggtatcctcagcagccagtgttaacaccactgtcacgtagtgtacagattcatcttttatgtatttaaagtaatccatactatgatttggtttttccctgcaccattaattctggcatcagatcagtttttgtgttgtgaagttctactgtggtttgacccaagaccacaaccatgagaccctgaagtaaagataaggtacacatacattatttgagtaactgtttccttgggggccaatctgtgtatgcttttagaagtttacagaatgcttttatttttgtctataacaaacagtctgtcatttatttctgttgataaaccatttggacagagtgaggacgtttgccctgttatctcctagtgctaacaatacactccagtcatgagccgggctttacaaataaagcacttttgatgactcacaagatgaatccttttttcctctgtcccaattgtgtgtctctgttccaaacacattttaaatactcggtcctgacagtgtctttagctaatccttgaagaaatgaaagtggaattgaatcttt

SEQ ID NO: 5611 - DNA, 768 bp, Homo sapiens
atcaatgaactgagccatgttcaaatccctgttatgttgatgccagatgacttcaaagcctattcaaaaataaaggtggacaatcacctttttaacaaagaaaacatgccgagccatttcaagtttaaggaatactgcccgatggtcttccgtaacctgcgggagaggtttggaattgatgatcaagatttccagaattccctgaccaggagcgcacccctccccaacgactcccaggcccgcagtggagctcgttttcacacttcctacgacaaaagatacatcatcaagactattaccagtgaagacgtggccgaaatgcacaacatcctgaagaaataccaccagtacatagtggaatgtcatgggatcacccttcttccccagttcttgggcatgtaccggcttaatgttgatggagttgaaatatatgtgatagttacaagaaatgtattcagccaccgtttgtctgtgtataggaaatacgacttaaagggctctacagtggctagagaagctagtgacaaagaaaagtctcccacccctgctattgtggttcttcctgttccccattctgctgccaccagcgagaaacactgtattgacccgatgagagttctacttcatttctcttcatcaaattgttgaatagtgaaacagttatttgttgcaagcatggttggaaggaacattccacatgcaacttgctcttgaaaaacacagccacctgtgcagtaaacctataatcgaaaatggcactgacagctg

SEQ ID NO: 5612 - DNA, 304 bp, Homo sapiens
atcaatgaactgagccatgttcaaatccctgttatgttgatgccagatgacttcaaagcctattcaaaaataaaggtggacaatcacctttttaacaaagaaaacatgccgagccatttcaagtttaaggaatactgcccgatggtcttccgtaacctgcgggagaggtttggaattgatgatcaagatttccaggtgagttgcgtttgtaacatttgcttccagtaggaaatgggttttgccatgacttttgctgtgtcaattgggatctgtatttttgtcaataaaagtattatataatagt

SEQ ID NO: 5613 - DNA, 1436 bp, Homo sapiens
gcagctgctgcggggcggggagccggagtcagccctggacctccggctgctcgcccgcctcgaagcccccagccccgcggcgcgtgcccccagccctctgggccgcccaggcaccaccacttgcgtcccctttagatctatggcccggtgcgggtcgggggtcccgtgtgcatatcaatgaactgagccatgttcaaatccctgttatgttgatgccagatgacttcaaagcctattcaaaaataaaggtggacaatcacctttttaacaaagaaaacatgccgagccatttcaagtttaaggaatactgcccgatggtcttccgtaacctgcgggagaggtttggaattgatgatcaagatttccagaattccctgaccaggagcgcacccctccccaacgactcccaggcccgcagtggagctcgttttcacacttcctacgacaaaagatacatcatcaagactattaccagtgaagacgtggccgaaatgcacaacatcctgaagaaataccaccagtacatagtggaatgtcatgggatcacccttcttccccagttcttgggcatgtaccggcttaatgttgatggagttgaaatatatgtgatagttacaagaaatgtattcagccaccgtttgtctgtgtataggaaatacgacttaaagggctctacagtggctagagaagctagtgacaaagaaaaggccaaagaactgccaactctgaaagataatgatttcattaatgagggccaaaagatttatattgatgacaacaacaagaaggtcttcctggaaaaactaaaaaaggatgttgagtttctggcccagctgaagctcatggactacagtctgctggtgggaattcatgatgtggagagagccgaacaggaggaagtggagtgtgaggagaacgatggggaggaggagggcgagagcgatggcacccacccggtgggaacccccccagatagccccgggaatacactgaacagctcaccacccctggctcccggggagttcgatccgaacatcgacgtctatggaattaagtgccatgaaaactcgcctaggaaggaggtgtacttcatggcaattattgacatccttactcattatgatgcaaaaaagaaagctgcccatgctgcaaaaactgttaaacatggcgctggcgcggagatctccaccgtgaacccagaacagtattcaaagcgctttttggactttattggccacatcttgacgtaacctcctgcgcagcctcggacagacatgaacattggatggacagaggtggcttcggtgtaggaaaaatgaaaaccaaactcagtgaagtactcatcttgcaggaagcaaacctccttgtttacatcttcaggccaagatgactgatttgggggctactcgctttacagctacctgattttcccagca

SEQ ID NO: 5614 - DNA, 5507 bp, Homo sapiens
gccttttccagctggctgcagagaaggggccagctccctcctggggacccggagccgcggtacaggtgtggttgcttctcttggagaaagaggctgagctgacatcccccgggctgataaagaatgggctcctcctcctgggcccagcaggctcccgggaccctccctccctccctccctccctccctccttccgggcagcagggaagatctgagttcatgtagctggtgttggcttagggtctgggaggaaggcttttgggaagatgtaaataagaacaaaatctgcagccacctgggaagcctggcctcagtgtggaagagaaggcagcaggattattacagaaccttgtgaagccaacgcgggcagccgccaggagctgcagaccgagaggatctcgtcctttcttgcggcccagggagaccaggcctttcattctgggctcgagaccaacaattcgaattccgaactccccctgcgtgtgggactcaaggttgcccagggctcacctctgatgggtgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctgcatcacgcgccctgtcgtgctgaaatggtccgtcacccaggcactggacgtcacagagcagctggatgccggggtgcggtacctggacctgcggatagcccacatgctggagggctcggagaagaacctgcactttgtccatatggtgtacacaacggcgctggtggaggacacactcacggaaatctcggagtggctggagcggcatccacgcgaggtggtcatcctggcctgcagaaacttcgaggggctgagcgaggacctgcacgagtacctggtcgcctgtatcaagaacatcttcggggacatgctgtgtcctcgtggggaggtgccgacactgcggcagctgtggtcccggggccaacaggtcatcgtctcctatgaagacgagagctccttgcgccggcaccacgagctgtggccaggagtcccctactggtggggaaacagggtgaagaccgaggccctcatccgatacctggagaccatgaagagctgcggccgcccaggagggttgttcgtggccggcatcaacctcacggagaacctgcagtacgttctggcgcacccgtccgagtccctggagaagatgacgctgcccaaccttccgcggctgagcgcgtgggtccgagagcagtgcccggggccgggttcacggtgcaccaacatcatcgcgggggacttcatcggcgcagacggcttcgtcagtgacgtcatcgcgctcaatcagaagctgctgtggtgctgacgggacccttctgaagttcgggacgcggcggctgcagtttcacccccgaatttccaagtattgtgactttgtttgggccaaatgttggtgatcataggaccgatgataatacgttttcattttctttaaaatagagatggggtggctgggcgtggtgacttcgcctgtcttcccagcactttgggaggccgaggtgggtggatcatgaggtcaggagcttgagagcagcctgaccaacatggtgaaatcccatctctactaaaaatacaaaacttagctgggtgtgtggcaggcgcctgtagtcccagttactcgggaggctcaggcaggagaactgcttgaagccgggagatggaggttgcattgagctgacatcgtgccactgcactccagtctgaatgatagaccgagactccatctcaaaagaaaaaaaaacagccgagtgtgcagtgactcacgcctgtcatcccagcactttgggaggcgaaggcgggtggaacatgaggtcaggagttcgagaccagcctgaccaacatggtgaaaccccgtctctattaaaaacacaaaaactacctgggtgcgtgatgggcacctgtagtgccagctactcaggaggctgaggcaggagaatggcgtgaacccgggaggtggaggttgcattgagctgagatcgtgccactgcactccagcctgggcgacagagcgagactccatctcaaaaaaaaaaaaaaaaaaaaagatggggtctctctatgttggccaggttggtcttgaactcctggcctcaagtgatcctcccacctcagcctcccagagtgctgggatgacagtcaagaaccaccatggcagcccataatatgttttcttatttctgtattctccttgctgtggcgtctggagcccttacagacccagggagacactatcctcccacagctcactaattactaaacacagtgacagcccacttaggagccggcctcccctgtcagccaacccctcagctagttctcacaccaagcctatagatatatatgtgtgtgtatatatgtgtgtttatgtgtctgtgtgtatatatgtgtatatatcggtgtgtatatatgtatgtatgtttatacatgtgtatatgtgtgtgtgtgtgtgtatatgtgtgtatgtgtgtatatatgtatatgtgtgcatatgtgtatacgtgtatgcatacatgtatatgtgtatgcatgtatatgtgtatgtgtacatgtatatgtgtttatacatgtatatgtgtgtatgcgtgtatacgtgtatgtatacatgtatatgtgtgtatgcgtgtatatacacacgtatacatatatacgtgcgtgtgtatgtgtatatatatatatgtgtatatatatattttttgaggagtctcactctgtcacccaggctggagtgcaacggcgagatctcggctcaccgcaacctccgcctccctggttcaagcaattctcctgcctccgcctcccgagtagctgggatgacaggcatgtgccaccacacccgactaatttcatatatttagtagagacggggtttctccgcgttggtcaggccgttctcaaacttctgacctcaggtgatctgcccgcctcgacctcccaaagtgctgggatgacaggcatgagccactgtgcccagccgccgatatttctttaaattatgtttagggacagggtctttttctgtcacccaggctggagggcagtggtacagtcatagctcactgcagcctcaacctcctgggctcaagcgatcctctcagctcagcctcccgtgtagctggggctccagggacacacccccactgctggctaatttttgtatttttggtagagtcagggtttcaccacatggcacagtctggtctcaaattcctgggctccagtgatcctcccaccttagcttccagagtggccaggatcacaggcaggcaccaccatgcccaggtaattttatttttttgtagagacgtggtctggctatgttgtccagggtggtctcaaactcctgggctcaactgatcctcccacctcaacctctgccatagccaggacctcaggtgtcagccaccacacccacagctaattttttttgtagagatggggtctggctctgttgctcaggctggtgtgtagtaggggcacagtcatagctcactgtaaccttcaacgcctgggctgaagcaattctcccgcctcagcttcccaagtaactgggagtataggtgtacaccaccatgcccagctaattatttagtagtagtaggaggagtattatgtttgagatggagtctcgctctgtcgcccaggctggagtgcagtggcgcagtctcagctcactgcaacctctgcctcccaggttcaagcaattcttgtgcctcagcctcctgagtagctgggattacaggcgcccgccaccgcgcctggctaacttttgtatttttagcagagatggggtttcaccatgttgcccaggctggtcttgaactcccgacctcaggtgatccatccgcattggcctcccaaagtgctgggatcacaggcgtgagccaccgcacctggcctcaagccagtatttccctggccctaaatcattcctggctgggtcccagcccagtagagccagccccccagcccggagtgctactgaagtgttcaaaagttgtcaatcctcagccgttccctagtcctgttgcccggttctgccgaagccccttgaaggctgtggcctgggctgttccctcattcattcctgcctcccgagccaaacccaggtatccgcttgtgccctgcgtggtgtggcagcgtcttctctcgggaagggtcaggagtaatttcttctttcagtggcctctctgtgctagtcccggtcacctccgtgaattaaagtcctacaggtacaagggagaccccccccccacggaaggcgcccccagtccgtgtgggagactcgcacaccggttttctgcacaggtttctttctgcctctgaagcgtgaacggtcctagtttcagacgcagatcctgcaaatacttttttttgtttttttgagatggattttccctcttgttgttcaggctggagtgcaatggcacgatctcagctcactgcaacctctgcctcccgggttcaagtgattctcctgcctcagcctcccgaggagctgagattacaggcgcgtgccaccgtgcctggttaattttgtatttgtatttttatttatgttttgagacggagtttcgctctcgttgccgaggctggagtgtagtagtgtgatcctggctcactgcaacctccacctcccgggttccagcaaattctcctgcctcagcctcccaagtagctgggattgcaggcgcccgccaccacgcccggataatttttgtgtgtttagcagagacggggtttcaccatgttggccaggctggtctcgatctcctgacctcaggtgatccacccgcctcggcctcccaaagtgctgggatgacaggcgtgagccaccgcgcccggcctatacctcattttctacatgtcgcttgttggagctgctggttcaagttcccagccagccaatggatgccagcaccatttttactcccctttcccaagcaaatcgtgcatttttgtctaacgagagacatcagtttctcaggatgatcctcaagaacgttatggagtccatgttgcaataggttctctttgggacctaatgactcattttccaaaaatccgcttctacttttggtacccggttgctacggtgaaatgaaggtgccccgcatccagaaagacgcactcctggaccacaaccggcggctacctcagccccacggctctgcaggatcagggctcgggcaggccccgcggagatgaagaatttgcagggagcctccctgacttccgtcggctgtgaatccttgtctgtcaggggcgtatccacaaaatcaccgaattcatacagatcgtttaaataaatgaacatcattaaagtcaaa

SEQ ID NO: 5615 - DNA, 1863 bp, Homo sapiens
aataagaacaaaatctgcagccacctgggaagcctggcctcagtgtggaagagaaggcagcaggattattacagaaccttgtgaagccaacgcgggcagccgccaggagctgcagaccgagaggatctcgtcctttcttgcggcccagggagaccaggcctttcattctgggctcgagaccaacaattcgaattccgaactccccctgcgtgtgggactcaaggttgcccagggctcacctctgatgggtgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctgcatcacgcgccctgtcgtgctgaaatggtccgtcacccaggcactggacgtcacagagcagctggatgccggggtgcggtacctggacctgcggatagcccacatgctggagggctcggagaagaacctgcactttgtccatatggtgtacacaacggcgctggtggaggacacactcacggaaatctcggagtggctggagcggcatccacgcgaggtggtcatcctggcctgcagaaacttcgaggggctgagcgaggacctgcacgagtacctggtcgcctgtatcaagaacatcttcggggacatgctgtgtcctcgtggggaggtgccgacactgcggcagctgtggtcccggggccaacaggtcatcgtctcctatgaagacgagagctccttgcgccggcaccacgagctgtggccaggagtcccctactggtggggaaacagggtgaagaccgaggccctcatccgatacctggagaccatgaagagctgcggccgcccaggagggttgttcgtggccggcatcaacctcacggagaacctgcagtacgttctggcgcacccgtccgagtccctggagaagatgacgctgcccaaccttccgcggctgagcgcgtgggtccgagagcagtgcccggggccgggttcacggtgcaccaacatcatcgcgggggacttcatcggcgcagacggcttcgtcagtgacgtcatcgcgctcaatcagaagctgctgtggtgctgacgggacccttctgaagttcgggacgcggcggctgcagtttcacccccgaatttccaagtattgtgactttgtttgggccaaatgttggtgatcataggaccgatgataatacgttttcattttctttaaagtgctgggatgacaggcgtgagccaccgcgcccggcctatacctcattttctacatgtcgcttgttggagctgctggttcaagttcccagccagccaatggatgccagcaccatttttactcccctttcccaagcaaatcgtgcatttttgtctaacgagagacatcagtttctcaggatgatcctcaagaacgttatggagtccatgttgcaataggttctctttgggacctaatgactcattttccaaaaatccgcttctacttttggtacccggttgctacggtgaaatgaaggtgccccgcatccagaaagacgcactcctggaccacaaccggcggctacctcagccccacggctctgcaggatcagggctcgggcaggccccgcggagatgaagaatttgcagggagcctccctgacttccgtcggctgtgaatccttgtctgtcaggggcgtatccacaaaatcaccgaattcatacagatcgtttaaataaatgaacatcattaaagtc

SEQ ID NO: 5616 - DNA, 5287 bp, Homo sapiens
gtgttttaggaagagtgtcccgcagagacccggcgggagctgccaggagctctgggattccagcggctggaagccacctgggaagcctggcctcagtgtggaagagaaggcagcaggattattacagaaccttgtgaagccaacgcgggcagccgccaggagctgcagaccgagaggatctcgtcctttcttgcggcccagggagaccaggcctttcattctgggctcgagaccaacaattcgaattccgaactccccctgcgtgtgggactcaaggttgcccagggctcacctctgatgggtgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctgcatcacgcgccctgtcgtgctgaaatggtccgtcacccaggcactggacgtcacagagcagctggatgccggggtgcggtacctggacctgcggatagcccacatgctggagggctcggagaagaacctgcactttgtccatatggtgtacacaacggcgctggtggaggacacactcacggaaatctcggagtggctggagcggcatccacgcgaggtggtcatcctggcctgcagaaacttcgaggggctgagcgaggacctgcacgagtacctggtcgcctgtatcaagaacatcttcggggacatgctgtgtcctcgtggggaggtgccgacactgcggcagctgtggtcccggggccaacaggtcatcgtctcctatgaagacgagagctccttgcgccggcaccacgagctgtggccaggagtcccctactggtggggaaacagggtgaagaccgaggccctcatccgatacctggagaccatgaagagctgcggccgcccaggagggttgttcgtggccggcatcaacctcacggagaacctgcagtacgttctggcgcacccgtccgagtccctggagaagatgacgctgcccaaccttccgcggctgagcgcgtgggtccgagagcagtgcccggggccgggttcacggtgcaccaacatcatcgcgggggacttcatcggcgcagacggcttcgtcagtgacgtcatcgcgctcaatcagaagctgctgtggtgctgacgggacccttctgaagttcgggacgcggcggctgcagtttcacccccgaatttccaagtattgtgactttgtttgggccaaatgttggtgatcataggaccgatgataatacgttttcattttctttaaaatagagatggggtggctgggcgtggtgacttcgcctgtcttcccagcactttgggaggccgaggtgggtggatcatgaggtcaggagcttgagagcagcctgaccaacatggtgaaatcccatctctactaaaaatacaaaacttagctgggtgtgtggcaggcgcctgtagtcccagttactcgggaggctcaggcaggagaactgcttgaagccgggagatggaggttgcattgagctgacatcgtgccactgcactccagtctgaatgatagaccgagactccatctcaaaagaaaaaaaaacagccgagtgtgcagtgactcacgcctgtcatcccagcactttgggaggcgaaggcgggtggaacatgaggtcaggagttcgagaccagcctgaccaacatggtgaaaccccgtctctattaaaaacacaaaaactacctgggtgcgtgatgggcacctgtagtgccagctactcaggaggctgaggcaggagaatggcgtgaacccgggaggtggaggttgcattgagctgagatcgtgccactgcactccagcctgggcgacagagcgagactccatctcaaaaaaaaaaaaaaaaaaaaagatggggtctctctatgttggccaggttggtcttgaactcctggcctcaagtgatcctcccacctcagcctcccagagtgctgggatgacagtcaagaaccaccatggcagcccataatatgttttcttatttctgtattctccttgctgtggcgtctggagcccttacagacccagggagacactatcctcccacagctcactaattactaaacacagtgacagcccacttaggagccggcctcccctgtcagccaacccctcagctagttctcacaccaagcctatagatatatatgtgtgtgtatatatgtgtgtttatgtgtctgtgtgtatatatgtgtatatatcggtgtgtatatatgtatgtatgtttatacatgtgtatatgtgtgtgtgtgtgtgtatatgtgtgtatgtgtgtatatatgtatatgtgtgcatatgtgtatacgtgtatgcatacatgtatatgtgtatgcatgtatatgtgtatgtgtacatgtatatgtgtttatacatgtatatgtgtgtatgcgtgtatacgtgtatgtatacatgtatatgtgtgtatgcgtgtatatacacacgtatacatatatacgtgcgtgtgtatgtgtatatatatatatgtgtatatatatattttttgaggagtctcactctgtcacccaggctggagtgcaacggcgagatctcggctcaccgcaacctccgcctccctggttcaagcaattctcctgcctccgcctcccgagtagctgggatgacaggcatgtgccaccacacccgactaatttcatatatttagtagagacggggtttctccgcgttggtcaggccgttctcaaacttctgacctcaggtgatctgcccgcctcgacctcccaaagtgctgggatgacaggcatgagccactgtgcccagccgccgatatttctttaaattatgtttagggacagggtctttttctgtcacccaggctggagggcagtggtacagtcatagctcactgcagcctcaacctcctgggctcaagcgatcctctcagctcagcctcccgtgtagctggggctccagggacacacccccactgctggctaatttttgtatttttggtagagtcagggtttcaccacatggcacagtctggtctcaaattcctgggctccagtgatcctcccaccttagcttccagagtggccaggatcacaggcaggcaccaccatgcccaggtaattttatttttttgtagagacgtggtctggctatgttgtccagggtggtctcaaactcctgggctcaactgatcctcccacctcaacctctgccatagccaggacctcaggtgtcagccaccacacccacagctaattttttttgtagagatggggtctggctctgttgctcaggctggtgtgtagtaggggcacagtcatagctcactgtaaccttcaacgcctgggctgaagcaattctcccgcctcagcttcccaagtaactgggagtataggtgtacaccaccatgcccagctaattatttagtagtagtaggaggagtattatgtttgagatggagtctcgctctgtcgcccaggctggagtgcagtggcgcagtctcagctcactgcaacctctgcctcccaggttcaagcaattcttgtgcctcagcctcctgagtagctgggattacaggcgcccgccaccgcgcctggctaacttttgtatttttagcagagatggggtttcaccatgttgcccaggctggtcttgaactcccgacctcaggtgatccatccgcattggcctcccaaagtgctgggatcacaggcgtgagccaccgcacctggcctcaagccagtatttccctggccctaaatcattcctggctgggtcccagcccagtagagccagccccccagcccggagtgctactgaagtgttcaaaagttgtcaatcctcagccgttccctagtcctgttgcccggttctgccgaagccccttgaaggctgtggcctgggctgttccctcattcattcctgcctcccgagccaaacccaggtatccgcttgtgccctgcgtggtgtggcagcgtcttctctcgggaagggtcaggagtaatttcttctttcagtggcctctctgtgctagtcccggtcacctccgtgaattaaagtcctacaggtacaagggagaccccccccccacggaaggcgcccccagtccgtgtgggagactcgcacaccggttttctgcacaggtttctttctgcctctgaagcgtgaacggtcctagtttcagacgcagatcctgcaaatacttttttttgtttttttgagatggattttccctcttgttgttcaggctggagtgcaatggcacgatctcagctcactgcaacctctgcctcccgggttcaagtgattctcctgcctcagcctcccgaggagctgagattacaggcgcgtgccaccgtgcctggttaattttgtatttgtatttttatttatgttttgagacggagtttcgctctcgttgccgaggctggagtgtagtagtgtgatcctggctcactgcaacctccacctcccgggttccagcaaattctcctgcctcagcctcccaagtagctgggattgcaggcgcccgccaccacgcccggataatttttgtgtgtttagcagagacggggtttcaccatgttggccaggctggtctcgatctcctgacctcaggtgatccacccgcctcggcctcccaaagtgctgggatgacaggcgtgagccaccgcgcccggcctatacctcattttctacatgtcgcttgttggagctgctggttcaagttcccagccagccaatggatgccagcaccatttttactcccctttcccaagcaaatcgtgcatttttgtctaacgagagacatcagtttctcaggatgatcctcaagaacgttatggagtccatgttgcaataggttctctttgggacctaatgactcattttccaaaaatccgcttctacttttggtacccggttgctacggtgaaatgaaggtgccccgcatccagaaagacgcactcctggaccacaaccggcggctacctcagccccacggctctgcaggatcagggctcgggcaggccccgcggagatgaagaatttgcagggagcctccctgacttccgtcggctgtgaatccttgtctgtcaggggcgtatccacaaaatcaccgaattcatacagatcgtttaaataaatgaacatcattaaagtc

SEQ ID NO: 5617 - DNA, 579 bp, Homo sapiens
accccagttccgtaatatgcaaatgttgcccagggctcacctctgatgggtgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctgcatcacgcgccctgtcgtgctgaaatggtccgtcacccaggcactggacgtcacagagcagctggatgccggggtgcggtacctggacctgcggatagcccacatgctggagggctcggagaagaacctgcactttgtccatatggtgtacacaacggcgctggtggaggacacactcacggaaatctcggagtggctggagcggcatccacgcgaggtggtcatcctggcctgcagaaacttcgaggggctgagcgaggacctgcacgagtacctggtcgcctgtatcaagaacatcttcggggacatg

SEQ ID NO: 5618 - DNA, 469 bp, Homo sapiens
cttttccagctggctgcagagaaggggccagctccctcctggggacccggagccgcggtacagccacctgggaagcctggcctcagtgtggaagagaaggcagcaggattattacagaaccttgtgaagccaacgcgggcagccgccaggagctgcagaccgagaggatctcgtcctttcttgcggcccagggagaccaggcctttcattctgggctcgagaccaacaattcgaattccgaactccccctgcgtgtgggactcaaggttgcccagggctcacctctgatgggtgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacga

SEQ ID NO: 5619 - DNA, 587 bp, Homo sapiens
ggcgggagctgccaggagctctgggattccagcggctggaaggttgcccagggctcacctctgatgggtgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctgcatcacgcgccctgtcgtgctgaaatggtccgtcacccaggcactggacgtcacagagcagctggatgccggggtgcggtacctggacctgcggatagcccacatgctggagggctcggagaagaacctgcactttgtccatatggtgtacacaacggcgctggtggaggacacactcacggaaatctcggagtggctggagcggcatccacgcgaggtggtcatcctggcctgcagaaacttcgaggggctgagcgaggacctgcacgagtacctggtcgcctgtatcaagaacatctt

SEQ ID NO: 5620 - DNA, 284 bp, Homo sapiens
gtggctcacgcctgtaatcccagcaccgcggaggttgcggttgcccagggctcacctctgatgggtgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctg

SEQ ID NO: 5621 - DNA, 555 bp, Homo sapiens
gaagggaggccgtgcagggggaggggaggccgtgcagggggagggggggccgtgcaggcggagggggccacctgggaagcctggcctcagtgtggaagagaaggcagcaggattattacagaaccttgtgaagccaacgcgggcagccgccaggagctgcagaccgagaggatctcgtcctttcttgcggcccagggagaccaggcctttcattctgggctcgagaccaacaattcgaattccgaactccccctgcgtgtgggactcaaggttgcccagggctcacctctgatgggtgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctgcatcacgcgccctgtcgtgctgaaatggtccgtcacccag

SEQ ID NO: 5622 - DNA, 587 bp, Homo sapiens
atatgcaaatgtagggcgccatgatgttccacacgcctgagggttgcccagggctcacctctgatgggtgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctgcatcacgcgccctgtcgtgctgaaatggtccgtcacccaggcactggacgtcacagagcagctggatgccggggtgcggtacctggacctgcggatagcccacatgctggagggctcggagaagaacctgcactttgtccatatggtgtacacaacggcgctggtggaggacacactcacggaaatctcggagtggctggagcggcatccacgcgaggtggtcatcctggcctgcagaaacttcgaggggctgagcgaggacctgcacgagtacctggtcgcctgtatcaagaacatctt

SEQ ID NO: 5623 - DNA, 828 bp, Homo sapiens
gggctggaccagctaaaggctcgcatttgcatattaaaggttgccaagccgggtctaagagccagggctttcacgctagacaagaaacattttttggagctgcaaaaaatgcttccaaggaccccttttcctctctctctctctcttttttttttttcttttttggatatggagtttcactcttgttgcccagcctggagtgcagtggcgggatctccgctcactgtaacctccacctcccgggttcaagcgattctcctgcctcagcctcccgagtagctgggatgacaggtgccacaggtgcccaccaccacgcccagctaatttttgtatttttagtagagatggggttttgtcaagttggccaggctggtctcgaactcctgacctgaagtcaccgtaaaaaacctcttttcctcttctccttcctcaggttgcccagggctcacctctgatgggtgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttcgcacgaggagtcccggctgctgcagctgctgaacaaggccttgccctgcatcacgcgccctgtcgtgctgaaatggtccgtcacccaggcactggacgtcacagagcagctggatgccggggtgcggtacctggacctgcggatagcccacatgctggagggctcggagaagaacctgcactttgtccatatggtgta

SEQ ID NO: 5624 - DNA, 2063 bp, Homo sapiens
gctgggagtcctggtgccgccggctgcacttctgtgtgtctttcaggaagccacagggcagggggcgtctgtgcagagaagcgggggagtgagtagcaggcaggcccagcttgtgtaccagcccagtgacatatatagaaacataaatcaggctagagccggcgcgcccgggcgcgcacctgtgtatggacccgcaggcatgtctgtacactgggtgggcacctgtcttgtgagtggctccgggtgtggctgctcctcggactttcagtttatgtaagatttatctctaggggcctaccttcccccatctccagaggggaacataagaagtttaacggagctgggactgagcagattaagggagtggagcggaggctgggccggagagagtggggactgtgagtgctagtgggtaaggatccatctgtttgccccgtcccccagccagaaaggcattttggaaagactggcgtggcaagcgtcgccctgaaacgtccacagagcccaagaagtgatgatcactgagtgagtggcactgggctgagactggccagtttgttaacaacagggatgctagcagttaggaaggccaggaggaaactcaggatggggaccatctgctcccccaaccccagcgggacaaagacatcatcggaggtctgcaatgccgactggatggcctcgctcccccctcacctccacaacctccccctttccaatctggcaatcccaggctcacatgattcattcagctactgggtggatgaaaagtccccagtggggcctgaccaaacccaagctatcaaacgcctcgccaggatctccttggtgaagaagctaatgaagaagtggtctgtgactcagaacctgacatttcgagaacagctggaagctgggatccgctactttgacctgcgtgtgtcttccaaaccaggggatgccgaccaggagatctacttcatccatgggctttttggcatcaaggtctgggatgggctgatggaaattgactcgtttcttacacagcacccccaggagattatcttcctggatttcaaccacttctatgccatggatgagacccatcacaaatgcctggttctgcggatccaggaggcctttggaaacaagctgtgcccagcctgcagtgtggaaagtttgacgctgcgaactctgtgggagaagaactgccaggttcttattttctaccactgtcccttctacaagcagtaccccttcctgtggccaggaaagaagattccagcgccctgggcaaacaccacaagtgtgcgcaaactaatcctcttcttggagaccactctgagtgagcgggcctcacggggctccttccatgtctcccaagcgatcctcacccccagagtgaagaccattgcccggggcttggttgggggcctcaagaacacgctggttcataggctggcactgatcccagtttatcctttgagattcagcagaagatcctgatggaggaggaggataccaagagagaggtgcccaaggaagatggagttggtgatgtgcaacatttcggtgagaactttattgtcagaggttttcagtacatatttacaagttcttactccatcatacatattgggaatgagctggcattttcaagcatatacccaggagtccagcaatcattggggaagagagcctgaggctggcaatccttgcccagaactttggtcacctgcttgttcacaggccaccatatcttacttcactgaagtcatatgctgaggttttatttagtccagatgctgaaggatgggaagacccaagcagctggtgtggaggtctttcccagtgactcatcagtcattcagaaatcaaagcctgcacaagaaagggtgggatgggatgtatagagaaagacaccaagcctttagactccagcagagtagctgatattgacatatctgaggagggaggaggctccaatacgactactcccaattcacagggtttgtggttctggatgaaatctttgcaaagggtttccctggcactcaaacagaataaataggcttataaagtgt

SEQ ID NO: 5625 - DNA, 1721 bp, Homo sapiens
tggctgctcctcggactttcagtttatgtaagatttatctctaggggcctaccttcccccatctccagaggggaacataagaagtttaacggagctgggactgagcagattaagggagtggagcggaggctgggccggagagagtggggactgtgagtgctagtgggtaaggatccatctgtttgccccgtcccccagccagaaaggcattttggaaagactggcgtggcaagcgtcgccctgaaacgtccacagagcccaagaagtgatgatcactgagtgagtggcactgggctgagactggccagtttgttaacaacagggatgctagcagttaggaaggccaggaggaaactcaggatggggaccatctgctcccccaaccccagcgggacaaagacatcatcggaggtctgcaatgccgactggatggcctcgctcccccctcacctccacaacctccccctttccaatctggcaatcccaggctcacatgattcattcagctactgggtggatgaaaagtccccagtggggcctgaccaaacccaagctatcaaacgcctcgccaggatctccttggtgaagaagctaatgaagaagtggtctgtgactcagaacctgacatttcgagaacagctggaagctgggatccgctactttgacctgcgtgtgtcttccaaaccaggggatgccgaccaggagatctacttcatccatgggctttttggcatcaaggtctgggatgggctgatggaaattgactcgtttcttacacagcacccccaggagattatcttcctggatttcaaccacttctatgccatggatgagacccatcacaaatgcctggttctgcggatccaggaggcctttggaaacaagctgtgcccagcctgcagtgtggaaagtttgacgctgcgaactctgtgggagaagaactgccaggttcttattttctaccactgtcccttctacaagcagtaccccttcctgtggccaggaaagaagattccagcgccctgggcaaacaccacaagtgtgcgcaaactaatcctcttcttggagaccactctgagtgagcgggcctcacggggctccttccatgtctcccaagcgatcctcacccccagagtgaagaccattgcccggggcttggttgggggcctcaagaacacgctggttcatagcaatcgctggaacagccatgggccatccctgctgagtcaggaaagaagctgagggaagagtcgggattgaaaagcagcagacaaggctggcactgatcccagtttatcctttgagattcagcagaagatcctgatggaggaggaggataccaagagagaggtgcccaaggaagatggagttggtgatgtgcaacatttcggtgagaactttattgtcagaggttttcagtacatatttacaagttcttactccatcatacatattgggaatgagctggcattttcaagcatatacccaggagtccagcaatcattggggaagagagcctgaggctggcaatccttgcccagaactttggtcacctgcttgttcacaggccaccatatcttacttcactgaagtcatatgctgaggttttatttagtccagatgctgaaggatgggaagacccaagcagctggtgtggaggtctttcccagtgactcatcagtcattcagaaatcaaagcctgcacaagaaagggtgggatg

SEQ ID NO: 5626 - DNA, 7538 bp, Homo sapiens
gtaaactctagcggggctagagcaaacattggattagcggcagcagcctgccagcctgcccgaggagtgctgggaccagcgcgctgcacgccgactggcacgatggcctcgtctcaggggaaaaacgagctgaaattagccgactggatggcaactctgccggagagcatgcacagcatccccctcaccaatttagccattccagggtctcatgattccttcagcttctacattgatgaagcctctccagtaggtcctgagcagccagaaactgtccagaattttgtctctgtgtttggaactgtggccaaaaagctcatgcggaaatggttagccactcagacaatgaattttactggccagctaggagctggaattcgttattttgatcttcgaatttccaccaagcccagagaccccgacaatgaactctattttgctcatggtttgttcagtgccaaagtcaatgaaggccttgaggagatcaatgcattcctcacagatcaccataaggaggtagtgttcttggacttcaaccacttttatgggatgcagaaatatcaccatgaaaaactggtccaaatgctgaaagacatctatggaaataaaatgtgcccagcgatttttgcccaggaagttagtttaaagtacctgtgggagaaggactatcaagtgctggtcttctaccatagtccagtggctctggaagtgccctttctctggcctgggcagatgatgccagcaccctgggccaacaccacagaccccgagaaactgatccagtttcttcaagcatccatcactgagagaagaaagaagggatcgttttttatatctcaggtggtgctgacccccaaagctagcactgtggtcaaaggggtggcaagtggcctcagagaaacaatcacagaaagagctcttcctgccatgatgcagtgggtccgcacgcagaagccaggagagagtggcatcaatattgtcactgccgattttgtagaacttggtgactttatcagcactgtcataaagctcaactatgtctttgatgaaggagaagccaacacttgatagcactacttggagtttccatgaataagatggagaaagctcattgtattagggcatactatctgtaaacactctgatcttcctattccactgagtctctgaagggaatagggctggtagtgggtgggaaaaggggaaaaactgtttcttcagtgattacaatcatactcttcattactataaatatttcatttcccatttgatgagcaaaatctacttctagtgttaggaataaaaaaaaaagaccagtaactttgtttttcaaaattagtctttgtaacatagaattcatgagtgtttacttgattaggttctctatttccagcctatgactcctacgctgtctataccctgcaacctttctgctccctctcttgctcgctctttttaatcagatgctgtatgggaatcaaaacaattgaatgcccaacattttgtgtattacattgttgtcttaaaacttactagttttgtgggacttgttataatgctctatagtcatccacagttgggcaatcatagctaatttttggtcatagaaaatctgcatcaaatcagtttccatgcatcagtaatattgaaggtcataatcagtgatttttgttatatgaaaataatagtgtttcacagtatttctatttaaggcagctataaatataggagaaaaatgtttttggagagctgtgaatgccaatttcagagggaaaaatggttgaggggtgaaagagatgtatggcattttaatttggcaatctcttaaataatattgccctgcaagtacccagtaaatggtaaggtacaagtgtgttaaaattgaaaactctgaaaataactctttaaaaagccctcttaatgatgctcttgatgaaagaaaaagacagaaggaaggaagaagaaaaagactgcaagctttcctgccaatttgggattttcaaatatttaattctaaattccagattttaaggaagatttttcaagaaactgcaagtttttgacttgaaggaaagaaagaggaaggctggtagaagcagttagagcaatgtgtttgaaattatgtccatgaaatcacagggatctctgaaatatctttaggaaacttgaaatttatgaggtctgaatggacttgtttaaaattggctctgactcctcacttctgagtttcatcctatccgagggatgagattaaggcagaggcaaaagtttcacacaaagtttctgcaacctaacgtttaatagtccgggtctacagggaagaacaatgacacagcttgagcgttacttcctccttcgtgtcattgtgatatttgacaactctaaaaaataaaaaaaaaaaacttagagcacaataatccttgcctatgtacttcacaggaatattgtgaggtgtttataaaattataaaatttgatgaaattcttacaattattaattattttattttcatgtttagaaataatcacaccccaatagtttcctaggataatacagtccatgcaaagtagggtcatagagaaataaaagcatgccctcagcttttaatgaacttaaatgtagcacatatggcttaatctcttagacttagataagggagttcaattcaaaaccatatatgtcaagaccacaaataatcaagagttgatttcaagattataaatactcatgatcagaaaatagtacttattagcaattaaagggaggaaaagaaattgtttatactgaagagaatgtttatgaggagtgtgtatgtacctgtggtataccaaatagcatacatgtacacacaaaaatgtgtgtatacatttgggttgtgtgtatacatcttgccatatacaatatacaaacatatgcccattcctgtgatagcatacaaattcaaacatacagaaacacacacagatatggacacagtacaattcttcttttcaaatgaagacattgataatattaaataatttaattttaagactgaaacccttaatattgtgtgaaaaagagtaataaaacctttgaaagtagagtagatgatcacatcaaagtatttttgtaaaagaattctagtgtaggacttaattatttttaaaatatatttcttctcttctttccattttcccttcccttgtagttttattatctttctgtcttttacacctgctctttatgtgaaaatgtatatgaatccttttaaaatgattaggattattgaaatgtatgtcccgtaaatttggtttttgggcagactttctctctaactggctattcattcatccttcaggaggatcttagccaagaatatttgcaatgacacatgaatttaattttataaatataatggaaaacagatttttcatcatatcatgaataaaatatagaggtaactatgttgtattttcttgaacctagatactttctcatagtgtttgcttagaattaactttgtcctatttgtcaactgggttctggaaaaaaacaaacatgatgaagcttttgaataattgtgcagttttttaactagggaaagctttgtactgctgctaatgatatgcacccagaaaccttgttagacaaaaggcagtttcaagccaatgctatggtttccatgtggacatacagtgcctatgtagcaggcacttagagtaaatggacttgccttaatttataaaggagggaagaggtagaagggaaccatgggtcctccagctagagggggagtttactaaaagggagtccttggaaaggggaatggagagaaggtgcctttgactgtcttctatccattagttctgccctggagcacactggggaagcaggctgcgggccttccaaaagtaaaaaatggtgatatgcaatcgaagcttatccttagcctatgcacatttgtctcagctgggcattgtcttttcagagagcttgtagcacaagggctacacatgggcgccaagatggtggtagatacaccttggtgcactttttgttttacttgtttcttaagactatttcacaagtcctgtgaggcaaaaaaacaaaacaaaacaaaacaaccaaacaaatacaatctaacttttacccaatctacagcaggaaatcaaaggagtgggtggaatgagagaaaatatgcaaagagatcatttttaagtttgatttcctgtctgtaattttcaaggactaatatagcaaatttttcttctgccattatcatttatgtctccctatttaccacacaataatgtaaatgcagagaatgaggaggcatcttttaaaagccttaggatattctatatgatgacctcaatattgactttcagccatactgggaaaacttacttttcatggagtgccacctaacagtgaatgtattagagtataaaatgtttgccatgtatacacctgtatgtgcacatacacacattacacacacacacagaatgcacatttcacacacatatacttattattcaagttgaaactgcactctaatcaatctgagtctattgctgtttcaactcttaaaatcaatatctcctacattagtagatataaacataattcaaatatttaaatatttaagaggagaaaagtaactagaaaaccaatgaaaagtgaggccatcagaaatagaaaatgcctggcacgaacagtctatctaaattctcaatttcacttcaaattagagaatccataatggactagaatataaattacaaacacatacacacatcttcacttaaagttgttttaagttctttgaagttctgacatgtttttagccagggttatttgttcaggttcttccttgttaggattccagactggaaagttggaagtctcaggaaatgcatgtttccatgagttttttagtttcacagttttacagatccaacgacacaatcttttaatctttggtcactcaaccaaacaggagttccgtaggcagagtgctcactttgaattgctaatagaaaataatgcacagtgtcctcaggatatgctaaacaaggtttttaagagcattttattttacagcactttagtcttttcagctagatttcagtgacactatggtgtaaatgctatatctgccataacttattggtggctcctgtgttacatacagttttaaataatgctctaaattgtttgttttcccaatgataatgataaagtgttctgtagaatttgtaaaacatgtcaattgaatctgttgaaaattgtgtaattgttatttcaattgtgatactattttgtaggtaatagttttaaacgtatatttgtatgagtcaaaagtatgtgcttgtatgtggtatgtgtgtgtaagtatataatatcttatcaaaaatcaaacttatcctaaagaaaaagggcacattgtgaccagccttaatttattaacacttttttgttgtttttgcaatttggatttaaaattgaaacagaaattaagtttttgttaaaaatggtgtcttttaattttgtgaggaatgggctttagaacctatctgagttcccacaagcaaactgtccaccttgtgaggtaccccattgcttttcgtaataatcaaacatcaattcatatattaacttcattttcatacagactaatttgttttcatcaacaatagaaccagtacacctttaaagttgaccttcccaacatggcacccatttttctttaatgataaattttccatgaaaaattgtttctccaaaccattactttttaaaattcaatcttcccaagtaagatgaactgccttggtgttaggagagcttttaaaggcccatccatactaggtggttccaacatggttctcttctcgagaaaacaagcatgcaacccacacacttttctggtctgccccacgtgtagaattagtctagcaatagaaaactcatgactgacaaggatctacacatgtggtcatgcttgaagcaaaaattctgtgaccttctttgggcttggatctgattacagaatattaattaactttcttatttcctttctttctccatccttagttattccttttcaatatttagagttgccaggtaaaatacaggatatccagtgaaatttaaatttcagataaacagtatttctttagcatatttctcatatatttaatcagacatactttcactttaaaaaaagtttatctgaaattcaaatgtaactgggtatgtcctatatattttttcctaaatctcacaattctatccacactgcctttctatctttttcagctgggctatctataaggggcgagatctacctccctccatacccttgtgttcagacaccttatgaatatctgcagtcataatgtccttcaagaaagaaaacattggtcagctctaggtcctgcaaatgctttttgaaggacgaactcaaatacagatgggataatcaagtaaatatcttcataggatcaatgccaccatgttcaacacttccctttgccagcctgttgtgaggtccaagtttccccattaatcccttatatagcatttcccagtaactgggacaaccaaaaacacaccgacatattagaaatgctcctgaaaagtggcaacaccgcctaactcagtaccaggacctcttttaaattcaatttcttttttctttcagagagataacaaacgaattcattatttcccccattcacatcttaccacaaattatttttatcaggttaaaactggtcatctacggaattgtagaaaggtgacataggaactgtcttcactgctggaagaataaaagagtctgaggtatagacactgccctggtgacaccttctcagaacattgttgggggacaggggaggcaggcgcaagtaggggatagaatctgaccctgacatgcagctatcacctggcagagagactcgtcaaagcaaattataacgaccagtactatttttttttggaattgaaaacccaagaagccctaaaataagaacagtgagatcaaaggctggtttctaaaacaatgcagaaaatagaaccatgttggaattcctaaattctagctttcaaatactactgtttccaacagtgaatccttgacagagactgaatgcagatggaattttgaaacattttcagtagctacctcctctcctgaaattcctataagtggcagaggaaaatccaaatcctttaatataacatgtccatctcatgactcctgcttacacacatttgtgttgatttgcttcatttctggaggatgggaatttgcagagctggtgacatttccttcattagacaccagaaattcaccagagagagacagatctgtgccttctctttttaggatctggttattgatactttaataaatgtggtgtaaagaaaatccatggctacagtctgtatagaaaatgtgaattttttaaataagattgtgttcttaatgtaaaaaataaaagtttatttgtattcagtgaaatgcctaataaagtcctggtacc

SEQ ID NO: 5627 - DNA, 7704 bp, Homo sapiens
attggattagcggcagcagcctgccagcctgcccgaggagtgctgggaccagcgcgctgcacgccgactggcacgatggcctcgtctcaggggaaaaacgagctgaaattagccgactggatggcaactctgccggagagcatgcacagcatccccctcaccaatttagccattccagggtctcatgattccttcagcttctacattgatgaagcctctccagtaggtcctgagcagccagaaactgtccagaattttgtctctgtgtttggaactgtggccaaaaagctcatgcggaaatggttagccactcagacaatgaattttactggccagctaggagctggaattcgttattttgatcttcgaatttccaccaagcccagagaccccgacaatgaactctattttgctcatggtttgttcagtgccaaagtcaatgaaggccttgaggagatcaatgcattcctcacagatcaccataaggaggtagtgttcttggacttcaaccacttttatgggatgcagaaatatcaccatgaaaaactggtccaaatgctgaaagacatctatggaaataaaatgtgcccagcgatttttgcccaggaagttagtttaaagtacctgtgggagaaggactatcaagtgctggtcttctaccatagtccagtggctctggaagtgccctttctctggcctgggcagatgatgccagcaccctgggccaacaccacagaccccgagaaactgatccagtttcttcaagcatccatcactgagagaagaaagaagggatcgttttttatatctcaggtggtgctgacccccaaagctagcactgtggtcaaaggggtggcaagtggcctcagagaaacaatcacagaaagagctcttcctgccatgatgcagtgggtccgcacgcagaagccaggagagagtggcatcaatattgtcactgccgattttgtagaacttggtgactttatcagcactgtcataaagctcaactatgtctttgatgaaggagaagccaacacttgatagcactacttggagtttccatgaataagatggagaaagctcattgtattagggcatactatctgtaaacactctgatcttcctattccactgagtctctgaagggaatagggctggtagtgggtgggaaaaggggaaaaactgtttcttcagtgattacaatcatactcttcattactataaatatttcatttcccatttgatgagcaaaatctacttctagtgttaggaataaaaaaaaaagaccagtaactttgtttttcaaaattagtctttgtaacatagaattcatgagtgtttacttgattaggttctctatttccagcctatgactcctacgctgtctataccctgcaacctttctgctccctctcttgctcgctctttttaatcagatgctgtatgggaatcaaaacaattgaatgcccaacattttgtgtattacattgttgtcttaaaacttactagttttgtgggacttgttataatgctctatagtcatccacagttgggcaatcatagctaatttttggtcatagaaaatctgcatcaaatcagtttccatgcatcagtaatattgaaggtcataatcagtgatttttgttatatgaaaataatagtgtttcacagtatttctatttaaggcagctataaatataggagaaaaatgtttttggagagctgtgaatgccaatttcagagggaaaaatggttgaggggtgaaagagatgtatggcattttaatttggcaatctcttaaataatattgccctgcaagtacccagtaaatggtaaggtacaagtgtgttaaaattgaaaactctgaaaataactctttaaaaagccctcttaatgatgctcttgatgaaagaaaaagacagaaggaaggaaggaaggaaggaaggaaggaaggaaggaaggaaggaaggaaaggaagaaaggaagggagggaggaagggagggaagaagggagggaaggacagaaggaaggacgggaggaaggaaggaagggaggaaggaaggaaggaagagagggagggagggaggaagagagggagggagggaggaagagaggaaggaagaagaaaaagactgcaagctttcctgccaatttgggattttcaaatatttaattctaaattccagattttaaggaagatttttcaagaaactgcaagtttttgacttgaaggaaagaaagaggaaggctggtagaagcagttagagcaatgtgtttgaaattatgtccatgaaatcacagggatctctgaaatatctttaggaaacttgaaatttatgaggtctgaatggacttgtttaaaattggctctgactcctcacttctgagtttcatcctatccgagggatgagattaaggcagaggcaaaagtttcacacaaagtttctgcaacctaacgtttaatagtccgggtctacagggaagaacaatgacacagcttgagcgttacttcctccttcgtgtcattgtgatatttgacaactctaaaaaataaaaaaaaaaaacttagagcacaataatccttgcctatgtacttcacaggaatattgtgaggtgtttataaaattataaaatttgatgaaattcttacaattattaattattttattttcatgtttagaaataatcacaccccaatagtttcctaggataatacagtccatgcaaagtagggtcatagagaaataaaagcatgccctcagcttttaatgaacttaaatgtagcacatatggcttaatctcttagacttagataagggagttcaattcaaaaccatatatgtcaagaccacaaataatcaagagttgatttcaagattataaatactcatgatcagaaaatagtacttattagcaattaaagggaggaaaagaaattgtttatactgaagagaatgtttatgaggagtgtgtatgtacctgtggtataccaaatagcatacatgtacacacaaaaatgtgtgtatacatttgggttgtgtgtatacatcttgccatatacaatatacaaacatatgcccattcctgtgatagcatacaaattcaaacatacagaaacacacacagatatggacacagtacaattcttcttttcaaatgaagacattgataatattaaataatttaattttaagactgaaacccttaatattgtgtgaaaaagagtaataaaacctttgaaagtagagtagatgatcacatcaaagtatttttgtaaaagaattctagtgtaggacttaattatttttaaaatatatttcttctcttctttccattttcccttcccttgtagttttattatctttctgtcttttacacctgctctttatgtgaaaatgtatatgaatccttttaaaatgattaggattattgaaatgtatgtcccgtaaatttggtttttgggcagactttctctctaactggctattcattcatccttcaggaggatcttagccaagaatatttgcaatgacacatgaatttaattttataaatataatggaaaacagatttttcatcatatcatgaataaaatatagaggtaactatgttgtattttcttgaacctagatactttctcatagtgtttgcttagaattaactttgtcctatttgtcaactgggttctggaaaaaaacaaacatgatgaagcttttgaataattgtgcagttttttaactagggaaagctttgtactgctgctaatgatatgcacccagaaaccttgttagacaaaaggcagtttcaagccaatgctatggtttccatgtggacatacagtgcctatgtagcaggcacttagagtaaatggacttgccttaatttataaaggagggaagaggtagaagggaaccatgggtcctccagctagagggggagtttactaaaagggagtccttggaaaggggaatggagagaaggtgcctttgactgtcttctatccattagttctgccctggagcacactggggaagcaggctgcgggccttccaaaagtaaaaaatggtgatatgcaatcgaagcttatccttagcctatgcacatttgtctcagctgggcattgtcttttcagagagcttgtagcacaagggctacacatgggcgccaagatggtggtagatacaccttggtgcactttttgttttacttgtttcttaagactatttcacaagtcctgtgaggcaaaaaaacaaaacaaaacaaaacaaccaaacaaatacaatctaacttttacccaatctacagcaggaaatcaaaggagtgggtggaatgagagaaaatatgcaaagagatcatttttaagtttgatttcctgtctgtaattttcaaggactaatatagcaaatttttcttctgccattatcatttatgtctccctatttaccacacaataatgtaaatgcagagaatgaggaggcatcttttaaaagccttaggatattctatatgatgacctcaatattgactttcagccatactgggaaaacttacttttcatggagtgccacctaacagtgaatgtattagagtataaaatgtttgccatgtatacacctgtatgtgcacatacacacattacacacacacacagaatgcacatttcacacacatatacttattattcaagttgaaactgcactctaatcaatctgagtctattgctgtttcaactcttaaaatcaatatctcctacattagtagatataaacataattcaaatatttaaatatttaagaggagaaaagtaactagaaaaccaatgaaaagtgaggccatcagaaatagaaaatgcctggcacgaacagtctatctaaattctcaatttcacttcaaattagagaatccataatggactagaatataaattacaaacacatacacacatcttcacttaaagttgttttaagttctttgaagttctgacatgtttttagccagggttatttgttcaggttcttccttgttaggattccagactggaaagttggaagtctcaggaaatgcatgtttccatgagttttttagtttcacagttttacagatccaacgacacaatcttttaatctttggtcactcaaccaaacaggagttccgtaggcagagtgctcactttgaattgctaatagaaaataatgcacagtgtcctcaggatatgctaaacaaggtttttaagagcattttattttacagcactttagtcttttcagctagatttcagtgacactatggtgtaaatgctatatctgccataacttattggtggctcctgtgttacatacagttttaaataatgctctaaattgtttgttttcccaatgataatgataaagtgttctgtagaatttgtaaaacatgtcaattgaatctgttgaaaattgtgtaattgttatttcaattgtgatactattttgtaggtaatagttttaaacgtatatttgtatgagtcaaaagtatgtgcttgtatgtggtatgtgtgtgtaagtatataatatcttatcaaaaatcaaacttatcctaaagaaaaagggcacattgtgaccagccttaatttattaacacttttttgttgtttttgcaatttggatttaaaattgaaacagaaattaagtttttgttaaaaatggtgtcttttaattttgtgaggaatgggctttagaacctatctgagttcccacaagcaaactgtccaccttgtgaggtaccccattgcttttcgtaataatcaaacatcaattcatatattaacttcattttcatacagactaatttgttttcatcaacaatagaaccagtacacctttaaagttgaccttcccaacatggcacccatttttctttaatgataaattttccatgaaaaattgtttctccaaaccattactttttaaaattcaatcttcccaagtaagatgaactgccttggtgttaggagagcttttaaaggcccatccatactaggtggttccaacatggttctcttctcgagaaaacaagcatgcaacccacacacttttctggtctgccccacgtgtagaattagtctagcaatagaaaactcatgactgacaaggatctacacatgtggtcatgcttgaagcaaaaattctgtgaccttctttgggcttggatctgattacagaatattaattaactttcttatttcctttctttctccatccttagttattccttttcaatatttagagttgccaggtaaaatacaggatatccagtgaaatttaaatttcagataaacagtatttctttagcatatttctcatatatttaatcagacatactttcactttaaaaaaagtttatctgaaattcaaatgtaactgggtatgtcctatatattttttcctaaatctcacaattctatccacactgcctttctatctttttcagctgggctatctataaggggcgagatctacctccctccatacccttgtgttcagacaccttatgaatatctgcagtcataatgtccttcaagaaagaaaacattggtcagctctaggtcctgcaaatgctttttgaaggacgaactcaaatacagatgggataatcaagtaaatatcttcataggatcaatgccaccatgttcaacacttccctttgccagcctgttgtgaggtccaagtttccccattaatcccttatatagcatttcccagtaactgggacaaccaaaaacacaccgacatattagaaatgctcctgaaaagtggcaacaccgcctaactcagtaccaggacctcttttaaattcaatttcttttttctttcagagagataacaaacgaattcattatttcccccattcacatcttaccacaaattatttttatcaggttaaaactggtcatctacggaattgtagaaaggtgacataggaactgtcttcactgctggaagaataaaagagtctgaggtatagacactgccctggtgacaccttctcagaacattgttgggggacaggggaggcaggcgcaagtaggggatagaatctgaccctgacatgcagctatcacctggcagagagactcgtcaaagcaaattataacgaccagtactatttttttttggaattgaaaacccaagaagccctaaaataagaacagtgagatcaaaggctggtttctaaaacaatgcagaaaatagaaccatgttggaattcctaaattctagctttcaaatactactgtttccaacagtgaatccttgacagagactgaatgcagatggaattttgaaacattttcagtagctacctcctctcctgaaattcctataagtggcagaggaaaatccaaatcctttaatataacatgtccatctcatgactcctgcttacacacatttgtgttgatttgcttcatttctggaggatgggaatttgcagagctggtgacatttccttcattagacaccagaaattcaccagagagagacagatctgtgccttctctttttaggatctggttattgatactttaataaatgtggtgtaaagaaaatccatggctacagtctgtatagaaaatgtgaattttttaaataagattgtgttcttaatgtaaaaaataaaagtttatttgtattcagtgaaatgcctaataaagtcctggtaccaat

SEQ ID NO: 5628 - DNA, 569 bp, Homo sapiens
atttcacgaaggcatgggggtggccataggcggcctgaaatagaagggcaaggagttggtgcacacctacaagggctgcatcaggtcccaggactgctactccggcgttatatccaccaccatgggccccaaggaccacatggtaaccagctccttctgctgccagagcgacggctgcaacagtgcctttttgtctgttcccttgaccaatcttactgagaatggcctgatgtgccccgcctgcactgcgagcttcagggacaaatgcatggggcccatgacccactgtactggaaaggaaaaccactgcgtctccttatctggacacgtgcaggctggtattttcaaacccagatttgctatgcggggctgtgctacagagagtatgtgctttaccaagcctggtgctgaagtacccacaggcaccaatgtcctcttcctccatcatatagagtgcactcactccccctgaaaagctatctgaacagaggaagataatgtagtgtgaagtccccatttgtcctcagcctgtaactccccgtgtgcctataaagaagttaatagagcaa

SEQ ID NO: 5629 - DNA, 712 bp, Homo sapiens
atgaggctctccaggagaccagagacctttctgctggcctttgtgttgctctgcaccctcctgggtcttgggtgcccactacactgcgaaatatgtacggcggcggggagcaggtgccatggccaaatgaagacctgcagcagtgacaaggacacatgtgtgctcctggtcgggaaggctacttcaaagggcaaggagttggtgcacacctacaagggctgcatcaggtcccaggactgctactccggcgttatatccaccaccatgggccccaaggaccacatggtaaccagctccttctgctgccagagcgacggctgcaacagtgcctttttgtctgttcccttgaccaatcttactgagaatggcctgatgtgccccgcctgcactgcgagcttcagggacaaatgcatggggcccatgacccactgtactggaaaggaaaaccactgcgtctccttatctggacacgtgcaggctggtattttcaaacccagatttgctatgcggggctgtgctacagagagtatgtgctttaccaagcctggtgctgaagtacccacaggcaccaatgtcctcttcctccatcatatagagtgcactcactccccctgaaaagctatctgaacagaggaagataatgtagtgtgaagtccccatttgtcctcagcctgtaactccccgtgtgcctataaagaagttaatagagcaa

SEQ ID NO: 5630 - DNA, 2520 bp, Homo sapiens
atgcgcgccaagtgcattacagaaccagtaggtatagagctggcaccctgcctgcaggctcccagcgtaccggagacagacctgaagggtgtggtccaggcccggggtgggggggccagtgttctggaaaagccaagggaagggttcaagagggctgagcaggttcctgtgagccagacagactgttttgtgagcctctggctgcccaccgcctctcagaagaagctgaggacaaggaccatctccaactgcccaaatccagagtggaatgaaagcttcaacttccagatccagagccgagtgaagaacgtgctagagttgagtgtctgtgatgaagacacagtgacaccagatgaccatctcctgacagttctctatgacctcaccaagctctgtttccgaaagaaaacccacgtgaagtttccactcaacccgcagggcatggaagagctggaggtggagttcctgctggaggagagtccctctccacctgagaccctcgtcaccaatggcgtgctggtgtctcgacaagtctcctgcctggaggttcatgcacaatccaggaggcggaggaagagggagaaaatgaaggacctcctggtgatggtgaacgaatcctttgagaacacccagcgtgtccggccctgcttggaaccctgctgcccaacctctgcctgcttccaaaccgctgcctgcttccactaccccaagtacttccagtcccaggtgcacgtggaagtgcccaagagtcactggagctgtgggctttgctgccgctctcgcaagaagggccccatcagccagcccctcgactgcctttccgatggtcaggtgatgaccctgcctgtgggtgagagttatgaattacacatgaagtctacaccctgccctgagacactggacgtgcggctgggcttcagcctgtgcccagcagagctggagtttctgcagaagcggaaggtcgtggtggccaaggccctgaagcaggtgctgcagctggaggaagacctgcaggaggacgaggtgccgctgatagccatcatggccactgggggtggaacaagatccatgacctccatgtatggccacctgctggggctgcagaagctgaacctcctggactgtgccagctacatcaccggtctatcaggggccacctggaccatggctaccttgtaccgtgaccctgactggtcctccaaaaacttggagcctgctatctttgaggctcggagacatgtggtaaaggacaagctaccctccctgttcccagaccagctccgcaaattccaggaggagctccggcagcgcagccaggaaggctacagggtcacctttacagacttctggggcctgctgatagagacctgcctgggggacgagagaaatgaatgcaaactgtcagatcagcgtgctgctttgagctgcggccagaaccccctgcccatctacctcaccatcaatgtcaaggatgatgtaagcaaccaggacttcagagagtggttcgagttctccccctacgaggtgggcctgcagaagtatggggccttcatcccctccgagctcttcggctccgagttcttcatggggcggctggtgaagaggatcccggagtctcgaatctgctacatgctaggcctgtggagcagcatcttctccctgaacctgctggatgcctggaacctgtcacacacctcggaggagtttttccacaggtggacaagggagaaagtgcaggacatcgaagacgagccgatcctgcctgaaatccccaaatgtgatgctaacatcctggagaccacggtagtgatcccagggtcatggctgtccaattctttccgagaaatccttacccatcggtccttcgtgtctgagtttcacaacttcctgtctgggctgcagctgcacaccaactacctccagaatggccagttctctaggtggaaagacacagtgctagatggtttcccaaaccagctgaccgagtccgcgaaccacctgtgcctgctggacactgcgttctttgtcaactccagctacccgcccctcctcaggccagagcgaaaagccgacctcatcatccacctcaactactgtgctgggtcccagacaaagcccctgaaacaaacctgtgagtactgcactgtgcagaacatccccttccccaaatacgagctgccagatgagaatgaaaatctcaaggaatgctacctgatggagaacccccaggaacccgatgcccccatcgtgactttcttcccactcatcaatgacactttccgaaaatacaaggcaccaggtgtagagcgaagccctgaggagctggagcagggccaggtggacatttatggtcccaaaactccctatgccaccaaggagctgacatacacagaggccacctttgacaagctggtgaaactctcagagtataacatcctgaataataaggacactctcctccaggctctgcggctcgcagtggagaagaagaagcgcctgaagggccagtgtccctcctag

SEQ ID NO: 5631 - DNA, 4234 bp, Homo sapiens
cacaaactgttgggcccggagtcggaagagacccgggtttgggaaggaccccagggtcaggcgtcctggtggaagggcgggcctctttctctcttgctcagcagggagtccagagccctggaggaaagccagctcagctccgcatcggcgtcggcggttgggacgcacacactctgcgtcatggagggctgaggccgatgatgaattccggagtgcctgtcaggcttgctgtgtcactcggcccgctcggcgcgccccttcccagccgcccttccgtaccggctctcgggctcttccggtctccggccgccccttacctgcaggctcttctcccgccgcggcccggcgctctccgagtcgcccctgcggactggtctcgcacagtgcctgggcaccgggcgccagacagacactggccatgacgagcggcgcaaccaggtaccggctgagctgctcgctccggggccacgagctggacgtacggggcctggtgtgctgcgcctatccgccgggagcctttgtgtccgtgtcccgagaccgcaccacccgcctctgggccccagacagtccaaacaggagctttacagaaatgcactgtatgagtggccattccaattttgtatcttgtgtatgcatcataccctcaagtgacatctaccctcatggcctaattgccaccggtggaaatgaccacaatatatgcattttctcactggacagtccaatgccactttatattctaaaaggccacaaaaatactgtttgtagtctatcatctggaaaatttgggacattacttagtggttcatgggacaccactgctaaagtctggctgaatgacaagtgcatgatgaccttgcagggtcatacagctgcagtgtgggcggtaaagatcttacctgaacagggcttaatgttgactggatcagcagacaagactgttaaactgtggaaggctggaagatgtgagaggactttttcagggcatgaagactgtgtaagaggtttggcaattttgagtgaaacagaatttctttcctgtgcaaatgatgctagtattagaaggtggcaaatcactggcgagtgtcttgaagtatattatggacatacaaattatatttatagcatatccgtttttccaaattgtagagactttgtgacaacagcagaggacagatctctgagaatctggaaacatggggaatgtgctcaaactatccgacttccagctcagtctatatggtgctgctgtgtgctcgacaatggtgacattgtggttggtgcgagtgatggcattattagagtgtttacagaatcagaagatcgaacagcaagtgctgaagaaatcaaggcttttgaaaaagaactgtctcacgcaaccattgattctaaaactggcgatttaggggacatcaatgctgagcagcttcctgggagggaacatcttaatgaacctggtactagagaaggacagactcgtctaatcagagatggggagaaagtcgaagcctatcagtggagtgttagtgaagggaggtggataaaaattggtgatgttgttggctcatctggtgctaatcagcaaacatctggaaaagttttatatgaagggaaagaatttgattatgttttctcaattgatgtcaatgaaggtggaccatcatataaattgccatataataccagtgatgacccttggttaactgcatacaacttcttacagaagaatgatttgaatcctatgtttctggatcaagtagctaaatttattattgataacacaaaaggtcaaatgttgggacttgggaatcccagcttttcagatccatttacaggtggtggtcggtatgttccgggctcttcgggatcttctaacacactacccacagcagatccttttacaggtgctggtcgttatgtaccaggttctgcaagtatgggaactaccatggccggagttgatccatttacagggaatagtgcctaccgatcagctgcatctaaaacaatgaatatttatttccctaaaaaagaggctgtcacatttgaccaagcaaaccctacacaaatattaggtaaactgaaggaacttaatggaactgcacctgaagagaagaagttaactgaggatgacttgatacttcttgagaagatactgtctctaatatgtaatagttcttcagaaaaacccacagtccagcaacttcagattttgtggaaagctattaactgtcctgaagatattgtctttcctgcacttgacattcttcggttgtcaattaaacaccccagtgtgaatgagaacttctgcaatgaaaaggaaggggctcagttcagcagtcatcttatcaatcttctgaaccctaaaggaaagccagcaaaccagctgcttgctctcaggactttttgcaattgttttgttggccaggcaggacaaaaactcatgatgtcccagagggaatcactgatgtcccatgcaatagaactgaaatcagggagcaataagaacattcacattgctctggctacattggccctgaactattctgtttgttttcataaagaccataacattgaagggaaagcccaatgtttgtcactaattagcacaatcttggaagtagtacaagacctagaagccacttttagacttcttgtggctcttggaacacttatcagtgatgattcaaatgctgtacaattagccaagtctttaggtgttgattctcaaataaaaaagtattcctcagtatcagaaccagctaaagtaagtgaatgctgtagatttatcctaaatttgctgtagcagtggggaagagggacggatatttttaattgattagtgtttttttcctcacatttgacatgactgataacagataattaaaaaaagagaatacggtggattaagtaaaattttacatcttgtaaagtggtggggaggggaaacagaaataaaatttttgcactgctgaactgtgagattttcctgtgtaatttgggtagattttcaagagtgtgaacacaaatttaaaataagctataatcagcaacaacacaatgacaatgacatcttccccttaccttagccactaagaagacaagggctgttactcatataacttgcttttattacttaatgtacaccaaactgttgttgtcaattatcttttatttaacttctccaccttcattgctagatccttcgaacagcactgatacatttcaaggtcttgttttaggataactactttaaaattttttaaattatattaaatttataaaataatttataaattcatatattaaaacaatataagataatttcttgatttgtcatttataaatcctaaagtatatttgtttaatggcctatttttagatgaagaaaaagccagttggtaagctgtgttagtcatgtatcagttcagacagacgaggtctcaatttaactccaggcttagatccagtttcttttgcccttcactatttgaggtaacttcatttttcattctagttttgatatttggctgtttatttttgtcattttccattatttcaaagggaatttggaacatgttgaattttatcaggtggttacataagcaagagtacatcaaactgtattatttgaaagtctagaacctgtcatgtgaaattactatttttgagccctctatgtggtccaggcagaatagtagacacactgatatttaatccttaaaacccctttaaatgagggccagtattatctctgctttcagaagtagacataataggatgaatcatataacagaaaaaaaaaagtgaagccaagagggagttaactacttaaagtacatgctatgctatactttctagagagatcacagatgtgtgtgaacatcctagcaattaacacaaagaaggaaccatcacattaattacacaatttattgtgtctgaggtaacccagtttcttgagagaagcgtaactattttcaaaagtgggaaagatcttttcataaagacgttgccagaaatagcaacattctcaatactcgtggtgtaaaaaccatgaatcccctggcttaatgccaaattatagccttagaagaataattgttccccaaatgggcaagaaaggttctaattgtcaagagtaacccaagtaagaacttttggaatatcaaaaggaaatgagcaaaatgtaaatagaggggatatgtactttgctgagtattaaattggaact

SEQ ID NO: 5632 - DNA, 3456 bp, Homo sapiens
gctaagtttcttcgctcgccgcctcgctcagagccggggccgggccagagcggcgccccgctgccctgtccccgcgtgcagaccccgggcccggccccggccccccgccaagccatgctgtgcggccgctggaggcgttgccgccgcccgcccgaggagcccccggtggccgcccaggtcgcagcccaagtcgcggcgccggtcgctctcccgtccccgccgactccctccgatggcggcaccaagaggcccgggctgcgggcgctgaagaagatgggcctgacggaggacgaggacgtgcgcgccatgctgcggggctcccggctccgcaagatccgctcgcgcacgtggcacaaggagcggctgtaccggctgcaggaggacggcctgagcgtgtggttccagcggcgcatcccgcgtgcgccatcgcagcacatcttcttcgtgcagcacatcgaggcggtccgcgagggccaccagtccgagggcctgcggcgcttcgggggtgccttcgcgccagcgcgctgcctcaccatcgccttcaagggccgccgcaagaacctggacctggcggcgcccacggctgaggaagcgcagcgctgggtgcgcggtctgaccaagctccgcgcgcgcctggacgccatgagccagcgcgagcggctagacccctggatccactcctatctgcaccgggctgactccaaccaggacagcaagatgagcttcaaggagatcaagagcctgctgagaatggtcaacgtggacatgaacgacatgtacgcctacctcctcttcaaggagtgtgaccactccaacaacgaccgtctagagggggctgagatcgaggagttcctgcggcggctgctgaagcggccggagctggaggagatcttccatcagtactcgggcgaggaccgcgtgctgagtgcccctgagctgctggagttcctggaggaccagggcgaggagggcgccacactggcccgcgcccagcagctcattcagacctatgagctcaacgagacagccaagcagcatgagctgatgacactggatggcttcatgatgtacctgttgtcgccggagggggctgccttggacaacacccacacgtgtgtgttccaggacatgaaccagccccttgcccactacttcatctcttcctcccacaacacctatctgactgactcccagatcggggggcccagcagcaccgaggcctatgacagggcctttgcccagggatgccgctgcgtggagctggactgctgggaggggccaggaggggagcccgtcatctatcatggccataccctcacctccaagattctcttccgggacgtggtccaagccgtgcgcgaccatgccttcacgctgtccccttaccctgtcatcctatccctggagaaccactgcgggctggagcagcaggctgccatggcccgccacctctgcaccatcctgggggacatgctggtgacacaggcgctggactccccaaatcccgaggagctgccatccccagagcagctgaagggccgggtcctggtgaagggaaagaagttgcccgctgctcggagcgaggatggccgggctctgtcggatcgggaggaggaggaggaggatgacgaggaggaagaagaggaggtggaggctgcagcgcagaggcggctggccaagcagatctccccggagctgtcggccctggctgtgtactgccacgccacccgcctgcgactgcaccctgcccccaacgccccacaaccctgccaggtcagctccctcagcgagcgcaaagccaagaaactcattcgggaggcagggaacagctttgtcaggcacaatgcccgccagctgacccgcgtgtacccgctggggctgcggatgaactcagccaactacagtccccaggagatgtggaactcgggctgtcagctggtggccttgaacttccagacgccaggctacgagatggacctcaatgccgggcgcttcctagtcaatgggcagtgtggctacgtcctaaaacctgcctgcctgcggcaacctgactcgacctttgaccccgagtacccaggacctcccagaaccactctcagcatccaggtgctgactgcacagcagctgcccaagctgaatgccgagaagccacactccattgtggaccccctggtgcgcattgagatccatggggtgcccgcagactgtgcccggcaggagactgactacgtgctcaacaatggcttcaacccccgctgggggcagaccctgcagttccagctgcgggctccggagctggcactggtccggtttgtggtggaagattatgacgccacctcccccaatgactttgtgggccagtttacactgcctcttagcagcctaaagcaagggtaccgccacatacacctgctttccaaggacggggcctcactgtcaccagccacgctcttcatccaaatccgcatccagcgctcctgagggcccacctcactcgccttggggttctgcgagtgccagtccacatcccctgcagagccctctcctcctctggagtcaggtggtgggagtaccagccccccagcccacccacttggcccactcagcccattcaccaggcgctggtctcacctgggtgctgagggctgcctgggcccctcctgaagaacagaaaggtgttcatgtgacttcagtgagctccaaccctggggccctgagatggccccagctcctcttgtcctcagcccacccctcattgtgacttatgaggagcaagcctgttgctgccaggagacttggggagcaggacacttgtgggccctcagttcccctctgtcctcccgtgggccatcccagcctccttcccccagaggagcgcagtcactccacttggccccgaccccgagcttagcccctaagccctcctttaccccaggccttcctggactcctccctccagctccggaacctgagctccccttcccttctcaaagcaagaagggagcgctgaggcatgaagccctggggaaactggcagtaggttttggtttttattttttgagacagggtctcgctccgtcgcccaggctggagtgcaatgttgcaatcatggctcactgcagctttgaactcccaggctcaagcgatcctcccatctcagcctcctgagtagctgggactacaggcacaggccaccaaacctggctaatgtttaaattttatgtagagatggcggggggggcgggggtctccctatgttgcccaggctggtctcgagctcctgacctcaagtgatcctcctgccccagcattccaaagtgctgggattacaggtgtgagccactgcctggcctggccgtaggtttgtaactgtttcatagaagagccctggagaagacagtagaatgagcctatctagtttaaaaaataaagaagcacgttgatttcaccaccgcc

SEQ ID NO: 5633 - DNA, 2830 bp, Homo sapiens
attctctgcctctgaaggctccagaggctgtgggaagcagcacatcagcgacagctcctggctgctggactccgcagggagggaaggaagattggtcgcaatgtcccagcagaagtgcatcgtgatctttgccctggtgtgctgctttgccattctggttgcactgatcttttcagccgtggacatcatgggagaggatgaggatggactctcagaaaaaaattgccaaaataaatgtcggtaagagggtcaacgtctttttgaaaagttgctccagctgacttcgcaaaatattgaaatcaagctagtgagtgatgtaacagctgattcaaaggtattagaagccttgaaattaaagggagccgaggtgacgtacatgaacatgaccgcttacaacaagggccggctgcagtcctccttctggatcgtggacaaacagcacgtgtatatcggcagtgccggtttggactggcaatccctgggacagatgaaagaactcggtgtcatcttctacaactgcagctgcctggtcctagatttacaaaggatatttgctctatatagttcattaaaattcaaaagcagagtgcctcaaacctggtccaaaagactctatggagtctatgacaatgaaaagaaattgcaacttcagttgaatgaaaccaaatctcaagcatttgtatcgaattctccaaaactcttttgccctaaaaacagaagttttgacatagatgccatctacagtgtgatagatgatgccaagcagtatgtgtacatcgctgtcatggactacctgcctatctccagcacaagcaccaaaaggacttactggccagacttggatgcaaaaataagagaagcattagttttacgaagcgttagagttcgactccttttaagcttctggaaggaaactgatccccttacgtttaactttatttcatctcttaaagcgatttgcactgaaatagccaactgcagtttgaaagttaaattttttgatctggaaagagagaatgcttgtgctacaaaagaacaaaagaatcacacctttcctaggttaaatcgcaacaagtacatggtgacagatggagcagcttatattggaaattttgattgggtagggaatgatttcactcagaatgctggcacgggccttgttatcaaccaggcagatgtgaggaacaacagaagcatcattaagcaacttaaagatgtgtttgaaagggactggtattcaccgtatgccaaaaccttacagccaaccaaacagccgaactgctcaagcctgttcaaactcaaacccctctccaacaaaactgccacagacgacacaggcggaaaggatccccggaacgtataacatgatgaagaaactgacaggacagctctgtatttcatatttatacataaaggacttgaggagagaaaaaacactttaatatgtctctttttttagggaaaaagcacacttataaaaaatattctctgaacaacacataatacctatctaacaatatcttagcgtcgtgtacactaaaattaagacttttgtatttgttacctctgacagagaatgtcattctggcgtagaagttagtttttacgtttgcatacaaattttaagactttcattcctgctcctttctagttttagaactttttctgctgacctacccggtcagttgttaggaagcttagcatgaggtgggctctttaacaccattctgagaactgttgatttagagaggaaggtgaggattttgccttggagaagagactgataaaaccaagtgtttattcttgtaaatcgtctccaagacctacacagtcagctaagcatgaatagcttacatctcatgccagccttcaacacccttgaaaaatatccttttctgtcttgctcattttcttcttataccataagttttatttggtatcattttctcttctcacaaaatgttcctattatatagcattttctgtattcacctcaacattacttctaactatgataacatcttttgaaaacatacaaatttttcagaatggatactaagtggaaatagcagtctttcattttcacctttcaactgaatccttttttcccctaccgaattggtatttaaaaaaaatcacagtcagcaatatgtatcctttctctcaagctcagaaaaattatgtagccacctgctaatatccagcaagctatcaagtctgcattttgggaataaagtagtttttcacatttttgttcagtttatggtattataaaggaaaaaatctctatgcgtcagtggattttaatttctttagaatcattatgctgttaagagtatgccagcaaacgtttctagagctatttaatataccttctgctatttaatataccaaatgcttttcagagaaatgcaatttaaatactgtgcttaacatattttactaagaagcagaaatattgaattattgttctataacgtaattgtgtgttgttgttttatatctatacaatatatacccctgtattaatggagaccattgctacactagggagaggcatggcctcttcagagcccacagcaggtggccgggatgtccagttccaatgttgttcccgactctgtgactcaaagcggagcccctcactgcttggcctcgggcttctcttggtaatgtagacggtaataactcacctacctcgcaaggatgttgtcacggtaggaaatatttataacttgttttgaaatcaaaagaacctatataaatgctaagcattataatatataatctttttcttgaaataaactttgtcatatcttgatggaatcaa

SEQ ID NO: 5634 - DNA, 1969 bp, Homo sapiens
ctttgtcaaataaggaaaactcaaacttttggcagtctgcaaactgtgaggttgactttataatttttcatcacaaggtatacctcctgaagcctcttaactattttcagaaaaagacagtgttgctgataatgcaatatatcctgcatgttcaacctttgtgaatcataccatgtagggcaattgacttggtgagcaaaatctccatggtcacctgggtagctgcatttagaaataggagctgtccagtcaaggttacagcacttgttttctttccttagaattcaatgcagttaaatatcatctgtaaattttgattagctttgcaaggctattgaaggtttgtatattccaatgcctctgattaatcaaattcaattaaaaatgaaaataaagatttatttatataatagtagggaatatatcctcttcttatttattttgagttgaagagatggagataaatccaatagaaaaataacaataataatgttcaaacattttcaacatgtaaagaattgtatttagaactatcaaaaatttatacaataggatgttttatcacagaatctggaaaggagacttctagaaattgagaaatacaggatatttctgatataagactgaatgcaaatgtgtatattctaagaaatacaaaaacaacttggtaaaaaaaaaaaagacacttaaaatgagtgctgtgtgctttcctttctggtttttattatttttaaattgttccttcagccaccaaagttatatgatggtttctgaacagcgtttacttttgtgacagtttcatctcactctgttgtccaaactgataaagtccagaagtctagaaacagcaagggactcccttcctctgttatatgtaagctgacaagaggcagacaaacacgttctgaagttttgtgcatgctgcgttttctctccttgctgcaacaagaaaagcctttgttttccaacctggcaacctttgaagaagtgactcagacatcttcatggcctctaaagatgcccagaaccaaagaagaggtctgcctggttttcttcctggagctccagacccagaccaaagccttcctgcctcttccaatccagggaaccaagcatggcagctgagtctccctctgccaagcagtttcctgccaacagtcagtctccctcctggtctagaatatttaagccagttagacctgataattatacaccagcaggtggagctgcttggaatgatacttggtactgagacctccaacaaatatgagattaaaaacagcttgggacaaagaatttactttgcagtggaggaaagcatctgcttcaatcgtactttctgttccactctgcgatcttgcaccctgaggatcacagataactcaggtcgagaggtcattacagtgaacaggcccttgagatgtaacagctgctggtgcccttgctacctacaagagttagaaatccaagcccctcctggtactatagttggttacgttacgcagaagtgggacccctttctgcctaaattcacaatccaaaatgcaaacaaagaagatattttgaaaattgttggtccttgtgtgacatgtggctgttttggcgatgtggattttgaggtgaaaaccattaatgaaaagcttacaattgggaagatttcaaagtactggtcaggatttgtaaatgatgtcttcacaaatgctgacaatttcggaattcatgttcctgcagatctagatgtaacagtcaaagcagcaatgatcggtgcctgttttctctttgattttatgttctttgaacattcactggctggattataataaccaagataatgaaaacaataaaatatgcagaacatatttcaaaatcccttgggctctggatttcatttctgaatggtttgaatgtttgcttttttgttaaaaaaaaatgttaattattatatttattaaaacagtttaatgaggca

SEQ ID NO: 5635 - DNA, 1058 bp, Homo sapiens
ctttgaagaagtgactcagacatcttcatggcctctaaagatgcccagaaccaaagaagaggtctgcctggttttcttcctggagctccagacccagaccaaagccttcctgcctcttccaatccagggaaccaagcatggcagctgagtctccctctgccaagcagtttcctgccaacagtcagtctccctcctggtctagaatatttaagccagttagacctgataattatacaccagcaggtggagctgcttggaatgatacttggtactgagacctccaacaaatatgagattaaaaacagcttgggacaaagaatttactttgcagtggaggaaagcatctgcttcaatcgtactttctgttccactctgcgatcttgcaccctgaggatcacagataactcaggtcgagaggtcattacagtgaacaggcccttgagatgtaacagctgctggtgcccttgctacctacaagagttagaaatccaagcccctcctggtactatagttggttacgttacgcagaagtgggacccctttctgcctaaattcacaatccaaaatgcaaacaaagaagatattttgaaaattgttggtccttgtgtgacatgtggctgttttggcgatgtggattttgaggtgaaaaccattaatgaaaagcttacaattgggaagatttcaaagtactggtcaggatttgtaaatgatgtcttcacaaatgctgacaatttcggaattcatgttcctgcagatctagatgtaacagtcaaagcagcaatgatcggtgcctgttttctctttgattttatgttctttgaacattcactggctggattataataaccaagataatgaaaacaataaaatatgcagaacatatttcaaattatttagagtatttcaaagcacttccacacatatgaatggcctgcactggacctcacaagaaaacagagggtttcaactgtgcataacatcagagatgaccaggtgcaacctccatatattgaagacttagaaaatgagaaatataaaaattaaattactttgtttta

SEQ ID NO: 5636 - DNA, 3490 bp, Homo sapiens
ctgacgcaggcgccattacaggagccgtctctcttgaggcgaccgtgtccgcataagttgtcagtccccagcagtgtttgggagccttaacaggcttgctaagtgcctgagattaaaggcgaagaggaagaagagcaagaagggcaacccggtgtttaacacacggctttcaggcgctctcaggtggcgccaagttcagtttcgacagggatatgcatccgggagagaatttttcagcccccgcccccactggcatacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacgtcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggttttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgagaca

SEQ ID NO: 5637 - DNA, 3341 bp, Homo sapiens
tggtcccgcgccggtcccggtgggccgacttccggcgagcgggcaagcgggaaccaggtggccacccggtgtcggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacgtcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggttttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgagaca

SEQ ID NO: 5638 - DNA, 3469 bp, Homo sapiens
atgtccgccatgttagtgtctgacgcaggcgccattacaggagccgtctctcttgaggcgaccgtgtccgcataagttgtcagtccccagcagtgtttgggagccttaacaggcttgctaagtgcctgagattaaaggcgaagaggaagaagagcaagaagggcaacccggtgtttaacacacggctttcaggcgctctcaggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacgtcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggttttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgagaca

SEQ ID NO: 5639 - DNA, 3200 bp, Homo sapiens
agagatttccaagtagggggtgtgttggagggacttctgagggcagcttgtcctggaagaatgggggaaaggcggcgtgtgttgctgtccctgaggacatctgtgtagctccctgggagaccctctgccctttccccctcccaccagcccggcgagcagggaccaagcctgcttattatcacctgacgctgcgcagccgctgatcccattggtggaggcagattcggtctggctctctcgttctttctcccttctctgcctctctctcctccacgctgctttgatttcgctcttgcctctcttcttgcgctgctcagctgggaacatcgtctcaccaggggcagcagcgacgcgctgcacagccagacaggagctggctgcggggcatggaagcagcctccttggcagccgggagaggagcaagcgcacgccactgcccgtgacccaggcgtccggctgctgtcccctgccggggagctcatccacgcagaggtctctccctgtcctccctgcgagcttttcctctgcagagcccagtggagccagtccccacaggagacaaccctgacgggagcatggagctgctgtccacgccccacagcattgagatcaacaacatcacctgcgactccttccgcatctcctgggccatggaggacagtgacctggagagggtcacccattacttcattgaccttaacaagaaggagaataagaattccaacaagttcaagcaccgggacgtccccaccaagctcgtggccaaggcagtgccgctgcccatgacggtgagaggccactggttcctgagcccccgcacggagtacagtgtggccgtgcagacggcagtgaagcagagcgatggggagtacctggtgtccggctggagcgagacggtggagttctgcactggggattatgccaaggagcacctggctcagcttcaggagaaagctgagcagatcgcaggccgcatgctccgcttctccgtcttctaccgcaaccatcacaaggagtacttccagcatgccaggacccactgcgggaacatgctgcagccttacctgaaggacaacagtggcagccacggctcccccaccagcggtatgctccacggggtcttcttcagctgcaacacggagttcaacacgggccagcccccgcaggactccccctacggccgctggcgcttccagatcccagctcagcgcctcttcaatcccagcaccaacctctactttgcggacttctactgcatgtacacggcctaccactacgccatcctggtgctggcgcccaaaggctccctgggggaccgcttctgccgcgaccgcctgcccctcctggacattgcttgcaacaagttcctgacctgcagcgtggaggatggggagctggtcttccgccacgcccaggacctcatcctggagatcatctacactgagcccgtcgacctgtccctgggcaccctgggggagatcagtgggcaccagctcatgagtctgtctactgccgatgccaagaaggaccccagctgcaagacctgcaacatcagcgtgggccgctagggactcctggggagctggggggcgagggagagatgagcggaaggtggaggtgggtagcccaggttcagggagctggctttctctctcctgcccccctgctccctccactctgcccagctgccctcccctcgccccttggcattggaggcaacagacggtggtcctcttggtaagtgtggcccacacccagcctggtggacatggaaaggcttctcagcctctgtagttggcagctgggctggacttctggagaacttcccctttcctctggtttccttgtcctactgttctttgcctcgtccaggtctctatctcccaaagacctgcccacctcctgggctctcccagggaagcccctctgggccaaagcccatgggtagcttggctgcctccagaagagatgcagagagctgtggggcgatctttcttagtcccactcaccccactcagggccaaccacagaatgccccctccctgctgagctgggtctctggggcttcccactccaggcctggatcccttccttctataaatagtctcctgcaccaccgtgactccctggctgctccttgccccaaagaaccctcttcctgcatgggagagctgtccctccttctccacctgcccaccgggacactccccctgctctctagaaaggaactctctttcttctcttggcactgggggcgtcaggctgtcggatgttccttccttccataccccagcataccttctccttgcttagagtgcaggggtctgagacagcagccactggggttgaggagggggaggagacccctgagacccagaggtgccccttcctcagctgggagtgggccgcctcatgctctgctggggcctggcatggaacgtgagacctgtaagctgtcccgcgggccccggcaccccgcccagctgtgcactttgctcactcgctctgccatggtgccatgactgtactgtgcccatgcgtgacctggactgtggaccctctgctgctccgcctctcccctccccactggctctgtctgctctcctgccaccctgctggccgggagcccctccccggggagttcttggtgaagtccttcccgggcctccttgtgtttttgcctcattcctactgtcacacaggtcacgagggtggactccctacaatcaacaaagcaaacagagagcctgtgggaggggctgacagcagcagccggctgtttgggggatgatggaggtgacatcaggcagaggagagtgcagcctcacagtgactttctcagaggtgacagagatgatggatgagcagctggattttcgtgatgaaggacggaagcagcagcgggccggcaaggccatacctcggtgagggacaggtggacaacggtcacctatctgtagccaggggcagttgtgtggccagctgtctctctgggatgagtcaggaggcctggaggcttggggagaggtgtggagaaggagagaacatggcccaggccctttccttccccctgtgctgacagcattgctgtgggggtggcccactgccctcccctggccctcatgtccccccggggctggggtccgcctgcctgtgctgtgcttgcgacgtgcatcaataaaccaccatggcctgagggc

SEQ ID NO: 5640 - DNA, 1466 bp, Homo sapiens
acgctgctttgatttcgctcttgcctctcttcttgcgctgctcagctgggaacatcgtctcaccaggggcagcagcgacgcgctgcacagccagacaggagctggctgcggggcatggaagcagcctccttggcagccgggagaggagcaagcgcacgccactgcccgtgacccaggcgtccggctgctgtcccctgccggggagctcatccacgcagaggtctctccctgtcctccctgcgagcttttcctctgcagagcccagtggagccagtccccacaggagacaaccctgacgggagcatggagctgctgtccacgccccacagcattgagatcaacaacatcacctgcgactccttccgcatctcctgggccatggaggacagtgacctggagagggtcacccattacttcattgaccttaacaagaaggagaataagaattccaaccatcacaaggagtacttccagcatgccaggacccactgcgggaacatgctgcagccttacctgaaggacaacagtggcagccacggctcccccaccagcggtatgctccacggggtcttcttcagctgcaacacggagttcaacacgggccagcccccgcaggactccccctacggccgctggcgcttccagatcccagctcagcgcctcttcaatcccagcaccaacctctactttgcggacttctactgcatgtacacggcctaccactacgccatcctggtgctggcgcccaaaggctccctgggggaccgcttctgccgcgaccgcctgcccctcctggacattgcttgcaacaagttcctgacctgcagcgtggaggatggggagctggtcttccgccacgcccaggacctcatcctggagatcatctacactgagcccgtcgacctgtccctgggcaccctgggggagatcagtgggcaccagctcatgagtctgtctactgccgatgccaagaaggaccccagctgcaagacctgcaacatcagcgtgggccgctagggactcctggggagctggggggcgagggagagatgagcggaaggtggaggtgggtagcccaggttcagggagctggctttctctctcctgcccccctgctccctccactctgcccagctgccctcccctcgccccttggcattggaggcaacagacggtggtcctcttggtaagtgtggcccacacccagcctggtggacatggaaaggcttctcagcctctgtagttggcagctgggctggacttctggagaacttcccctttcctctggtttccttgtcctactgttctttgcctcgtccaggtctctatctcccaaagacctgcccacctcctgggctctcccagggaagcccctctgggccaaagcccatgggtagcttggctgcctccagaagagatgcagagagctgtggggcgatctttcttagtcccactcaccccactca

SEQ ID NO: 5641 - DNA, 3094 bp, Homo sapiens
ttctttctcccttctctgcctctctctcctccacgctgctttgatttcgctcttgcctctcttcttgcgctgctcagctgggaacatcgtctcaccaggggcagcagcgacgcgctgcacagccagacaggagctggctgcggggcatggaagcagcctccttggcagccgggagaggagcaagcgcacgccactgcccgtgacccaggcgtccggctgctgtcccctgccggggagctcatccacgcagaggtctctccctgtcctccctgcgagcttttcctctgcagagcccagtggagccagccatgtaccgcggcaacgcttgctgaccccagtgaggagagaggcctgaatccgagggccctggcacctgtgagctcttggctgtcacctgccccaagcctcgcacctccgctccacagcagtccccacaggagacaaccctgacgggagcatggagctgctgtccacgccccacagcattgagatcaacaacatcacctgcgactccttccgcatctcctgggccatggaggacagtgacctggagagggtcacccattacttcattgaccttaacaagaaggagaataagaattccaacaagttcaagcaccgggacgtccccaccaagctcgtggccaaggcagtgccgctgcccatgacggtgagaggccactggttcctgagcccccgcacggagtacagtgtggccgtgcagacggcagtgaagcagagcgatggggagtacctggtgtccggctggagcgagacggtggagttctgcactggggattatgccaaggagcacctggctcagcttcaggagaaagctgagcagatcgcaggccgcatgctccgcttctccgtcttctaccgcaaccatcacaaggagtacttccagcatgccaggacccactgcgggaacatgctgcagccttacctgaaggacaacagtggcagccacggctcccccaccagcggtatgctccacggggtcttcttcagctgcaacacggagttcaacacgggccagcccccgcaggactccccctacggccgctggcgcttccagatcccagctcagcgcctcttcaatcccagcaccaacctctactttgcggacttctactgcatgtacacggcctaccactacgccatcctggtgctggcgcccaaaggctccctgggggaccgcttctgccgcgaccgcctgcccctcctggacattgcttgcaacaagttcctgacctgcagcgtggaggatggggagctggtcttccgccacgcccaggacctcatcctggagatcatctacactgagcccgtcgacctgtccctgggcaccctgggggagatcagtgggcaccagctcatgagtctgtctactgccgatgccaagaaggaccccagctgcaagacctgcaacatcagcgtgggccgctagggactcctggggagctggggggcgagggagagatgagcggaaggtggaggtgggtagcccaggttcagggagctggctttctctctcctgcccccctgctccctccactctgcccagctgccctcccctcgccccttggcattggaggcaacagacggtggtcctcttggtaagtgtggcccacacccagcctggtggacatggaaaggcttctcagcctctgtagttggcagctgggctggacttctggagaacttcccctttcctctggtttccttgtcctactgttctttgcctcgtccaggtctctatctcccaaagacctgcccacctcctgggctctcccagggaagcccctctgggccaaagcccatgggtagcttggctgcctccagaagagatgcagagagctgtggggcgatctttcttagtcccactcaccccactcagggccaaccacagaatgccccctccctgctgagctgggtctctggggcttcccactccaggcctggatcccttccttctataaatagtctcctgcaccaccgtgactccctggctgctccttgccccaaagaaccctcttcctgcatgggagagctgtccctccttctccacctgcccaccgggacactccccctgctctctagaaaggaactctctttcttctcttggcactgggggcgtcaggctgtcggatgttccttccttccataccccagcataccttctccttgcttagagtgcaggggtctgagacagcagccactggggttgaggagggggaggagacccctgagacccagaggtgccccttcctcagctgggagtgggccgcctcatgctctgctggggcctggcatggaacgtgagacctgtaagctgtcccgcgggccccggcaccccgcccagctgtgcactttgctcactcgctctgccatggtgccatgactgtactgtgcccatgcgtgacctggactgtggaccctctgctgctccgcctctcccctccccactggctctgtctgctctcctgccaccctgctggccgggagcccctccccggggagttcttggtgaagtccttcccgggcctccttgtgtttttgcctcattcctactgtcacacaggtcacgagggtggactccctacaatcaacaaagcaaacagagagcctgtgggaggggctgacagcagcagccggctgtttgggggatgatggaggtgacatcaggcagaggagagtgcagcctcacagtgactttctcagaggtgacagagatgatggatgagcagctggattttcgtgatgaaggacggaagcagcagcgggccggcaaggccatacctcggtgagggacaggtggacaacggtcacctatctgtagccaggggcagttgtgtggccagctgtctctctgggatgagtcaggaggcctggaggcttggggagaggtgtggagaaggagagaacatggcccaggccctttccttccccctgtgctgacagcattgctgtgggggtggcccactgccctcccctggccctcatgtccccccggggctggggtccgcctgcctgtgctgtgcttgcgacgtgcatcaataaaccaccatggcctgagggccctgctcgtctc

SEQ ID NO: 5642 - DNA, 1599 bp, Homo sapiens
cctgcctcagcctcgcgagcagctgggactacaggtgcccgccaccacgcccggctaattttttgtatttttagtagagacggggtttcaccgtgttagccaggatggtctcgatttcctgacctcgtgatccgcgcgcctctgcctccaaagtgctgggattacaggcccgagccgccgcacccggcctgcaggtgttgttctgaccccagctccactgtgccagcccgacttgagatgccaagtatcttgggcctgaggattgaggcctagagagaggcaggcgttcctcagagtcacagggaatggcggcgcctggactgggactcagcccagctgcttggcctgaccctctcacagcataatttcccggcacctggaggccgcgcttagaagccgcccagtgccctgagcgtctccatggcctgcctgagcccctcgcagctccagaagttccaacaggatggattcctggtgctggaaggattcttgtctgcggaagagtgtgtggccatgcaacaaaggattggcgagatagtggctgaaatggatgttcctctccactgccgcacagaattctccacccaggaagaggagcagcttcgagcccagggcagcacagactatttcttgagcagtggtgacaagattcgattcttctttgagaaaggcgtttttgatgagaaaggaaatttcctggtccctccggagaaatccatcaacaaaattggccacgctctgcacgcccacgaccccgtcttcaagagcatcacacactccttcaaggtgcagaccttggccagaagtctgggcctccagatgcccgtggtggtgcagagcatgtacatctttaagtctcccctcatcaggacgcctccttcctgtacacggagcccctgggccgggtgctgggcgtgtggatcgcagtggaggatgccacgctggagaacggctgtctctggttcatccctggctcccacaccagtggtgtgtcaagaaggatggtccgggcccctgttggctcagcgcctggtaccagcttccttgggtcagagccagcccgggataacagcctctttgtgcccaccccagtgcagagaggggccctggtcctcatccatggagaagtggtacacaagagcaagcagaacctctctgaccgctcgcgccaggcctacactttccacctcatggaggcctctggcaccacctggagcccggagaactggctccagccaacagctgaactgccctttccccaactgtacacctaaaggctctcgcagggcaggagccctcgcccctcccgggtgaagctgtgggctgtaaacaccagtgccttgctcagcctcctggttgcaacagggaggtcttgtctcccctcctgggctttcctcctgccctgtgggcagcagcctaggctgggtcaggggcttccctaagatcttcacctctctgcctccctactgccccaacatagccttgaggaggcttctcagccaccaaagggttctggccccttctcactctcctctcctctcagatggaactctggttattatggtgttagttatcgaataaaaacgacttcagaatgca

SEQ ID NO: 5643 - DNA, 1374 bp, Homo sapiens
cggcctgcaggtgttgttctgaccccagctccactgtgccagcccgacttgagatgccaagtatcttgggcctgaggattgaggcctagagagaggcaggcgttcctcagagtcacagggaatggcggcgcctggactgggactcagcccagctgcttggcctgaccctctcacagcataatttcccggcacctggaggccgcgcttagaagccgcccagtgccctgagcgtctccatggcctgcctgagcccctcgcagctccagaagttccaacaggatggattcctggtgctggaaggattcttgtctgcggaagagtgtgtggccatgcaacaaaggattggcgagatagtggctgaaatggatgttcctctccactgccgcacagaattctccacccaggaagaggagcagcttcgagcccagggcagcacagactatttcttgagcagtggtgacaagattcgattcttctttgagaaaggcgtttttgatgagaaaggaaatttcctggtccctccggagaaatccatcaacaaaattggccacgctctgcacgcccacgaccccgtcttcaagagcatcacacactccttcaaggtgcagcaacctcactttggcggtgaagtctcccctcatcaggacgcctccttcctgtacacggagcccctgggccgggtgctgggcgtgtggatcgcagtggaggatgccacgctggagaacggctgtctctggttcatccctggctcccacaccagtggtgtgtcaagaaggatggtccgggcccctgttggctcagcgcctggtaccagcttccttgggtcagagccagcccgggataacagcctctttgtgcccaccccagtgcagagaggggccctggtcctcatccatggagaagtggtacacaagagcaagcagaacctctctgaccgctcgcgccaggcctacactttccacctcatggaggcctctggcaccacctggagcccggagaactggctccagccaacagctgaactgccctttccccaactgtacacctaaaggctctcgcagggcaggagccctcgcccctcccgggtgaagctgtgggctgtaaacaccagtgccttgctcagcctcctggttgcaacagggaggtcttgtctcccctcctgggctttcctcctgccctgtgggcagcagcctaggctgggtcaggggcttccctaagatcttcacctctctgcctccctactgccccaacatagccttgaggaggcttctcagccaccaaagggttctggccccttctcactctcctctcctctcagatggaactctggttattatggtgttagttatcgaataaaaacgacttcagaatgca

SEQ ID NO: 5644 - DNA, 2133 bp, Homo sapiens
agcaaacacgacttgactcgaggccaaggctcttgagggctgagcagtgtccccatgcacactcctgaaacactttgtcccttcgccattcagaaggcatcattttggggaaggcagcagccggtttttcagagccagcgagtggccctgccagctgctgagcagggcaagctgagaagggtggtggtgtgcaagtgttattctctctttttgtttttgtttttgttttttgagatggagtcttactctgtcgtccaggctggagtgagtgccgtggcatgatctcggctcactgcaacctccgcctcctgggttcaagcgattctcctgcctcagcctcccgagtaactgggactacaggcacctgccaccatgctcggctagtttttggtatttttatttattatttatttatttattttgagaccgagtctcgctctgtcgcccaggctctagtgcagtggcccaatctcggctcactgcaagctccgcctcccgcgttcacgccattctcctgcctcagcctcgcgagcagctgggactacaggtgcccgccaccacgcccggctaattttttgtatttttagtagagacggggtttcaccgtgttagccaggatggtctcgatttcctgacctcgtgatccgcgcgcctctgcctccaaagtgctgggattacaggcccgagccgccgcacccggcctgcaggtgttgttctgaccccagctccactgtgccagcccgacttgagatgccaagtatcttgggcctgaggattgaggcctagagagaggcaggcgttcctcagagtcacagggaatggcggcgcctggactgggactcagcccagctgcttggcctgaccctctcacagcataatttcccggcacctggaggccgcgcttagaagccgcccagtgccctgagcgtctccatggcctgcctgagcccctcgcagctccagaagttccaacaggatggattcctggtgctggaaggattcttgtctgcggaagagtgtgtggccatgcaacaaaggattggcgagatagtggctgaaatggatgttcctctccactgccgcacagaattctccacccaggaagaggagcagcttcgagcccagggcagcacagactatttcttgagcagtggtgacaagattcgattcttctttgagaaaggcgtttttgatgagaaaggaaatttcctggtccctccggagaaatccatcaacaaaattggccacgctctgcacgcccacgaccccgtcttcaagagcatcacacactccttcaaggtgcagaccttggccagaagtctgggcctccagatgcccgtggtggtgcagagcatgtacatctttaagcaacctcactttggcggtgaagtctcccctcatcaggacgcctccttcctgtacacggagcccctgggccgggtgctgggcgtgtggatcgcagtggaggatgccacgctggagaacggctgtctctggttcatccctggctcccacaccagtggtgtgtcaagaaggatggtccgggcccctgttggctcagcgcctggtaccagcttccttgggtcagagccagcccgggataacagcctctttgtgcccaccccagtgcagagaggggccctggtcctcatccatggagaagtggtacacaagagcaagcagaacctctctgaccgctcgcgccaggcctacactttccacctcatggaggcctctggcaccacctggagcccggagaactggctccagccaacagctgaactgccctttccccaactgtacacctaaaggctctcgcagggcaggagccctcgcccctcccgggtgaagctgtgggctgtaaacaccagtgccttgctcagcctcctggttgcaacagggaggtcttgtctcccctcctgggctttcctcctgccctgtgggcagcagcctaggctgggtcaggggcttccctaagatcttcacctctctgcctccctactgccccaacatagccttgaggaggcttctcagccaccaaagggttctggccccttctcactctcctctcctctcagatggaactctggttattatggtgttagttatcgaataaaaacgacttcagaatgc

SEQ ID NO: 5645 - DNA, 548 bp, Homo sapiens
cctcagcctcgcgagcagctgggactacaggtgcccgccaccacgcccggctaattttttgtatttttagtagagacggggtttcaccgtgttagccaggatggtctcgatttcctgacctcgtgatccgcgcgcctctgcctccaaagtgctgggattacaggcccgagccgccgcacccggcctgcagattgaggcctagagagaggcaggcgttcctcagagtcacagggaatggcggcgcctggactgggactcagcccagctgcttggcctgaccctctcacagcataatttcccggcacctggaggccgcgcttagaagccgcccagtgccctgagcgtctccatggcctgcctgagcccctcgcagctccagaagttccaacaggatggattcctggtgctggaaggattcttgtctgcggaagagtgtgtggccatgcaacaaaggattggcgagatagtggctgaaatggatgttcctctccactgccgcacagaattctccacccaggaagaggagcagcttcgagcccagggcagca

SEQ ID NO: 5646 - DNA, 1182 bp, Homo sapiens
gaggccgcgcttagaagccgcccagtgccctgagcgtctccatggcctgcctgagcccctcgcagctccagaagttccaacaggatggattcctggtgctggaaggattcttgtctgcggaagagtgtgtggccatgcaacaaaggattggcgagatagtggctgaaatggatgttcctctccactgccgcacagaattctccacccaggaagaggagcagcttcgagcccagggcagcacagactatttcttgagcagtggtgacaagattcgattcttctttgagaaaggcgtttttgatgagaaaggaaatttcctggtccctccggagaaatccatcaacaaaattggccacgctctgcacgcccacgaccccgtcttcaagagcatcacacactccttcaaggtgcagcaacctcactttggcggtgaagtctcccctcatcaggacgcctccttcctgtacacggagcccctgggccgggtgctgggcgtgtggatcgcagtggaggatgccacgctggagaacggctgtctctggttcatccctggctcccacaccagtggtgtgtcaagaaggatggtccgggcccctgttggctcagcgcctggtaccagcttccttgggtcagagccagcccgggataacagcctctttgtgcccaccccagtgcagagaggggccctggtcctcatccatggagaagtggtacacaagagcaagcagaacctctctgaccgctcgcgccaggcctacactttccacctcatggaggcctctggcaccacctggagcccggagaactggctccagccaacagctgaactgccctttccccaactgtacacctaaaggctctcgcagggcaggagccctcgcccctcccgggtgaagctgtgggctgtaaacaccagtgccttgctcagcctcctggttgcaacagggaggtcttgtctcccctcctgggctttcctcctgccctgtgggcagcagcctaggctgggtcaggggcttccctaagatcttcacctctctgcctccctactgccccaacatagccttgaggaggcttctcagccaccaaagggttctggccccttctcactctcctctcctctcagatggaactctggttattatggtgttagttatcgaataaaaacgacttcagaatgcagct

SEQ ID NO: 5647 - DNA, 872 bp, Homo sapiens
ctgcagatggatgcgttaattcccttccataatcctcccaggaccgagagggtttcagatcggtgctgggaggggcccagatagttctccccaggacctcttccacctttggaatgcccattacctggagaaggggggtgccgcacatcccccagaccaaccctgcatcccattctatccagattgaggcctagagagaggcaggcgttcctcagagtcacagggaatggcggcgcctggactgggactcagcccagctgcttggcctgaccctctcacagcataatttcccggcacctggaggccgcgcttagaagccgcccagtgccctgagcgtctccatggcctgcctgagcccctcgcagctccagaagttccaacaggatggattcctggtgctggaaggattcttgtctgcggaagagtgtgtggccatgcaacaaaggattggcgagatagtggctgaaatggatgttcctctccactgccgcacagaattctccacccaggaagaggagcagcttcgagcccagggcagcacagactatttcttgagcagtggtgacaagattcgattcttctttgagaaaggcgtttttgatgagaaaggaaatttcctggtccctccggagaaatccatcaacaaaattggccacgctctgcacgcccacgaccccgtcttcaagagcatcacacactccttcaaggtgcagaccttggccagaagtctgggcctccagatgcccgtggtggtgcagagcatgtacatctttaagcaacctcactttggcggtgaagtctcccctcatcaggacgcctccttcctgtacacggagcccctgggccgggtgctgggcgtgtggatcgcagtg

SEQ ID NO: 5648 - DNA, 790 bp, Homo sapiens
actttgtcccttcgccattcagaaggcatcattttggggaaggcagcagccggtttttcagagccagcgagtggccctgccagctgctgagcagggcaagctgagaagggtggtggtgtgcaagtgttattctctctttttgtttttgtttttgttttttgagatggagtcttactctgtcgtccaggctggagtgagtgccgtggcatgatctcggctcactgcaacctccgcctcctgggttcaagcgattctcctgcctcagcctcccgagtaactgggactacaggcacctgccaccatgctcggctagtttttgtagagacggggtttcaccgtgttagccaggatggtctcgatttcctgacctcgtgatccgcgcgcctctgcctccaaagtgctgggattacaggcccgagccgccgcacccggcctgcagattgaggcctagagagaggcaggcgttcctcagagtcacagggaatggcggcgcctggactgggactcagcccagctgcttggcctgaccctctcacagcataatttcccggcacctggaggccgcgcttagaagccgcccagtgccctgagcgtctccatggcctgcctgagcccctcgcagctccagaagttccaacaggatggattcctggtgctggaaggattcttgtctgcggaagagtgtgtggccatgcaacaaaggattggcgagatagtggctgaaatggatgttcctctccactgccgcacagaattctccacccaggaagaggagcagcttcgagcccag

SEQ ID NO: 5649 - DNA, 2136 bp, Homo sapiens
cgcggccgcgacgcccgacgccaacgcaggcgcagcgctccgattcggcgcggctcatggtccggttcgggctcgcgagtctccgtctggggtagggcaggttcttagactctgtgagtaaagacagcttcatcttcccagttcatcatggcttcaacatccagagatgtcattgctgggagaggtatccactcaaaggtgaagtctgcaaagctgcttgaggttctgaatgctatggaggaggaagagtccaacaacaacagggaagagattttcattgcacctcccgacaatgctgcgggggaattcactgatgaggactcaggggatgaagacagccagcgaggtgctcacctacctggcagtgtgctgcatgcttcagtcctgtgtgaggactctggcaccggggaggataatgacgacctggagctgcagccagccaagaagaggcagaaagcagttgtgaaacctcagcgcatttggaccaaaagagatattcgtccagactttggcagttggactgcatcagatcctcatattgaggatctgaaaagccaagagctgagtcccgtgggcctttttgagttgttttttgatgaaggaacaattaatttcattgttaatgaaaccaatcgttatgcttggcagaaaaatgtcaatttgagtcttacggctcaggaattgaagtgtgttttgggcattttgattttaagtgggtacatctcttatccaaggagaaggatgttctgggaaacctctcccgattcacatcatcatcttgtggctgatgcaattagaagggacagatttgaactaatcttctcatacttacattttgcagataacaacgaacttgatgcaagtgataggtttgccaaggtcagacctctcatcatccggatgaactgcaatttccagaagcatgcacccttggaagagttctacagctttggcgagtctatgtgtgagtactttgggcaccgggggtccaagcagctgcacagggggaagcctgtgcgacttggctacaagatttggtgtgggacaaccagcagaggctacttggtgtggtttgagccctcacagggcacactgtttaccaagccagacaggagcttggatctaggaggcagtatggtaataaaatttgtggatgcgcttcaggagcgtggttttctgccatatcacatattttttgacaaggttttcacaagtgttaaactgatgtccattttgaggaaaaagggggtgaaagccacaggaactgttcgtgagtacaggactgagcgatgtcccctaaaagaccccaaagaactgaaaaaaatgaagaggggttcatttgattacaaagtcgatgagagtgaggagatcatcgtgtgccgctggcacgatagcagcgtggtcaacatttgctccaatgctgtgggcatagagccagtgaggctgaccagtcgtcactctggagcagctaaaacgcggactcaggtccaccagccatcactggtgaagctgtatcaggagaaggtgggtggcgttggtaggatggatcagaatattgccaagtacaaggtgaagatccgaggcatgaagtggtactcaagctttattggctatgtcattgatgctgccctcaacaatgcatggcagctgcatagaatctgctgccaagatgcccaggtggacctccttgccttccggagatacattgcctgtgtgtatctggagagcaatgctgacacaacatctcaagggaggcgaagcaggcggttggagactgagagccgcttcgatatgattgggcactggattatccatcaggacaagaggacccggtgtgccctctgccactcacagaccaacacccggtgtgagaagtgccagaagggtgtccatgccaaatgcttcagggagtaccacatccggtgacatcatgagacatgcttctttggtttataatgagatgtttacagttaaatacagatggcagttgagcacttctgttttgtgttggaaaaaagacctgaatttctaatgacttgattttctattttctccctacccacaatacagttatcttttttattgtgttgtgttatgcctacatgtgatataaattaatatttatattcatttata

SEQ ID NO: 5650 - DNA, 2879 bp, Homo sapiens
atggaaggccggccgaggtgcagcgagccctctggtgccggacgttgcgcggccgcgacgcccgacgccaacgcaggcgcagcgctccgattcggcgcggctcatggtccggttcgggctcgcgagtctccgtctggggtagggcaggttcttagactctgtgagtaaagacagcttcatcttcccagttcatcatggcttcaacatccagataacaacgaacttgatgcaagtgataggtttgccaaggtcagacctctcatcatccggatgaactgcaatttccagaagcatgcacccttggaagagttctacagctttggcgagtctatgtgtgagtactttgggcaccgggggtccaagcagctgcacagggggaagcctgtgcgacttggctacaagatttggtgtgggacaaccagcagaggctacttggtgtggtttgagccctcacagggcacactgtttaccaagccagacaggagcttggatctaggaggcagtatggtaataaaatttgtggatgcgcttcaggagcgtggttttctgccatatcacatattttttgacaaggttttcacaagtgttaaactgatgtccattttgaggaaaaagggggtgaaagccacaggaactgttcgtgagtacaggactgagcgatgtcccctaaaagaccccaaagaactgaaaaaaatgaagaggggttcatttgattacaaagtcgatgagagtgaggagatcatcgtgtgccgctggcacgatagcagcgtggtcaacatttgctccaatgctgtgggcatagagccagtgaggctgaccagtcgtcactctggagcagctaaaacgcggactcaggtccaccagccatcactggtgaagctgtatcaggagaaggtgggtggcgttggtaggatggatcagaatattgccaagtacaaggtgaagatccgaggcatgaagtggtactcaagctttattggctatgtcattgatgctgccctcaacaatgcatggcagctgcatagaatctgctgccaagatgcccaggtggacctccttgccttccggagatacattgcctgtgtgtatctggagagcaatgctgacacaacatctcaagggaggcgaagcaggcggttggagactgagagccgcttcgatatgattgggcactggattatccatcaggacaagaggacccggtgtgccctctgccactcacagaccaacacccggtgtgagaagtgccagaagggtgtccatgccaaatgcttcagggagtaccacatccggtgacatcatgagacatgcttctttggtttataatgagatgtttacagttaaatacagatggcagttgagcacttctgttttgtgttggaaaaaagacctgaatttctaatgacttgattttctattttctccctacccacaatacagttatcttttttattgtgttgtgttatgcctacatgtgatataaattaatatttatattcatttatatttatatttttgaacttatttatttaaagttatggatcactttttattcaaataaaagttgtgctttggggtatatttgaatcctagcaagaataatcaaaggaaaacttgcaagaacagtaagaagactttaccattgcatgccatggtttataatctaagataggcaatagtgtataaatatcatgtaaatgtgatggatttcttaatcatatttatttcatattaatccaagtttatcaaacttttgagggataatctgccttgtatttagtcagagggctagaggtgcagatttcatattttcttaatgaaaatattttcctaatacacatatatcaatgtgagattcatttttgtaaaaaaaattatttttttaattttgtgggtacatagtaggagtgtatttttatgggttacatgagatattctgatacaaacatgcaatgtataaaaatcacatcagggtaaatggggtatccatcttgtcaaacacttgtcctttgtgtttcaaacaatccaattatactgttagttattttaaaatgtgcaattaaattatttttaactatattcaccctgttgtgctagcaaatactaggtcttactcattctttctattttttcatacccattaactattcccactctcccccaccccctaactaccctttccaagctctggtaaccttctttccactctgtgtgtccatgagttcaattgttttcatttttagctcccacaaataagtgagaacatctgaagtttgtctgtctttgcttggcttatttcacttaacataatgacctccagttccattcatgttgttgcaaatgactgaatatcatttttttgtggctaaatattaatcacacttcattgtgtatatgtacattttctttatccattcttctgttgatggacacttaggttgctcccaaatcatgactattgagaatagtgcagaaaataaacatgagttcagatctttcttcaatatactgatttttttttcttttggatgtatacttaggaatgggattcctgaatcatatggtagctctatttttagtttttgaggaagcttcaaactgttctccatagaggttgtactaatttacattcccaccagcagtgttcaagggttcccttttctccacatccttgccagcatttgttattgtctgtcttttggattacagccatttctgcccggatgagatatctcaatgtagttttcacttgcatttttctgttgatcagtgatgttgagcactttttttatacctgtttgccatttgtaccttttgtttttattttgagatggagttgccttgtcacccaggctggaatgcagtggtgcgcaatctcg

SEQ ID NO: 5651 - DNA, 2232 bp, Homo sapiens
aacgcaggcgcagcgctccgattcggcgcggctcatggtccggttcgggctcgcgagtctccgtctggggtagggcaggttcttagactctgtgagtaaagacagcttcatcttcccagttcatcatggcttcaacatccagagcttggatgagtgaatacctcacctccctggaggtcagcatggcagctgacagtcagtctccaggaagtgaggttggagtgaatttctaatgcagcctgaactccaaagtccatgggcagagatgtcattgctgggagaggtatccactcaaaggtgaagtctgcaaagctgcttgaggttctgaatgctatggaggaggaagagtccaacaacaacagggaagagattttcattgcacctcccgacaatgctgcgggggaattcactgatgaggactcaggggatgaagacagccagcgaggtgctcacctacctggcagtgtgctgcatgcttcagtcctgtgtgaggactctggcaccggggaggataatgacgacctggagctgcagccagccaagaagaggcagaaagcagttgtgaaacctcagcgcatttggaccaaaagagatattcgtccagactttggcagttggactgcatcagatcctcatattgaggatctgaaaagccaagagctgagtcccgtgggcctttttgagttgttttttgatgaaggaacaattaatttcattgttaatgaaaccaatcgttatgcttggcagaaaaatgtcaatttgagtcttacggctcaggaattgaagtgtgttttgggcattttgattttaagtgggtacatctcttatccaaggagaaggatgttctgggaaacctctcccgattcacatcatcatcttgtggctgatgcaattagaagggacagatttgaactaatcttctcatacttacattttgcagataacaacgaacttgatgcaagtgataggtttgccaaggtcagacctctcatcatccggatgaactgcaatttccagaagcatgcacccttggaagagttctacagctttggcgagtctatgtgtgagtactttgggcaccgggggtccaagcagctgcacagggggaagcctgtgcgacttggctacaagatttggtgtgggacaaccagcagaggctacttggtgtggtttgagccctcacagggcacactgtttaccaagccagacaggagcttggatctaggaggcagtatggtaataaaatttgtggatgcgcttcaggagcgtggttttctgccatatcacatattttttgacaaggttttcacaagtgttaaactgatgtccattttgaggaaaaagggggtgaaagccacaggaactgttcgtgagtacaggactgagcgatgtcccctaaaagaccccaaagaactgaaaaaaatgaagaggggttcatttgattacaaagtcgatgagagtgaggagatcatcgtgtgccgctggcacgatagcagcgtggtcaacatttgctccaatgctgtgggcatagagccagtgaggctgaccagtcgtcactctggagcagctaaaacgcggactcaggtccaccagccatcactggtgaagctgtatcaggagaaggtgggtggcgttggtaggatggatcagaatattgccaagtacaaggtgaagatccgaggcatgaagtggtactcaagctttattggctatgtcattgatgctgccctcaacaatgcatggcagctgcatagaatctgctgccaagatgcccaggtggacctccttgccttccggagatacattgcctgtgtgtatctggagagcaatgctgacacaacatctcaagggaggcgaagcaggcggttggagactgagagccgcttcgatatgattgggcactggattatccatcaggacaagaggacccggtgtgccctctgccactcacagaccaacacccggtgtgagaagtgccagaagggtgtccatgccaaatgcttcagggagtaccacatccggtgacatcatgagacatgcttctttggtttataatgagatgtttacagttaaatacagatggcagttgagcacttctgttttgtgttggaaaaaagacctgaatttctaatgacttgattttctattttctccctacccacaatacagttatcttttttattgtgttgtgttatgcctacatgtgatataaattaatatttatattcattt

SEQ ID NO: 5652 - DNA, 2212 bp, Homo sapiens
ctatgagctgaagcctctgcccaagggcgggaaacggcagaagaaagtgccagtgcaggagattgatgatgactttttcccaagttctggggaagaagctgaagctgcttctgtaggagaaggaggaggaggaggtcggaaagtgggaagataccgagatgatggagatgaagattattataagcagcggttaagtcccaagatgcctcgaacactaagtttacatgaaataactgaccttttagagacagatgacagcatagaagcaagtgctatagtgatacaaccacctgaaaatgctacagcacctgtttctgatgaggaatcaggagatgaagaaggtggaacaataaataatctgccaggttctttgttgcacacagctgcgtatcttattcaagatggctctgatgctgagtctgactcagatgatccctcatacgcacctaaagatgactctcctgatgaagttccatctacgtttactgtgcagcaacctccaccatcaaggaggaggaaaatgacaaaaattctttgcaaatggaaaaaagccgacctaactgtacaacccgtagcaggtagagttacagcaccaccaaacgatttcttcaccgtaatgagaactcccacagaaattcttgaactttttcttgatgacgaggtcattgaactcattgtcaagtactccaacttatatgcttgcagtaaaggtgtacatcttggcttgactagctctgaattcaaatgttttctgggaattatttttctgagtggttatgtctcagttcctagaaggcgtatgttttgggaacaaagaacagatgtgcataatgtactggttagtgctgccatgagacgtgaccggtttgaaactatattttctaatttgcatgttgctgacaatgcaaatttggatccagtggacaaattttccaaattgcgacctctcataagcaaacttaatgagagatgcatgaaatttgttccaaatgaaacatatttcagctttgatgaattcatggttccttattttggtcgtcacgggtgcaaacaatttattcggggaaagcccattcggtttggctataagttttggtgtggtgccacctgtctgggctacatttgctggtttcagccgtatcagggtaaaaacccaaatactaaacatgaggaatatggtgtcggtgcgtcacttgtccttcagtttagtgaggcacttacagaggcacaccctggacaataccattttgtattcaataactttttcaccagtattgcacttcttgataagctcagttcaatgggacatcaggcaacaggtacagtgagaaaggatcacattgacagagttccactggaatcagatgtagctttaaagaaaaaagaaagaggcacatttgattatcgaattgatggcaaaggcaatattgtctgcagatggaatgataacagtgttgtcactgttgcctcatctggtgctggtatccatcccctgtgtcttgtcagtcgttactcccagaaactgaaaaagaagatacaagttcagcagccaaacatgatcaaagtgtataaccagttcatgggaggcgtagacagagctgatgaaaacattgataagtatcgggcatcaatccgtggaaagaaatggtattcaagccctcttttgttctgtttcgaactggtcttacaaaatgcttggcaattgcataaaacatatgatgagaaaccagtggattttctggagtttcgtcgacgtgtggtatgccattatctggagacccatggtcatcctccagaacctggccaaaaaggaagacctcagaagcgtaacattgactcacgttatgatggcataaatcatgtgatagtcaaacagggaaagcaaacgcgatgcgctgaatgtcataagaacacaacttttcgatgtgaaaaatgtgatgttgccttacatgtgaagtgttccgttgaatatcacactgaatagcaggtgtcaccacctcctgagataagaaacatagttttatacattatgtacagtgtagcagtggttttgcctagtgttccaattttggaacgtcacataacaatggaacataataaatttttttttctcttcaaatttttgttccttgaatttttctaggtaacatatatgaatttcatgcaaaaattcaaaaaattgtaacctcagacataaatgggttaaagatgt

SEQ ID NO: 5653 - DNA, 1782 bp, Homo sapiens
atgcctcgaacactaagtttacatgaaataactgaccttttagagacagatgacagcatagaagcaagtgctatagtgatacaaccacctgaaaatgctacagcacctgtttctgatgaggaatcaggagatgaagaaggtggaacaataaataatctgccaggttctttgttgcacacagctgcgtatcttattcaagatggctctgatgctgagtctgactcagatgatccctcatacgcacctaaagatgactctcctgatgaagttccatctacgtttactgtgcagcaacctccaccatcaaggaggaggaaaatgacaaaaattctttgcaaatggaaaaaagccgacctaactgtacaacccgtagcaggtagagttacagcaccaccaaacgatttcttcaccgtaatgagaactcccacagaaattcttgaactttttcttgatgacgaggtcattgaactcattgtcaagtactccaacttatatgcttgcagtaaaggtgtacatcttggcttgactagctctgaattcaaatgttttctgggaattatttttctgagtggttatgtctcagttcctagaaggcgtatgttttgggaacaaagaacagatgtgcataatgtactggttagtgctgccatgagacgtgaccggtttgaaactatattttctaatttgcatgttgctgacaatgcaaatttggatccagtggacaaattttccaaattgcgacctctcataagcaaacttaatgagagatgcatgaaatttgttccaaatgaaacatatttcagctttgatgaattcatggttccttattttggtcgtcacgggtgcaaacaatttattcggggaaagcccattcggtttggctataagttttggtgtggtgccacctgtctgggctacatttgctggtttcagccgtatcagggtaaaaacccaaatactaaacatgaggaatatggtgtcggtgcgtcacttgtccttcagtttagtgaggcacttacagaggcacaccctggacaataccattttgtattcaataactttttcaccagtattgcacttcttgataagctcagttcaatgggacatcaggcaacaggtacagtgagaaaggatcacattgacagagttccactggaatcagatgtagctttaaagaaaaaagaaagaggcacatttgattatcgaattgatggcaaaggcaatattgtctgcagatggaatgataacagtgttgtcactgttgcctcatctggtgctggtatccatcccctgtgtcttgtcagtcgttactcccagaaactgaaaaagaagatacaagttcagcagccaaacatgatcaaagtgtataaccagttcatgggaggcgtagacagagctgatgaaaacattgataagtatcgggcatcaatccgtggaaagaaatggtattcaagccctcttttgttctgtttcgaactggtcttacaaaatgcttggcaattgcataaaacatatgatgagaaaccagtggattttctggagtttcgtcgacgtgtggtatgccattatctggagacccatggtcatcctccagaacctggccaaaaaggaagacctcagaagcgtaacattgactcacgttatgatggcataaatcatgtgatagtcaaacagggaaagcaaacgcgatgcgctgaatgtcataagaacacaacttttcgatgtgaaaaatgtgatgttgccttacatgtgaagtgttccgttgaatatcacactgaatag

SEQ ID NO: 5654 - DNA, 2318 bp, Homo sapiens
tgtgtcaagtgcctatgaaggggactgcccatgaagtgaaagtcaagtgtgtgttgctgcggcagccacggaggccaaggacctcacgggagtaaaagatgacgagactggcttcgggagaaacaccatccagaagagacctttcaaaaaacttctagagactccccaagacgtatgagatgaaaggcttcttctgtctgtgtgcgtttaactcatttctccttagccccgagattacgcgctgctgtgcctgcgactgcagcgtttacgccgagataactcgtggattacagtgccaaccttactcccaaagtttgccacgaaatatctcgcttctgttattttcgcatggttctggtatattgacttttgaaacaaaagacatcattctgtttatagcattctgtttttagtagtgggatttccatctacaaaatatagtaattctcgatcgctgaaatgtcaaatcctagaaaacgtagcattcctatgcgtgatagtaataccggtctcgaacagttgttggctgaagattcatttgatgaatctgatttttcggaaatagatgattctgataatttttcggatagtgctttagaagccgataagatcaggcctctgtcccatttagaatctgatggaaagagctctacatcaagtgactcagggcgctccatgaaatggtcagctcgtgctatgattccacgtcaaaggtatgactttaccggcacacctggcagaaaagtcgatgtcagtgatatcactgacccattgcagtattttgaactgttctttactgaggaattagtttcaaaaattactagagaaacaaatgcccaagctgccttgttggcttcaaagccaccgggtccgaaaggattttcgcgaatggataaatggaaagacactgacaatgacgagctcaaagtcttttttgcagtaatgttactgcaaggtattgtgcagaaacctgagctggagatgttttggtcaacaaggcctcttttggatacaccttatctcaggcaaattatgactggtgaaagatttttacttttgtttcggtgcctgcattttgtcaacaattcttctatatctgctggtcaatcaaaggcccagatttcattgcagaagatcaaacctgtgttcgactttcttgtaaataaattttccactgtatatactccaaacagaaacattgcagttgatgaatcactgatgctgttcaaggggccattagctatgaagcagtacctcccgacaaaacgagtacgatttggtctgaagctatatgtactttgtgaaagtcagtctggttatgtgtggaatgcgcttgttcacacagggcctggcatgaatttgaaagattcagcggatggcctgaaatcatcacgcattgttcttaccttggtcaatgaccttcttggccaagggtattgtgtcttcctcgataactttaatatatctcccatgcttttcagagaattacatcaaaataggactgatgcagttgggacagctcgtttgaacagaaaacagattccaaatgatctgaaaaaaaggattgcaaaggggacgactgtagccagattctgtggtgaacttatggcactgaaatggtgtgacggcaaggaggtgacaatgttgtcaacattccacaatgatactgtgattgaagtaaacaatagaaatggaaagaaaactaaaaggccacgtgtcattgtggattataacgagaatatgggagcagtggactcggctgatcaaatgcttacttcttatccatctgagcgcaaaagacacaaggtttggtataagaaattctttcaccatcttctacacattacagtgctgaactcctacatcctgttcaagaaggataatcctgagcacacgatgagccatataaacttcagactggcattgattgaaagaatgctggaaaagcatcacaagccagggcagcaacatcttcgaggtcgtccttgctccgatgatgtcacacctcttcgtctgtctggaagacatttccccaagagcataccagcaacgtccgggaaacagaatccaactggtcgctgcaaaatttgctgctcccaatacgacaaggatggcaagaagatccggaaagaaacgcgctatttttgtgccgaatgtgatgttccgctttgtgttgttccgtgctttgaaatttaccacacgaaaaaaaattattaaataccgatcatcatacacatctgttccattaggattagagacaagttctgtttagaaataactccaagattgggaggccgacctgggtggatcacctgaga

SEQ ID NO: 5655 - DNA, 1241 bp, Homo sapiens
cgggcgctttcctggaagagaagtgggtcaggcccaactgaaaagcaagcctggcaccagaagggggacattccggaactagatatgaagagacttttctccctgaagttccccggacccaattagatgttgtacccaggctggttaccctggtaacaggcgtcgcggtttgtcaaggaactgagagaagaggcttaagaaaattattcaccactcataagtcatggagacatcctcaaaaggtctgcttacccaagttactcagttttggaacctcctagatgatctagctcagagtgaccctgagggctatgagaagtttattcagcagcagctgaaagaagggaaacagctctgtgctgccccagaaccacagctttgtctacagaccaggattctgaaaccaaaagaaaaaatactttttatcaacctgtgtcagtggacaaggatcccagctccccaatcaaccactcatccagtacctctaactgttggcaaaccagaagatacaactgagatatcagatgcttacacagtcattgatgttgcctacaatcctgatgttcttcatgcagcagaaaaggaccaagtgaaaaaaaatcagttaattcagatggccatgaaatgcattgaggagaaattccagttcaccctctcacactcttaccatattaccaaatttagaataaaaggaagcattcaaagaatgaaacaaaatctgatgggaatccaaactgattccatagatttaagagaaaaaatgagaagggaactaactcttggacagatacgaagcagtactatgagcaatccagatcactttcctcaactgttactgccaaaagaccaagtttcaggcaaagcagtgtgtctgatagaagagatttccagtactgaaatccaggtggagatgaagatgccagcctatgaactaaaaattgtgcatgatcacagtgagaaacctctgaaaattgagttgaaagttgaattacctggtattaattctgtctctctctgtgaccttagtgtttctgaggatgatttattgattgaagtatctgagaagtacagattacatctgaatcttccaaaacttattgatactgaaatgaccacagcaaaatttatcaaagaaaaatccacgctaatcatcacaatgcctttggtgtgaaagaagagcatcatatgttttgggttttcagtgctaaagtcatgtgaattaaaggaccttcattttggct

SEQ ID NO: 5656 - DNA, 1245 bp, Homo sapiens
cgggcgctttcctggaagagaagtgggtcaggcccaactgaaaagcaagcctggcaccagaagggggacattccggaactagatatgaagagacttttctccctgaagttccccggacccaattagatgttgtacccaggctggttaccctggtaacaggcgtcgcggtttgtcaaggaactgagagaagaggcttaagaaaattattcaccactcataagtcatggagacatcctcaaaaggtctgcttacccaagttactcagttttggaacctcctagatgatctagctcagagtgaccctgagggctatgagaagtttattcagcagcagctgaaagaagggaaacagctctgtgctgccccagaaccacagctttgtctacagaccaggattctgaaaccaaaagaaaaaatactttttatcaacctgtgtcagtggacaaggatcccagctccccaatcaaccactcatccagtacctctaactgttggcaaaccagaagatacaactgagatatcagatgcttacacagtcattgatgttgcctacaatcctgatgttcttcatgcagcagaaaaggaccaagtgaaaaaaaatcagttaattcagatggccatgaaatgcattgaggagaaattccagttcaccctctcacactcttaccatattaccaaatttagaataaaaggaagcattcaaagaatgaaacaaaatctgatgggaatccaaactgattccatagatttaagagaaaaaatgagaagggaactaactcttggacagatacgaagcagtactatgagcaatccagatcactttcctcaactgttactgccaaaagaccaagtttcaggcaaagcagtgtgtctgatagaagagatttccagtactgaaatccaggtggagatgaagatgccagcctatgaactaaaaattgtgcatgatcacagtgagaaacctctgaaaattgagttgaaagttgaattacctggtattaattctgtctctctctgtgaccttagtgtttctgagggaacaacagaaccacaagcattagcgaaagatgaattatctttgaagttttgaatgtttgaaccagatttggatcatattgatgatggtcccttgtgataagcttgtttcttttggataatcttcaacctaaaattactaattactgaaaaatcaaattaatgtattgttttcataataatacagcaaggtaaaagtctgtgtggaat

SEQ ID NO: 5657 - DNA, 1025 bp, Homo sapiens
atggagacatcctcaaaaggtctgcttacccaagttactcagttttggaacctcctagatgatctagctcagagtgaccctgagggctatgagaagtttattcagcagcagctgaaagaagggaaacagctctgtgctgccccagaaccacagctttgtctacagaccaggattctgaaaccaaaagaaaaaatactttttatcaacctgtgtcagtggacaaggatcccagctccccaatcaaccactcatccagtacctctaactgttggcaaaccagaagatacaactgagatatcagatgcttacacagtcattgatgttgcctacaatcctgatgttcttcatgcagcagaaaaggaccaagtgaaaaaaaatcagttaattcagatggccatgaaatgcattgaggagaaattccagttcaccctctcacactcttaccatattaccaaatttagaataaaaggaagcattcaaagaatgaaacaaaatctgatgggaatccaaactgattccatagatttaagagaaaaaatgagaagggaactaactcttggacagatacgaagcagtactatgagcaatccagatcactttcctcaactgttactgccaaaagaccaagtttcaggcaaagcagtgtgtctgatagaagagatttccagtactgaaatccaggtggagatgaagatgccagcctatgaactaaaaattgtgcatgatcacagtgagaaacctctgaaaattgagttgaaagttgaattacctggtattaattctgtctctctctgtgaccttagtgtttctgagggaacaacagaaccacaagcattagcgaaagatgaattatctttgaagttttgaatgtttgaaccagatttggatcatattgatgatggtcccttgtgataagcttgtttcttttggataatcttcaacctaaaattactaattactgaaaaatcaaattaatgtattgttttcataataatacagcaaggtaaaagtctgtgtggaatata

SEQ ID NO: 5658 - DNA, 1103 bp, Homo sapiens
ggtgggtttgccaacctatagaatgattacccgttagaactgagagaagaggcttaagaaaattattcaccactcataagtcatggagacatcctcaaaaggtctgcttacccaagttactcagttttggaacctcctagatgatctagctcagagtgaccctgagggctatgagaagtttattcagcagcagctgaaagaagggaaacagctctgtgctgccccagaaccacagctttgtctacagaccaggattctgaaaccaaaagaaaaaatactttttatcaacctgtgtcagtggacaaggatcccagctccccaatcaaccactcatccagtacctctaactgttggcaaaccagaagatacaactgagatatcagatgcttacacagtcattgatgttgcctacaatcctgatgttcttcatgcagcagaaaaggaccaagtgaaaaaaaatcagttaattcagatggccatgaaatgcattgaggagaaattccagttcaccctctcacactcttaccatattaccaaatttagaataaaaggaagcattcaaagaatgaaacaaaatctgatgggaatccaaactgattccatagatttaagagaaaaaatgagaagggaactaactcttggacagatacgaagcagtactatgagcaatccagatcactttcctcaactgttactgccaaaagaccaagtttcaggcaaagcagtgtgtctgatagaagagatttccagtactgaaatccaggtggagatgaagatgccagcctatgaactaaaaattgtgcatgatcacagtgagaaacctctgaaaattgagttgaaagttgaattacctggtattaattctgtctctctctgtgaccttagtgtttctgaggatgatttattgattgaagtatctgagaagtacagattacatctgaatcttccaaaacttattgatactgaaatgaccacagcaaaatttatcaaagaaaaatccacgctaatcatcacaatgcctttggtgtgaaagaagagcatcatatgttttgggttttcagtgctaaagtcatgtgaattaaaggaccttcattttggctaaa

SEQ ID NO: 5659 - DNA, 1603 bp, Homo sapiens
gcgcggcgcgcttagttgccggagctgaacggcgcggagctggtctgaggcgagccgagccgagcgagcgcggcggtggggccgagaggacgcgcaggtggcggcgttgccatgtcgcacggtcacagccacggcgggggtggctgccgctgcgccgccgaacgggaggagccgcccgagcagcgcggcctggcctacggcctgtacctgcgcatcgacctggagcggctgcaatgccttaacgagagccgcgagggcagcggccgcggcgtcttcaagccgtgggaggagcggaccgaccgctccaagtttgttgaaagtgatgcagatgaagagcttctgtttaatattccatttacgggcaatgtcaagctcaaaggcatcattataatgggagaggatgatgactcacacccctctgagatgagactgtacaagaatattccacagatgtcctttgatgatacagaaagggagccagatcagacctttagtctgaaccgggatcttacaggagaattagagtatgctacaaaaatttctcgtttttcaaatgtctatcatctctcaattcatatttcaaaaaacttcggagcagatacgacaaaggtcttttatattggcctgagaggagagtggactgagcttcgccgacacgaggtgaccatctgcaattacgaagcatctgccaacccagcagaccatagggtccatcaggttaccccacagacacactttatttcctaagggctggccaaggctcccatagaggcgctgtgtcagtgaagatgtacgactacctgttgggaaggacaaagggatgaggctccagagagagttggctgccacagcctctgccaagctttgtctttggggcttgctgcagaaacctggcctacggaagatacgacaccactgggagggttgtgtaggtgccaggggaccatcgtggttctctagggcgctgtggaaattgggtcttgggctgggtggcatctggcagtcatgggtaacacttgcttttccagttaatgtggccatgtgattccaagtgtcatgttgctttgtggcaagattgttgtgtgacttgtttttttgtttttgtttttgtttttttaaaggaaactatttgtgggctataggaaactttctgatgcctccggattgtgttagtagtagccatcaggagggtctccaactaaaacacttgttcctgcttgctcctttcccctctcattgttcagcattcttgtcaagttgcccagcttggagttgtctgtcacgcacatgtgtcctgtggttatagctagaaggacaggagtctcctgctgatgcgtgatagcttaagcttggggagaaggtcttttccactgcctagctaagcagtctggggagagcatggggatcatttctatgtgtgtgggtaatctggtcagtaagattgagacttagttaagattccccttggaaattccttaatgtttattagcttctaactagtgttgtaagtccgatgccagaatttggagatttgagttcttcttttcatggcttttattcactgtgactaataagcttcctaataaatccttgccagacttaa

SEQ ID NO: 5660 - DNA, 1292 bp, Homo sapiens
tggattaaagatatttgtaggctagacgcggtggctcatgcctgtaattccagcactttcggagaccgacgtaggcggatcacctgaggttgggagttagagaccagcattgccaacatggtacaagaatattccacagatgtcctttgatgatacagaaagggagccagatcagacctttagtctgaaccgggatcttacaggagaattagagtatgctacaaaaatttctcgtttttcaaatgtctatcatctctcaattcatatttcaaaaaacttcggagcagatacgacaaaggtcttttatattggcctgagaggagagtggactgagcttcgccgacacgaggtgaccatctgcaattacgaagcatctgccaacccagcagaccatagggtccatcaggttaccccacagacacactttatttcctaagggctggccaaggctcccatagaggcgctgtgtcagtgaagatgtacgactacctgttgggaaggacaaagggatgaggctccagagagagttggctgccacagcctctgccaagctttgtctttggggcttgctgcagaaacctggcctacggaagatacgacaccactgggagggttgtgtaggtgccaggggaccatcgtggttctctagggcgctgtggaaattgggtcttgggctgggtggcatctggcagtcatgggtaacacttgcttttccagttaatgtggccatgtgattccaagtgtcatgttgctttgtggcaagattgttgtgtgacttgtttttttgtttttgtttttgtttttttaaaggaaactatttgtgggctataggaaactttctgatgcctccggattgtgttagtagtagccatcaggagggtctccaactaaaacacttgttcctgcttgctcctttcccctctcattgttcagcattcttgtcaagttgcccagcttggagttgtctgtcacgcacatgtgtcctgtggttatagctagaaggacaggagtctcctgctgatgcgtgatagcttaagcttggggagaaggtcttttccactgcctagctaagcagtctggggagagcatggggatcatttctatgtgtgtgggtaatctggtcagtaagattgagacttagttaagattccccttggaaattccttaatgtttattagcttctaactagtgttgtaagtccgatgccagaatttggagatttgagttcttcttttcatggcttttattcactgtgactaataagcttcctaataaatccttgccagacttaa

SEQ ID NO: 5661 - DNA, 754 bp, Homo sapiens
agcagggtgggagatgcctgaaattgtaggctctcagcaaatatttgttgctttctcctcccccctccccatcccctccagtttgttgaaagtgatgcagatgaagagcttctgtttaatattccgtaagtatctccttggtgcctacctcaggctaaataggctgtacccagttgcctcagatggattcattcactggtgtcaagagcacacatttgcttctagaaatgggataaattactttggtgggtttgaggaggaaagcatcatagctttcttggtgcagactggaaacagatgtatttgtagaacaataactgagaaattgaggtagatttcttagaattgtagaatgctagaggtagacaggatcttagaaattatctagtacaagttgacagatgagtaaactgaagcccatacaggggaagggtcttgcccagggtcacacaactaaacaggtattcaaactcaggtttgacaaccttctcttttgcattctggcagatttacgggcaatgtcaagctcaaaggcatcattataatgggagaggatgatgactcacacccctctgagatgagactgtacaagaatattccacagatgtcctttgatgatacagaaagggagccagatcagacctttagtctgaaccgggatcttacaggagaattagagtatgctacaaaaatttctcgtttttcaaatgtctatcatctctcaattcatatttcaaaaaacttcggagcagat

SEQ ID NO: 5662 - DNA, 3450 bp, Homo sapiens
ggggttcctcgccagccaggtgctcgtcatgcgcaatgtggcgctgcggcgggcggcagggcctgtgtgtgctgaggcggctgagcggcggacatgcacaccacagagcgtggcgatggaacagtaaccgggcttgtgagagggctctgcagtataaactaggagacaagatccatggattcaccgtaaaccaggtgacatctgttcccgagctgttcctgactgcagtgaagctcacccatgatgacacaggagccaggtatttacacctggccagagaagacacgaataatctgttcagcgtgcagttccgtactactcccatggacagtactggtgttcctcacattcttgagcataccgtcctttgtgggtctcagaaatatccgtgcagagaccctttcttcaaaatgttgaaccggtccctctccacgttcatgaacgccttcacagctagtgattatactctgtatccattttccacacaaaatcccaaggactttcagaatctcctctcggtgtatttggatgccacctttttcccatgtttacgcgagctggatttctggcaggaaggatggcggctggaacatgagaatccgagcgacccccagacgcccttggtctttaaaggagtcgtctttaatgagatgaagggagcgtttgtaaacaatgagaggatattctcccagcaccttcagaacagacttcttcctgaccacacgtactcagtggtctccgggggtgacccactgtgcatcccggagcttacatgggagcagcttaagcagtttcatgccactcactatcacccaagcaatgctaggttcttcacgtacggtaattttccattagaacagcatctgaaacaaattcacgaggaagcactgagcaaattccagaaaattgaaccaagcaccgtggtgccagctcagacaccctgggacaagcctagggaattccagataacatgtggcccggattcatttgctacagatccctctaaacaaacaaccatcagcgttagcttcctcttaccggacatcaccgacacatttgaagccttcacattaagtcttctgtcttcactcttgacttctgggcccaattctcccttttacaaagccttgattgaatctggccttggcacagacttttctcctgatgttggatataatggctacacgagggaggcctactttagtgtcggcctccaagggattgcggagaaagacattgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaagctgggctgcggccttcttgactaccgggagcaggctcagcagatagaattgaagaccggagggatgagtgcttctccccacgtgctccccgacgactcacacatggacacctacgagcagggtgtgcttttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccgcgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggaatggaccacttcttgtacggcctctcggatgagatgaagcaggcccacagagagcagctctttgctgtcagccacgacaagctcctggccgtgagcgatagatacctcggcactgggaagagcacacacggcctggccatcctcggacccgagaacccgaaaattgccaaggacccatcctggatcatccaatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctgactt

SEQ ID NO: 5663 - DNA, 3426 bp, Homo sapiens
agagggggttcctcgccagccaggtgctcgtcatgcgcaatgtggcgctgcggcgggcggcagggcctgtgtgtgctgaggcggctgagcggcggacatgcacaccacagagcgtggcgatggaacagtataaactaggagacaagatccatggattcaccgtaaaccaggtgacatctgttcccgagctgttcctgactgcagtgaagctcacccatgatgacacaggagccaggtatttacacctggccagagaagacacgaataatctgttcagcgtgcagttccgtactactcccatggacagtactggtgttcctcacattcttgagcataccgtcctttgtgggtctcagaaatatccgtgcagagaccctttcttcaaaatgttgaaccggtccctctccacgttcatgaacgccttcacagctagtgattatactctgtatccattttccacacaaaatcccaaggactttcagaatctcctctcggtgtatttggatgccacctttttcccatgtttacgcgagctggatttctggcaggaaggatggcggctggaacatgagaatccgagcgacccccagacgcccttggtctttaaaggagtcgtctttaatgagatgaagggagcgtttacagacaatgagaggatattctcccagcaccttcagaacagacttcttcctgaccacacgtactcagtggtctccgggggtgacccactgtgcatcccggagcttacatgggagcagcttaagcagtttcatgccactcactatcacccaagcaatgctaggttcttcacgtacggtaattttccattagaacagcatctgaaacaaattcacgaggaagcactgagcaaattccagaaaattgaaccaagcaccgtggtgccagctcagacaccctgggacaagcctagggaattccagataacatgtggcccggattcatttgctacagatccctctaaacaaacaaccatcagcgttagcttcctcttaccggacatcaccgacacatttgaagccttcacattaagtcttctgtcttcactcttgacttctgggcccaattctcccttttacaaagccttgattgaatctggccttggcacagacttttctcctgatgttggatataatggctacacgagggaggcctactttagtgtcggcctccaagggattgcggagaaagacattgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaagctgggctgcggccttcttgactaccgggagcaggctcagcagatagaattgaagaccggagggatgagtgcttctccccacgtgctccccgacgactcacacatggacacctacgagcagggtgtgcttttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccgcgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggaatggaccacttcttgtacggcctctcggatgagatgaagcaggcccacagagagcagctctttgctgtcagccacgacaagctcctggccgtgagcgatagatacctcggcactgggaagagcacacacggcctggccatcctcggacccgagaacccgaaaattgccaaggacccatcctggatcatccaatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctgactt

SEQ ID NO: 5664 - DNA, 3457 bp, Homo sapiens
agagggggttcctcgccagccaggtgctcgtcatgcgcaatgtggcgctgcggcgggcggcagggcctgtgtgtgctgaggcggctgagcggcggacatgcacaccacagagcgtggcgatggaacagtaaccgggcttgtgagagggctctgcagtataaactaggagacaagatccatggattcaccgtaaaccaggtgacatctgttcccgagctgttcctgactgcagtgaagctcacccatgatgacacaggagccaggtatttacacctggccagagaagacacgaataatctgttcagcgtgcagttccgtactactcccatggacagtactggtgttcctcacattcttgagcataccgtcctttgtgggtctcagaaatatccgtgcagagaccctttcttcaaaatgttgaaccggtccctctccacgttcatgaacgccttcacagctagtgattatactctgtatccattttccacacaaaatcccaaggactttcagaatctcctctcggtgtatttggatgccacctttttcccatgtttacgcgagctggatttctggcaggaaggatggcggctggaacatgagaatccgagcgacccccagacgcccttggtctttaaaggagtcgtctttaatgagatgaagggagcgtttacagacaatgagaggatattctcccagcaccttcagaacagacttcttcctgaccacacgtactcagtggtctccgggggtgacccactgtgcatcccggagcttacatgggagcagcttaagcagtttcatgccactcactatcacccaagcaatgctaggttcttcacgtacggtaattttccattagaacagcatctgaaacaaattcacgaggaagcactgagcaaattccagaaaattgaaccaagcaccgtggtgccagctcagacaccctgggacaagcctagggaattccagataacatgtggcccggattcatttgctacagatccctctaaacaaacaaccatcagcgttagcttcctcttaccggacatcaccgacacatttgaagccttcacattaagtcttctgtcttcactcttgacttctgggcccaattctcccttttacaaagccttgattgaatctggccttggcacagacttttctcctgatgttggatataatggctacacgagggaggcctactttagtgtcggcctccaagggattgcggagaaagacattgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaagctgggctgcggccttcttgactaccgggagcaggctcagcagatagaattgaagaccggagggatgagtgcttctccccacgtgctccccgacgactcacacatggacacctacgagcaggtaggtgtgcttttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccgcgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggaatggaccacttcttgtacggcctctcggatgagatgaagcaggcccacagagagcagctctttgctgtcagccacgacaagctcctggccgtgagcgatagatacctcggcactgggaagagcacacacggcctggccatcctcggacccgagaacccgaaaattgccaaggacccatcctggatcatccaatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctgactt

SEQ ID NO: 5665 - DNA, 2579 bp, Homo sapiens
tgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcagtaagtgatctctcaacaattttgtttttgttttataatagacattttgtcttgttactagcttaactggctttttgatatttttatgtgaaatagattactttaaatgggtaagggtttataactagtaatctgttggttatttcctaaacattatttcagcctgtgctttttattttattggaacaaaacagggctaaagtaagtttttttgtttctccatccaaagaattacatgacttttgttataaacaatcatctgtggtatatttaaatacagaaactaggattttagtatcaagtctgggctgttggtggaggttgtactgtggtaccagctgcattgtggatgtggaaatcttccttccagtacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaagctgggctgcggccttcttgactaccgggagcaggctcagcagatagaattgaagaccggagggatgagtgcttctccccacgtgctccccgacgactcacacatggacacctacgagcagggtgtgcttttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccgcgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggaatggaccacttcttgtacggcctctcggatgagatgaagcaggcccacagagagcagctctttgctgtcagccacgacaagctcctggccgtgagcgatagatacctcggcactgggaagagcacacacggcctggccatcctcggacccgagaacccgaaaattgccaaggacccatcctggatcatccaatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctg

SEQ ID NO: 5666 - DNA, 482 bp, Homo sapiens
gtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatgtatacgttaaggcatcacgtcaagattggaggacttcatgtcagttttacagtgagaaattgtgtggagtgacggaactgcagtgccttgctctcgcgccccagcacctggctgcagagtgtcacggagatgggacccctgagatggctccagtcccagtgccgtgggcagtgcgtgggagcacagccgcctctgacccctgagtgggtccagtcccagtgccgtgggcggtgcatggcagcacagccgcctctgaccataccgtgtccctcaggaacccaccttcaagccct

SEQ ID NO: 5667 - DNA, 718 bp, Homo sapiens
cttgattgaatctggccttggcacagacttttctcctgatgttggatataatggctacacgagggaggcctactttagtgtcggcctccaagggattgcggagaaagacattgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacaggtcactgtgaacgctacgcttttcccgggtctcgggttccttgggggaattaaatgtcactcctcacagaa

SEQ ID NO: 5668 - DNA, 3030 bp, Homo sapiens
gtcatgcgcaatgtggcgctgcggcgggcggcagggcctgtgtgtgctgaggcggctgagcggcgggtgacatctgttcccgagctgttcctgactgcagtgaagctcacccatgatgacacaggagccaggtatttacacctggccagagaagacacgaataatctgttcagcgtgcagttccgtactactcccatggacagtactggtgttcctcacattcttgagcataccgtcctttgtgggtctcagaaatatccgtgcagagaccctttcttcaaaatgttgaaccggtccctctccacgttcatgaacgccttcacagctagtgattatactctgtatccattttccacacaaaatcccaaggactttcagaatctcctctcggtgtatttggatgccacctttttcccatgtttacgcgagctggatttctggcaggaaggatggcggctggaacatgagaatccgagcgacccccagacgcccttggtctttaaaggagtcgtctttaatgagatgaagggagcgtttacagacaatgagaggatattctcccagcaccttcagaacagacttcttcctgaccacacgtactcagtggtctccgggggtgacccactgtgcatcccggagcttacatgggagcagcttaagcagtttcatgccactcactatcacccaagcaatgctaggttcttcacgtacggtaattttccattagaacagcatctgaaacaaattcacgaggaagcactgagcaaattccagaaaattgaaccaagcaccgtggtgccagctcagacaccctgggacaagcctagggaattccagataacatgtggcccggattcatttgctacagatccctctaaacaaacaaccatcagcgttagcttcctcttaccggacatcaccgacacatttgaagccttcacattaagtcttctgtcttcactcttgacttctgggcccaattctcccttttacaaagccttgattgaatctggccttggcacagacttttctcctgatgttggatataatggctacacgagggaggcctactttagtgtcggcctccaagggattgcggagaaagacattgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccgcgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggaatggaccacttcttgtacggcctctcggatgagatgaagcaggcccacagagagcagctctttgctgtcagccacgacaagctcctggccgtgagcgatagatacctcggcactgggaagagcacacacggcctggccatcctcggacccgagaacccgaaaattgccaaggacccatcctggatcatccaatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaaga

SEQ ID NO: 5669 - DNA, 875 bp, Homo sapiens
tttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccgcgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccaggaaaaggcctgtctgtggaagcggcgacctggggctgatctcaccacgggcgtcttcaaggagcctgtgtctgtgctgcagaccctcccatcattgtctgccccgccttctgtcggaggtggatgtgttctagaatcagcttgaatgtgatgttaccgttcacagtggaaggcagaggaaattggccctgttcctagaaatgtgctttatcagagagtgtgtgttttctt

SEQ ID NO: 5670 - DNA, 673 bp, Homo sapiens
aaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggtattttgagtataacagtgagaatctcaacccacagcctcacagatgacgttgctgttttccaagttcccggcatgcatgggcaggagcactagcttctggtgcctccatccttgcttgtgatacgatttccacgtctgacaccctaaacacgcttcctgacatccgggcgagaagagtgcatcctgtcatttgttttactgacctgagacc

SEQ ID NO: 5671 - DNA, 638 bp, Homo sapiens
ccagcttattgccaaagggaaaaaggatagcccaaaggacaagaaaacacttctcactatgaattggtttggaagtaacttcttcaggtgtcctgaggatctttccttactcaacatatactcacctctgttgtcacacatgtcatctgaagatgaacattttatttccaacttgagaggccatgtaccagccagcgctgtggtgaagcagcctgttcggggagccagtggcaggacgacaatcacagcaattgtccagactggcgggggctggagcaccggtctcttcagtgtctgcagagataggagaatttgtttctgtggtctattctgtcctatgtgtcttgagtgtgacatcgccaggcattatggagagtgtctttgttggccgttgttacctgggtccacctttgcactgagaattggcaccagggagagacataaaatacagggcacactgtgtgaagactggctggcggtgcactgctgttgggctttttccatctgccaggtggcccgggaactcaagatgaggacctcccaagtctatgaaatctgtgcagtcccaatgactaaggacaccctggtttgacagcaagataactcctcctccttactccccaacaccctcctctcaa

SEQ ID NO: 5672 - DNA, 1447 bp, Homo sapiens
gcgtctgaaactgttctatgtactatgccctgcgatagaaacacagttacctctcccctttcacgtagttttcatttgtggtgagattctctcccaggccacaagacatttcctgctcggaaccttgtttactaatttccactgcttttaaggccctgcactgaaaatgcaagctcaggcgccggtggtcgttgtgacccaacctggagtcggtcccggtccggccccccagaactccaactggcagacaggcatgtgtgactgtttcagcgactgcggagtctgtctctgtggcacattttgtttcccgtgccttgggtgtcaagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacagaaggagagccatgcgtactttctaaaaactgatggtgaaaagctcttaccgaagcaacaaaattcagcagacacctcttcagcttgagttcttcaccatcttttgcaactgaaatatgatggatatgcttaagtacaactgatggcatgaaaaaaatcaaatttttgatttattataaatgaatgttgtccctgaacttagctaaatggtgcaacttagtttctccttgctttcatattatcgaattcgaatttcctggcttataaactttttaaattacatttgaaatataaaccaaatgaaatattttactgataagattcttcatgcttctttgctctccttaaaatgtctttttcactagttagttccaagggtcagtctcataattttgttcttatactttgatttcctttttctttttttttttttttaatagagttgggggatctttctttctttttttttttttttttttgagatagagtctcgctctgttgcccaggctggagtgcagtggcgtgatctcagctcactgcaacctccacctcctggatacaagcgattctgctgcctcagtctcccgagtagctgggattacaggttcccgccaccatgcccagctaatttttgtatttttagtagagacggggtttcaccatcttggtcaggctggtctcgaactcctgacctcgtgatccacctgcctcggcatcacaaaatgctgggattacaggcatgagccaccgcgtccagcctagagttgggggtctttctatgttgcccaggctggtcttgaactccgggcctctagcaagcctctcatctcagcctcccaaggtgctggaattacaggtgtgagccactgcaccatactttggtttcttagcaggagattttggttcacagtaacccagctctctttcatctaagaactttagatgagaaaaaaaaaaaa

SEQ ID NO: 5673 - DNA, 786 bp, Homo sapiens
gggtcccagagctgggctggcgggaggcgtaatccggcggggtgagggttgatcgaagagccccgcgcgcagctgccgctcacagccccttcccgagtgcagagcgggcagagaagtccactgcttttaaggccctgcactgaaaatgcaagctcaggcgccggtggtcgttgtgacccaacctggagtcggtcccggtccggccccccagaactccaactggcagacaggcatgtgtgactgtttcagcgactgcggagtctgtctctgtggcacattttgtttcccgtgccttgggtgtcaagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacagaaggagagccatgcgtactttctaaaaactgatggtgaaaagctcttaccgaagcaacaaaattcagcagacacctcttcagcttgagttcttcaccatcttttgcaactgaaatatgatggatatgcttaagtacaactgatggcatgaaaaaaatcaaatttttgatttattataaatgaatgttgtccctgaacttagctaaatggtgcaacttagtttctccttgctttcatattatcgaattcgaatttcctggcttataaactttttaaattacatttgaaatataaaccaaatgaaatattttactgataa

SEQ ID NO: 5674 - DNA, 2253 bp, Homo sapiens
tctctcccaggccacaagacatttcctgctcggaaccttgtttactaatttccactgcttttaaggccctgcactgaaaatgcaagctcaggcgccggtggtcgttgtgacccaacctggagtcggtcccggtccggccccccagaactccaactggcagacaggcatgtgtgactgtttcagcgactgcggagtctgtctctgtggcacattttgtttcccgtgccttgggtgtcaagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacagaaggagagccatgcgtactttctaaaaactgatggtgagtcaatgcaaacatgcctctcagaacatgtgggtttttagaaatatcactaaagactttgtcaattatttgttgttttgaataattcagcaataactatttcttaagtctcctgaagtgctatcataatatcaagattggctttaattttcttcttatgaagaagatagctctatactttgaaaccatattttagtaaataaaggaatggtgaattttctaaacttctcagaattctggtgatctattaaggaagcacttaccacttgtaaaataccagagtatggtgagatacaaaagaattagaaaacatgttccctgctaagacaaacaagttgacaaaaggaattcgtaaataattataaaatagaagagtaaagaaaataacattctgtatgatatttggattgattgtggcataaagcatctatcatagcaaggtgaggttaaatagaaaactcctgttggagaagctgaactttgaaagaggtgaacatagaatttagaatgtttggaaatgttatatagaattaaccatctgaaattcaatcaagtcattttcaactaatttttctcaggactatctattgaggatgtagttaagtagaaatcaacatgacttactccatcccctgtagaatatatattaagtatgggaagaacacaatttttctactctttgtaatatccagtttccttcctgaagtgataaggactctgtatgggttaataaaaataactcttgggagatacgtaaaaaaatgttcatttacttagcaagtaatgtattaaggatctaggatcaagtatatattatcttagcaactaatgtatcaatgtatcaatatctaagactaggtaagatactgttaggtattgtagtagggttggggagcaagataaataagctagtccctctgtcattatagaatttatacgaaaaagggggattagacaaacccctaactaaaatgcagaattcaattaatgcctatagacaaagcggtattttatgttcagaggaggaaaagatcacatcttgtaagatgtataggtgaaagtttcttgaaagcagtgatttttaattctaaaggggaagtgcgtattagttctcaacaagaaacagatggcactcaaactgtgatagttcaaagatttaatgaagactaattataaaggtgtgggtggggcattgtagggagatgacaagggatggcataataacctgcctggcaacagccccagggaggagaagagggagcagtgacctgaatccttaaggagagagctgtgtgaagaggcctgccctgaaagaaacagtatcctctcaagagagggttgtgagcagcccgaggcaacccatagaactgaaaaagtaccctgacctcactttcggatgtccttctggttttcccattggctgaacccaccagaaaggcagagggcagcaaagtgtcacggtagtccgcaggtcgcttcccagggcacacagcaggatggtcaagggagtaagtaaatcagataggggcaaacagaggatcactgactcaagatgtggttttaattaatagaaatggaggctgagtgcagtggctcacacctgtgatcccagcactttgggaggccaaggcaagaggactgcttgaacccaggagttcaagaccagcctggggaacatgttgaaaccctgtctcttgaaaaaatacaaaaattagctaggtgtggtggtgcacgcctgtagtcccagatacttgggaggctgaggtgggaggatcacttgagcctgggaggtagaagctgcagtgagctatgat

SEQ ID NO: 5675 - DNA, 1025 bp, Homo sapiens
atttacttctgtctgtatcaggaaacagaggcctgggtctagagacagggtcttggtgagggaaggactcaaaaccatgggatacagcatgaccgggcagcaccacagctgtggaaggagtttccctgcacaagttctcttctgttgtctgcctccatgtgagacatgcctttcaccttctgccatgattgtgaggcttccccagccacatggaactgaccaggaccagggtgaggcaaacaaggtccctacgggcacagaatttaagaaggcactcactcttgatgaaactggaggaccaaaattttaaactatgggatcagaaattcaaagactatgaataaaaatttcaaaagaaagaaatagtaataccaccaataagaagaataattaaaaaggtacaaagaaattggatgcaacattgtaaaaagagccatagtttggagctgagctgacatgagctaaaatcctagtccactgcttttaaggccctgcactgaaaatgcaagctcaggcgccggtggtcgttgtgacccaacctggagtcggtcccggtccggccccccagaactccaactggcagacaggcatgtgtgactgtttcagcgactgcggagtctgtctctgtggcacattttgtttcccgtgccttgggtgtcaagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacagaaggagagccatgcgtactttctaaaaactgatggtgaaaagctcttaccgaagcaacaaaattcagcagacacctcttcagcttgagttcttcaccatcttttgcaactgaaatatgatggatatgcttaagtacaactgatggcatgaaaaaaatcaaatttttgatttattataaatgaatgttgtccctgaactta

SEQ ID NO: 5676 - DNA, 3327 bp, Homo sapiens
gacttgctctctaaagttgcaattgtaagaagaatgttgggtttccagattgctcttctgggcgtgggagaaggttctgtctatcagtgctgcgagaaaggaaagaaacaagtttgctctcagcggatctttaaatggatgagatggctaccactcagatttccaaagatgagcttgatgaactcaaagaggcctttgcaaaagttgatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataattagtctgttcttcatgcttttgtctcttaggaagtatgccaatgtttgtcaggatttttttctttttgtttttctgatgtattctgtaaaatggtgtttgttaaatttgagttttgggagctgaattagaggtactgaattaaggacagtacaaatgaagtaaaaaggttttctccaatttaccaaaa

SEQ ID NO: 5677 - DNA, 4762 bp, Homo sapiens
gagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagaattacctttaatttccgagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgccagaggagcttacgctgctgctaataaagctgagacggcagcaagccgaactgagtagtatccgggagcatacgttagcacagctcatgcagctaaagcttgaggcccacagcccaaagaatgaaattctttcacatcatctccaaaggaacaccatatatttggatcatcagatgaaagaaaatgaacctattatcaccatggttcacacaatgattgagaactcggcgctaagaccccaactgtaccagcaattcttaagacagaagagcaagataagtctatattgtctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgaggaagaggaagtagtcccacctcgtcctccacttcctcggtcctatgactttacagagcagcctcccataatcccccctctgcccagtgatagcagctccttgctctgttatagcaggggcccagttcatctgcctgaagaaaagaagatgtatcaagttcaaggatatccaagaaatggatctcactgtggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttcttttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttcttaaa

SEQ ID NO: 5678 - DNA, 1954 bp, Homo sapiens
gccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaactgaatagatttccttttcattcttcctgggaatagaagatgtaatggaagttccagtatctgtatgcaggcctatgactagcttcacttcttggtgactaatactagttgacaaaacagcatattctaaactgattgtcttcgttatccagtagctttcctattctccataacaaatgttccaaatctttgattactcacctcagaatgcttgtctcactcctcttttcctcattcctagtagatcataccttggagaagaaagtagaaactatcaggcctgaacttcattagctttttcttcctcttcaatccaaatctgtctgtatcttcattcatttttcttaaccctttccttgcttgctatttctgctttccaaaaccaaggaaggaattttgacagaggtacccaaggaattcactgggggaaaatgaatgattcaataaatgatgttatgataattagatagatagctatatgtaagcataaaaaatttttaaaaccttaggcccttattatcatatcatgcacaaaaattaagtggattattgatttaaatgtaaaaacaaaaagtataaaacttttagaaaaaagagattatttgtgacattgggtctggcaaagatttcttagatgcgattaaagatttacaaaagaaaaaattgataaattagacttcatcaaaatttagaaattttgctttatctgtgtaggatactgaagagaatgaaaagacaagtcacagactgggagaaagtacaggcaaatcacatatttgtcaaataactcatatccagaatttttaaagaacttttacaactcaataataacaagacaaacagctcaattttttaaatgagggaaaaatttaaatatatttcacatgagaatatactcaaatagccagtgagcacatgaaaagatgttcagcatcattagacattagcaaattgcaaattaaaaccacactgaggaacccactaggaatggctataatcaaagacgatcagtatcaagtattgcggagaatgtggagaaactcaaactctgttacactagtaatagaaatataaaatgttagaaccactttggaaagagattggcagtttctggaaaaaattaattgtaaatttgaccaagcaattttactacgtaagtatgttaagaatgaaaacgtgtgcacacaaagatctgtactaaaatgttgatagcattattcataacagcctaacagtgcaaatgtctgtcaactactgtgaatggagagacaaaatgtgtttattaatacaataaaactacccagcaataaaaagaaataattgactgataaatggtatacgatgactgaactttaaaaccttgatgctgcctaaaagagccagacacagactacacattgtataattccatttttatgaatttcccagaaaggcaaattatagagacaaaacaaatcagtggttgcctagggctggtggtggacgtggagattgactgtaaatgggacatgagggaatttttttgtggtgatagaaatgttataaaactagatgtggtaatagttgcacaactctgtaaattcactaaaagtcactgaactgtacacttaaccataggtgggtttaatgaaatgtgaattacactgcaataaaactaaataaaagctgagttagtacca

SEQ ID NO: 5679 - DNA, 2983 bp, Homo sapiens
cggccaccggacgccctaccggacacgaccctccctggagcttggacaactgcccacctcggacgctgcaccggacactgccccccacagggctggacactccaacggacactacttcccagctccggacattgctccctcctctcccggggccctggacgcttttccccctcccccctccgggggcccagacactgagcccccctcagcgtctggctagcgtccccttgcaccccagcccaggacactgcctcctccctgtcctcttctcccttctgctcctcccacctcatctttcccctgctcgggtcggagccccgccagttcctccgaccccctactgctcggccgcggctgcccgcgcccccatccgcagctcctcgcccggatgcctctccccgggggactatggtggcttctctgctgccgtcgaggcttcactcttctgcaccgggactacggggacggcgagcttagcggggacggggacgaggacgaggacgaggaaacctttgagctgcggaccccgagtccagcgggcggcgggaggggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcgggaaaggggcgcggcgtctcgggagcctcgtgctcaccagcctgtgctcggtgaccggcccagagcgcaggcgtaaggagacaggtctgtggtcagtgactgtgtctggtcggaaacacagtgtccgcctctgctccccacgccaggcagaggctgagcgctggggggtggcattgcgggaagtgatcgcctccaaggcacccctggagacccccacccagctactgctcagggacatacaggaaagttgcggggacccagaggccgttgccctcatttacctgaggaacccgattctgagacacactagtggagccttgtatgccccactcctgcccctgccctatggagtcagcgccccaggtccgggctatgcacccctgcgcgaggaggcggtgcggctgttcttggcgctgcaggcgctggagggggcgcggcgccccgggcccttgatgcagggtgtgctccaaacctgccgggacttgcccgcgctccgggatgaactcttcctgcagctggctaagcagacctcgggccctgcaggtccccccgggctcccggctacccaagaccctgcggccctgcggtactggcaactcctcacctgcatgagctgcaccttccgacctgggggagctgtgcgggggcacctcctggggcacttggagaggaccgagcaggcactcccggactcggaactggcggaatatgcgcgcttcatccggaaagcgctgggccggacgcgcggcagagagctggtgccctcgctggcggagatttccgcgttgagccaacggcaggagctgctgtgtaccgtgcactgtccgggggctggtgcctgtgctgtggccatcgactcccacaccacggcgggggaggtggctcgagagctggtggggcggctgggcttggcccggagccgcaacgcattcgcgctgtacgagcagcgaggggcccaggagcgagccctggctggggggaccctcgtggccgacgtgctcaccaggtttgagaacttggccgcggaggaagctgggttggaggactcgcccgactccgggtggagactatgtctgcgtcttcacggacctctgcaccctgaggggctgtccccagacggtcacgaactgcctttcctctttgagcaggctcacgctctgctgctgcggggccggccgcccccacccgacgacacgctgcgcgccctggcggcgctgcgcctgcagagcctgcagcgggacttctctccgcgggtgcccctgccccgcctggaccgcctgctcccgcccccggccccgccgcgcgaagacccgccccgcccgacccccaggccgcccccttccgctgccctgctggccggggcgctctggagcccgggcctggccaagaggcgggcggagcgggcccggcgcggcggggccggccgcactgcgggaagcattgcccgcgagggaggaggcggcgccggcacggcagctgccgtgctgggcggctggaagcggctacggggcatgggccgagctgaggccatggccgcctacctggccctggcggcgcagtgtccggggttcggcgctgctcggtatgacgttctggagctgagcacggagcctggtcggggtgctccacagaagctgtgcctgggcttgggagccaaggccatgtccctctcccggccaggggagacggagcccatccacagtgtcagctatggccatgtggccgcctgccagctaatgggcccccacaccctggccttgagggtgggagagagccagctcctcctgcagagcccccaggtggaagagatcatgcagctggtgaatgcctacttggccaacccctcccccgagaggccctgcagcagctcttctcctccatgccaagacctgccagacacctcccctcccagccagcgcccgggcctggacgagccccagggacagtctggctgcttggggcagctgcaggactgagcctgccaagaggtcacgacttccctcctgcctgcagcctgggccaggactgctctgagatttgagggaaacatggacccttttggccctgcagggacagggcacatcccacacccaagggctacaatgggtgtgggtaattttctagtttgtttcttaatttatttgtagaagagaagcaaaaaaaaaaaaaaagtttcttatttacacaaa

SEQ ID NO: 5680 - DNA, 2250 bp, Homo sapiens
aactaacaggtatagatgagcatacagaagcgttctcggctacaaggaaggcggccgaaaccatttcagccgcgatcccgattcgaccccaacgaatcttggttgtttcttttttattttgtcaaacagggtcttgctctgttgtccaggctggagtgcaacggcacaatcacaactcactgcagcctcgacctcctggactcaagcgatcttcccgcttcagcctccagagtagctgggactacaggcgcgcgtcaccaaccacgcccggctaattttttttttttttttttttgcagtgatggggtctcgctatgttgcccaggctggagtgcagtggtgggatcatggctcactgcagcctcgacattccgagctcaagcgatcctctcgagtagctgggcctacagggaacccccggtccgcgtcggccgccgccctcaaccgcctctactcctcaccagagcccaaggccgcgttatctcctcctcgtttcgccacctccacgacttcgtttggcgaacggcgggcaaagaaagcacttccggggcaaatgagacgggccctctggtgtgcgcatgcctggcccgcccagcggcgtgagtcagagggtcccgaggcgcgaaggaaaaggctggagggggagaggctgaaagcgcggcctggaaggcaaactgcgcgtgcgcacaacgctctcaacgaaccctcggtccgctgcggccgcacggggccaactttcgcgagggagcggctgacactctccgggcgacgttatcgctccctccgcctgcgcctggccgctctagaaaggggtgccagccatcgctggggtgccttgattctgttccaccttggtccggtttatttcagtttaatggttatgtaacaacggtccgtctctcctaccaaccggtaccccgcccacgccagcagccacgggtcgccagcgccacgcagcggaggcgggcggcatggctggcccaaggtgcgcaggcgcactagccctgggggtgcttccgtgtctgcgccctgagacatttttggcgccggccccagcctgagcggggacggcggccgggagggcgcggcccgggttcccgttccccgcggagccatgcggtacaacgagaaggagctgcaggctctgtcccggcagccggccgagatggcggccgagctgggcatgaggggccccaagaagggcagcgtgctgaagcggcggctggtgaagctggtggtgaatttcctcttctactttcggacagacgaggccgagcccgtcggagccctgctgctggagcgctgcagagtcgtccgggaagagcccggcaccttctccatcagcttcattgaggaccctgagaggaagtatcactttgagtgcagcagcgaggagcagtgtcaggagtggatggaggctctgcgtcgggccagctacgagttcatgcggagaagcctcatcttctacaggaacgaaatccggaaggtgacgggcaaggaccccctggaacagttcggcatatccgaggaggccaggttccagctgagtggcttgcaggcgtgagcgcagggcacggtggtcagcgtgcagcgggacgggactggccctgcccagccatgaatcgcttggccatgcctggatctgttttgttttggtttttggtttttgggtcagggtttcactgtgttgcccaggctagagtgcagtggtgccacagctcactgtgaccttgaccttctggactcaagtgatcctcctgcctcagcttcccaagtagcggggatcacaggcatgagccgccacacccggccatcacacctggattttcagtgggaggtttttggtttggagacatccaaagcctgaagccaggtgggtgtgggcaggggctgcattttatgaaactgcccagcaagctgcgctccctggggccccaggatccacctaactggcctggcacctggtgccacgtgctgctgccgccaggatatgcgccttcccacaggtgccctgcctgagttgtgtgcatccaggggcctggtgagcccccaggctggtggcatggcccccctgccccgtgctgaatgaatgtacagagccagacaaagctgtgaatggcctaggggctgagtcccacaccagctgtgaattctcctgcagacaggagggccctggctgtgcacctggggaagtggttgccctggggccagggtgcttgttctgttcaaataaaggtacctcttttccac

SEQ ID NO: 5681 - DNA, 4238 bp, Homo sapiens
tcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgagggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttcttttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttcttaaa

SEQ ID NO: 5682 - DNA, 2039 bp, Homo sapiens
gcgctcccttcgctcgctcgttccctcctccctcggcagccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgtggggtagagaaaaggtggcgacggcgactggagcagcagaggctgtagcatcggatacccacctcccacgaaccggttcctcttccccctccttgctgtgtgtttga

SEQ ID NO: 5683 - DNA, 4504 bp, Homo sapiens
gcgctcccttcgctcgctcgttccctcctccctcggcagccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgaggaagaggaagtagtcccacctcgtcctccacttcctcggtcctatgactttacagagcagcctcccataatcccccctctgcccagtgatagcagctccttgctctgttatagcaggggcccagttcatctgcctgaagaaaagaagatgtatcaagttcaaggatatccaagaaatggatctcactgtggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttcttttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttctt

SEQ ID NO: 5684 - DNA, 4489 bp, Homo sapiens
gcgctcccttcgctcgctcgttccctcctccctcggcagccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgccagaggagcttacgctgctgctaataaagctgagacggcagcaagccgaactgagtagtatccgggagcatacgttagcacagctcatgcagctaaagcttgaggcccacagcccaaagaatgaaattctttcacatcatctccaaaggaacaccatatatttggatcatcagctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgagggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttcttttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttctt

SEQ ID NO: 5685 - DNA, 4147 bp, Homo sapiens
gcgctcccttcgctcgctcgttccctcctccctcggcagccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttcttttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttctt

SEQ ID NO: 5686 - DNA, 1046 bp, Homo sapiens
gcgctcccttcgctcgctcgttccctcctccctcggcagccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaaaaaaaaaaaaaaaaaaaaagaaa

SEQ ID NO: 5687 - DNA, 4412 bp, Homo sapiens
aaaagagatcacggtgtgcccctttgtcatcgttctgtcaggaagcatgtaatttgtctttagaaaccagaagcctgagacaaagaaaagaacacagatttttagcaaaaggctatttgccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgatgaaagaaaatgaacctattatcaccatggttcacacaatgattgagaactcggcgctaagaccccaactgtaccagcaattcttaagacagaagagcaagataagtctatattgtctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtatgataggatcaaagcctttctcaacagttaagtacaaaaatgaggaagaggaagtagtcccacctcgtcctccacttcctcggtcctatgactttacagagcagcctcccataatcccccctctgcccagtgatagcagctccttgctctgttatagcaggggcccagttcatctgcctgaagaaaagaagatgtatcaagttcaaggatatccaagaaatggatctcactgtggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttcttttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttctt

SEQ ID NO: 5688 - DNA, 6487 bp, Homo sapiens
agacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgccagaggagcttacgctgctgctaataaagctgagacggcagcaagccgaactgagtagtatccgggagcatacgttagcacagctcatgcagctaaagcttgaggcccacagcccaaagaatgaaattctttcacatcatctccaaaggaacaccatatatttggatcatcagctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgagggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaaagatgtcccccatgctggagtgtagtggcataatcacagctcactgcagccttgacctcctgggctcaagcagtcgtcctgcctcagcctcacaagtagctgggatcacaagtgcacgccaccacactcggctgatatttcgattttcttatagagacagtcttactaagttgtccacgctggtctcaaactcctgaattcaagctaccctcccactgcatgagccactgtgcctagcctctttgattttcacattctcaaaatatttcttttattttctctcctttttttttttttttcgaggcaaggtcttactctgtcacccaggctggagtgcagtggtgcaagatcatggctcaatggctcactgaaggctgacctcccaggctcaagcaatcctcccacctcagccccctgagtagctgggactacaggtgtatgccaccatgccaggctaattgttttgcagagatggagttttcaccatgttgcccaggctgatctcaagctcctgagctcaagtgatctgtccgcctcagcctcccaaagtgctgagattacaggtgtgagccaccacacccagccttttttcttccttttcaagcattttttaaatttcactagctttgggtacaagtggttttgggttacatggaagaattgtatagtggtgaagtctgagattttagtgcacccattacccgagtagtgtatgttgtacccaatccttcaccgaccttccaccctctcccttctgagtctccaaagtccattataccacactgtatgcctttgcatacccatagtgtagctccaacttataagtgagaacatatgatatttggttttcctttcctgagttactttacttagaataatggcctccagctccatccaagttgctgcaaaatacattattttgttcctttttattgctgagtagtattccatggtgtatataaaccacattttctttatccactccttggttggtggactcttaggttggttccatacccttggagttgcaaattgtgctgctataaacatgcatgtgcatgtatcttttttatgtaatgacttgttttcttttgggtcgatactcagtagtgggattgctggatcaaatgctggatctacttttagttctttaaggaatctccacactgttttccgtagtggttgtactagtttacattcccaccagcagtgtaaaagtgttttcttctcaccacatccataccaacatctgttgttttttgacttttaaattatggccattctttttttttgtttttgagatggagtctcgctctgtcagcaggctggagtgcagtggcgtgatcttggctcactgcaacctcctcctccagggttcaagtgattctcctgcctcagcctcccccgtagctgggactacaggcgtgtgccaccacacccagctaatttttgaatttttagtagagatggggtttcaccatgttggccagtatggtctcgatctcttgacctcatgatccgcccacctcggcctcccaaagtgctggcgtgacccactgcacccggccaattatggccattcttgcaggaataaggaggcatctcattgttgtgtaccttcttttgagaaatgcctattcgcgtcatttgcccactttttgatgggattatttgtttttgttttttttttcttgctgatttgttttgagttccttccagattctggatattagtcctttgttggatgcatagtttgcaaatatttcctcccatcctgttttctggaatctacttcctttcacaccttattgtaggaactataatctgtgccctttttttcagcccaaagtattttgttgtcttttcatatttgtaacttttatttgagattatgtctacctggaacctcaaagaggcttctgtttttgtcagttggtatctgtgcaggactgaagtgcttgctggagagttacaaataacctaactgtgatagtcttacctgtgttctgcctttgtcacttgtgtttaagccttttttcttttttcttttttcttttttttttttttgttgagaccaggtctcaccctgtcacccacactggagtgcaatggtgagatcttggagccttgccctcctgggcttaagtgatcctcccacgacagcctcccaagtagctgggaccacacgcctgtgccaccaagcctggctgatttttttgtattttttgtagagtaggggtttcaccgtgttgcccaggctggtctcaaactcctgagctcaagcgctctgcccgcctcaatctcccaaagtgctgagattacaagattgagccatcacgcctggctatgtttaaacttttaatttaatatgtttagaaatgactgttgaggccaggtgcggtaatgccagcactttgggaggccagggctggtggatcacttgaggtcgggagttcaggaccagcctggccaacatggtaaaaccccatctctacttaaaaatacaaaaattagctgggcatggtgtcaggcgcctgtaatcccagctacctgggaggctgagacaggagaatcgcttgaacctgggaggcagaggttgcagtgagccgagatcacaccatcgcactccggcctgggtgacagaacaagactttgtctcaaaaaaaaaaaaaaaaatctgggtgtggtggcccacacctgtaatcccagcactttgggaggccgaggcaggcagatcacctggctcctgaccagcgtgaccaacatggagaaacccagtctctactaaaattacaaaattagctgggcgtggtggcacatgcctgtaatcccagctacttgggaggctgaggcaggagaatcgcttgaacccagaggcagtggttgcagtgagccgaggtcgtgccattgcactccagcctgggcaacaagaacgaaactctgtctc

SEQ ID NO: 5689 - DNA, 2072 bp, Homo sapiens
tacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttcttttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttctt

SEQ ID NO: 5690 - DNA, 3357 bp, Homo sapiens
tcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgagggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaa

SEQ ID NO: 5691 - DNA, 4801 bp, Homo sapiens
gcgctcccttcgctcgctcgttccctcctccctcggcagccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaaggattttcttctctgatttcagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgccagaggagcttacgctgctgctaataaagctgagacggcagcaagccgaactgagtagtatccgggagcatacgttagcacagctcatgcagctaaagcttgaggcccacagcccaaagaatgaaattctttcacatcatctccaaaggaacaccatatatttggatcatcagatgaaagaaaatgaacctattatcaccatggttcacacaatgattgagaactcggcgctaagaccccaactgtaccagcaattcttaagacagaagagcaagataagtctatattgtctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtatgataggatcaaagcctttctcaacagttaagtacaaaaatgaggaagaggaagtagtcccacctcgtcctccacttcctcggtcctatgactttacagagcagcctcccataatcccccctctgcccagtgatagcagctccttgctctgttatagcaggggcccagttcatctgcctgaagaaaagaagatgtatcaagttcaaggatatccaagaaatggatctcactgtggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttcttttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttctt

SEQ ID NO: 5692 - DNA, 3803 bp, Homo sapiens
aaaagagatcacggtgtgcccctttgtcatcgttctgtcaggaagcatgtaatttgtctttagaaaccagaagcctgagacaaagaaaagaacacagatttttagcaaaaggctatttgccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgatgaaagaaaatgaacctattatcaccatggttcacacaatgattgagaactcggcgctaagaccccaactgtaccagcaactgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgaggaagaggaagtagtcccacctcgtcctccacttcctcggtcctatgactttacagagcagcctcccataatcccccctctgcccagtgatagcagctccttgctctgttatagcaggggcccagttcatctgcctgaagaaaagaagatgtatcaagttcaaggatatccaagaaatggatctcactgtggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctattt

SEQ ID NO: 5693 - DNA, 5031 bp, Homo sapiens
gctggatcctgcagtaaccacaacagcatcctctccctgcgccagggacctgccagccggagagatgactgattagatcagattagatccggagccccgctctgcagaagggggccccaggggcgggggaggaggaccccagctggcctgagctggggggaggggtgccttggggctcgcagagttagagctttccagcgcggggatcacacctcagaagccgccacaatgaaagacggaacacatttctacacccagtgactggccaggtcccagaggaaaacaaaaaatttgacttgaaaatatcgaccttggacatgtccaataaaacaggtgggaaacgcccggctaccaccaacagtgacatacccaaccacaacatggtgtccgaggtccctccagagcggcccagcgtccgggcaactcgcacagcccgcaaagccgtcgcctttggcaagcgctcacactccatgaagcggaaccccaatgcacctgtcaccaaggcgggctggctcttcaaacaggccagctccggggttaagcagtggaacaagcgctggttcgtcctggtggatcgctgcctcttctactataaagatgagaaggaagagagtatcctgggcagcatccccctcctgagcttccgggtagccgcagtgcagccctcagacaacatcagccggaaacacacgtttaaggctgagcatgccggggtccgcacctacttcttcagtgccgagagccccgaggagcaagaggcctggatccaggccatgggggaggctgctcgagtacagatccctccagcccagaagtcagtgccccaagctgtgcggcacagccatgagaagccagactcggagaacgtcccacccagcaagcaccaccagcagccaccccacaacagcctccctaagcctgagccagaggccaagactcgaggggagggtgatggccgaggctgtgagaaggcagagagaaggcctgagaggccagaagtcaagaaagagcctccggtgaaagccaatggcctcccagctggaccggagccagcctcagagccgggcagcccttaccccgagggcccaagagtgccagggggtggggaacagcctgcccagcccaatggctggcagtaccactccccaagccggccagggagcacagctttcccgtctcaggatggagagactgggggacaccggcggagtttcccaccacgcaccaaccctgacaaaattgcccagcgcaagagctccatgaaccagcttcagcagtgggtgaatctgcgccggggggtacccccgcctgaagaccttcggagtccctctaggttctatcctgtgtctcgcagggtccctgagtactatggcccctactcctcccagtaccccgatgattatcagtactacccgccaggagtgcggccggagagcatctgttccatgccggcctatgatcggatcagcccgccctgggccctggaggacaagcgccatgccttccgcaatgggggtggccctgcctaccagctgcgagagtggaaggagcccgccagctacgggcggcaggatgccaccgtctggatcccaagcccctcccggcagccagtctattatgatgagctggatgccgcctctagctccctgcgccgcctgtccctgcagccccgctcccactctgtgccccgctcacccagccagggctcctacagccgtgcccgcatttactcccctgtccgctcacccagtgcccgttttgagcggctgccacctcgcagtgaggacatctatgctgaccctgctgcctatgtgatgaggcgatccatcagctcccccaaggtccctccatacccagaagtgttccgggacagcctccacacctacaagttaaacgagcaagacacagataagctgctgggaaaattgtgtgagcagaacaaggtggtgagggagcaggaccggctggtgcagcagctccgagctgagaaggagagcctggaaagtgccttgatggggacccaccaggagctggagatgtttggaagccagcccgcctacccagaaaagctgcgacacaaaaaggattcactgcagaaccagctcatcaacatccgcgtggagctgtctcaggcgaccacggccctgacaaacagcaccatagagtatgagcacctcgagtctgaggtctctgccctgcacgatgacctctgggagcagctcaatttggacacccagaatgaggtgctgaaccggcaaatccaaaaggagatctggaggatccaggacgtgatggaggggctgaggaagaacaacccctcccggggcacggacaccgccaagcacagaggaggacttggcccctcagccacctacagctccaacagcccggccagccccctcagctctgccagcctcaccagccccctgagccccttttcactggtgtcgggctctcaggggtcccccaccaagcctggctccaacgagcccaaggcaaactatgaacaaagcaagaaagacccccaccagacattgcccctggacacccccagagacatcagccttgtgcccaccaggcaagaggtagaggcagagaagcaggcagctctcaacaaagttggcgttgtgccccctcggacaaaatcgcccactgatgatgaggtgaccccatcagcagtggtaagaaggaatgccagtgggctcaccaatggactctcctcccaggaacgccccaagagtgctgtgtttcctggcgaggggaaggtcaagatgagcgtggaggagcagattgaccgaatgcggcggcaccagagtggctccatgagggagaagcggaggagcctgcagctcccggccagcccggcccccgaccccagtccccggccagcctacaaagtggtgcgccgccaccgcagcatccatgaggtagacatctccaacctggaggcagccctgcgggcagaggagcctggcgggcatgcctacgagacaccccgggaggaaattgcccggcttcgcaaaatggagctagagccccagcattatgacgtggacatcaataaggagctctccactccagacaaagtcctcatccctgaacggtacattgacctggagcctgacactcccctgagccctgaggagttgaaggagaagcagaagaaggtggagaggatcaagacactcattgccaaatccagtatgcagaacgtggtgcccatcggcgagggggactctgtggacgtgccccaggactcagagagccagctgcaggagcaggagaagcggattgaaatctcctgcgccctggcgaccgaggcctcccgcaggggccgcatgctgtctgtgcaatgtgccaccccaagccctcccacctcccctgcttccccggctcctccagcaaaccccctgtcgtctgaatccccacggggcgccgacagcagctataccatgcgggtctgagctctgactgcaagccctggctgaggccaatgctgtgaagctccacagagccacattctgaagccgtcctctgcccacctgaggtcctggctccccaccctggccccctgcccctgcactcccatgggaatgccgcagggagccaggctggggccatgggctgctgccagaggaccgtggatacctcagtgtccacacacccaccatgcccagccctggagccatcactactcacaccgtggtcctgggccagggcctgagatgacagtggggagcaccatcctcattaatgtccaagtcacagggagcctcagccttgccctggctggggttgtggtgactccagtggaacattccctgatgggggacatgccgtggtggagaacacacctgtggctatcttatgtgaggactagaggtgaagaggagatggacactgcctctggagccagcctgacaccaaggacagcacttgtcatcatccctatcctcgtcagccccaccctactgcctcagctggacccagggctttgacacaaacccagtgctttgcttatgggtgctcgctggggtccggtggagactgaccaccctgcttgagccaaagacaaggtgatgagagatggggagaggccattggctcccagagggaacagtgctggctgtggctagagaacagcaggtctgtgcagtgtctgagggcaggttgggaagggtagcagagagagagagacagaaagagagagagagagagagagagagagagatcctcagagtggaaggagggggaagcagcaggacacattggcaagtcaagcaggaaggagggagatggaaaggggatatcagattggtttcccccggtggagccttaggttagtgcccagtgcagtgccagactgtctcctctgctcctcccacctcatccctaggaggacccaccagtggagcacatgcagcctcagtggagatgcttggtgtggggatctgggtgaagggggttgagtagcgactgcctgggagatggctgttagtaggtctgtgcctggtgtctgcctcgccatcctggggtaaggggcagagagaaggacttgtcttatgtagggtgtggtcagccttggggccttacctacccagttccatgatatttcttgccctgttccccctggaatgtgcagtgggccagctgagagtacgccttgaggaggggggatgaggccttaatctgggaggcctatccccctatcccaggcatcccagacgaggactggctgaggctaggcgctctcatgatccacctgccccgggagggcagcggggaagacagagaaaagcaaacgcattcctcctcagctccacccacctggagacgaatgtagccagagaggaggaaggagggaaactgaagacaccgtggcccctcggccttctctctgctagagttgccgctcagaggcttcagcctgacttccagcggtcccaagaacacctactaattcctctgcactccttcatggctgggacagttactggttcatatgcaagtaaagatgacaatttactcaac

SEQ ID NO: 5694 - DNA, 319 bp, Homo sapiens
ccgtgcccgcatttactcccctgtccgctcacccagtgcccgttttgagcggctgccacctcgcagtgaggacatctatgctgaccctgctgcctatgtgatgaggcgatccatcagctcccccaagtatgattacctgggagacaggcggccagtccctgcaggactgttcccctacaactacccaccatcccccacggtccacgataagatggtccctccatacccagaagtgttccgggacagcctccacacctacaagttaaacgagcaagacacagataagctgctgggaaaattgtgtgagcagaacaaggtg

SEQ ID NO: 5695 - DNA, 5091 bp, Homo sapiens
gctggatcctgcagtaaccacaacagcatcctctccctgcgccagggacctgccagccggagagatgactgattagatcagattagatccggagccccgctctgcagaagggggccccaggggcgggggaggaggaccccagctggcctgagctggggggaggggtgccttggggctcgcagagttagagctttccagcgcggggatcacacctcagaagccgccacaatgaaagacggaacacatttctacacccagtgactggccaggtcccagaggaaaacaaaaaatttgacttgaaaatatcgaccttggacatgtccaataaaacaggtgggaaacgcccggctaccaccaacagtgacatacccaaccacaacatggtgtccgaggtccctccagagcggcccagcgtccgggcaactcgcacagcccgcaaagccgtcgcctttggcaagcgctcacactccatgaagcggaaccccaatgcacctgtcaccaaggcgggctggctcttcaaacaggccagctccggggttaagcagtggaacaagcgctggttcgtcctggtggatcgctgcctcttctactataaagatgagaaggaagagagtatcctgggcagcatccccctcctgagcttccgggtagccgcagtgcagccctcagacaacatcagccggaaacacacgtttaaggtgactgtgtgctgggtggatgaggccgaggccagctccacacgctgcctctccccacaggctgagcatgccggggtccgcacctacttcttcagtgccgagagccccgaggagcaagaggcctggatccaggccatgggggaggctgctcgagtacagatccctccagcccagaagtcagtgccccaagctgtgcggcacagccatgagaagccagactcggagaacgtcccacccagcaagcaccaccagcagccaccccacaacagcctccctaagcctgagccagaggccaagactcgaggggagggtgatggccgaggctgtgagaaggcagagagaaggcctgagaggccagaagtcaagaaagagcctccggtgaaagccaatggcctcccagctggaccggagccagcctcagagccgggcagcccttaccccgagggcccaagagtgccagggggtggggaacagcctgcccagcccaatggctggcagtaccactccccaagccggccagggagcacagctttcccgtctcaggatggagagactgggggacaccggcggagtttcccaccacgcaccaaccctgacaaaattgcccagcgcaagagctccatgaaccagcttcagcagtgggtgaatctgcgccggggggtacccccgcctgaagaccttcggagtccctctaggttctatcctgtgtctcgcagggtccctgagtactatggcccctactcctcccagtaccccgatgattatcagtactacccgccaggagtgcggccggagagcatctgttccatgccggcctatgatcggatcagcccgccctgggccctggaggacaagcgccatgccttccgcaatgggggtggccctgcctaccagctgcgagagtggaaggagcccgccagctacgggcggcaggatgccaccgtctggatcccaagcccctcccggcagccagtctattatgatgagctggatgccgcctctagctccctgcgccgcctgtccctgcagccccgctcccactctgtgccccgctcacccagccagggctcctacagccgtgcccgcatttactcccctgtccgctcacccagtgcccgttttgagcggctgccacctcgcagtgaggacatctatgctgaccctgctgcctatgtgatgaggcgatccatcagctcccccaaggtccctccatacccagaagtgttccgggacagcctccacacctacaagttaaacgagcaagacacagataagctgctgggaaaattgtgtgagcagaacaaggtggtgagggagcaggaccggctggtgcagcagctccgagctgagaaggagagcctggaaagtgccttgatggggacccaccaggagctggagatgtttggaagccagcccgcctacccagaaaagctgcgacacaaaaaggattcactgcagaaccagctcatcaacatccgcgtggagctgtctcaggcgaccacggccctgacaaacagcaccatagagtatgagcacctcgagtctgaggtctctgccctgcacgatgacctctgggagcagctcaatttggacacccagaatgaggtgctgaaccggcaaatccaaaaggagatctggaggatccaggacgtgatggaggggctgaggaagaacaacccctcccggggcacggacaccgccaagcacagaggaggacttggcccctcagccacctacagctccaacagcccggccagccccctcagctctgccagcctcaccagccccctgagccccttttcactggtgtcgggctctcaggggtcccccaccaagcctggctccaacgagcccaaggcaaactatgaacaaagcaagaaagacccccaccagacattgcccctggacacccccagagacatcagccttgtgcccaccaggcaagaggtagaggcagagaagcaggcagctctcaacaaagttggcgttgtgccccctcggacaaaatcgcccactgatgatgaggtgaccccatcagcagtggtaagaaggaatgccagtgggctcaccaatggactctcctcccaggaacgccccaagagtgctgtgtttcctggcgaggggaaggtcaagatgagcgtggaggagcagattgaccgaatgcggcggcaccagagtggctccatgagggagaagcggaggagcctgcagctcccggccagcccggcccccgaccccagtccccggccagcctacaaagtggtgcgccgccaccgcagcatccatgaggtagacatctccaacctggaggcagccctgcgggcagaggagcctggcgggcatgcctacgagacaccccgggaggaaattgcccggcttcgcaaaatggagctagagccccagcattatgacgtggacatcaataaggagctctccactccagacaaagtcctcatccctgaacggtacattgacctggagcctgacactcccctgagccctgaggagttgaaggagaagcagaagaaggtggagaggatcaagacactcattgccaaatccagtatgcagaacgtggtgcccatcggcgagggggactctgtggacgtgccccaggactcagagagccagctgcaggagcaggagaagcggattgaaatctcctgcgccctggcgaccgaggcctcccgcaggggccgcatgctgtctgtgcaatgtgccaccccaagccctcccacctcccctgcttccccggctcctccagcaaaccccctgtcgtctgaatccccacggggcgccgacagcagctataccatgcgggtctgagctctgactgcaagccctggctgaggccaatgctgtgaagctccacagagccacattctgaagccgtcctctgcccacctgaggtcctggctccccaccctggccccctgcccctgcactcccatgggaatgccgcagggagccaggctggggccatgggctgctgccagaggaccgtggatacctcagtgtccacacacccaccatgcccagccctggagccatcactactcacaccgtggtcctgggccagggcctgagatgacagtggggagcaccatcctcattaatgtccaagtcacagggagcctcagccttgccctggctggggttgtggtgactccagtggaacattccctgatgggggacatgccgtggtggagaacacacctgtggctatcttatgtgaggactagaggtgaagaggagatggacactgcctctggagccagcctgacaccaaggacagcacttgtcatcatccctatcctcgtcagccccaccctactgcctcagctggacccagggctttgacacaaacccagtgctttgcttatgggtgctcgctggggtccggtggagactgaccaccctgcttgagccaaagacaaggtgatgagagatggggagaggccattggctcccagagggaacagtgctggctgtggctagagaacagcaggtctgtgcagtgtctgagggcaggttgggaagggtagcagagagagagagacagaaagagagagagagagagagagagagagagatcctcagagtggaaggagggggaagcagcaggacacattggcaagtcaagcaggaaggagggagatggaaaggggatatcagattggtttcccccggtggagccttaggttagtgcccagtgcagtgccagactgtctcctctgctcctcccacctcatccctaggaggacccaccagtggagcacatgcagcctcagtggagatgcttggtgtggggatctgggtgaagggggttgagtagcgactgcctgggagatggctgttagtaggtctgtgcctggtgtctgcctcgccatcctggggtaaggggcagagagaaggacttgtcttatgtagggtgtggtcagccttggggccttacctacccagttccatgatatttcttgccctgttccccctggaatgtgcagtgggccagctgagagtacgccttgaggaggggggatgaggccttaatctgggaggcctatccccctatcccaggcatcccagacgaggactggctgaggctaggcgctctcatgatccacctgccccgggagggcagcggggaagacagagaaaagcaaacgcattcctcctcagctccacccacctggagacgaatgtagccagagaggaggaaggagggaaactgaagacaccgtggcccctcggccttctctctgctagagttgccgctcagaggcttcagcctgacttccagcggtcccaagaacacctactaattcctctgcactccttcatggctgggacagttactggttcatatgcaagtaaagatgacaatttactcaac

SEQ ID NO: 5696 - DNA, 313 bp, Homo sapiens
ccgtgcccgcatttactcccctgtccgctcacccagtgcccgttttgagcggctgccacctcgcagtgaggacatctatgctgaccctgctgcctatgtgatgaggcgatccatcagctcccccaagatgagtgagagcgagactctcatcagtatggtgaaccgcatggtggaaaactcctcccccaggtcccaactcttcatgcaagtccctccatacccagaagtgttccgggacagcctccacacctacaagttaaacgagcaagacacagataagctgctgggaaaattgtgtgagcagaacaaggtg

SEQ ID NO: 5697 - DNA, 454 bp, Homo sapiens
ccgtgcccgcatttactcccctgtccgctcacccagtgcccgttttgagcggctgccacctcgcagtgaggacatctatgctgaccctgctgcctatgtgatgaggcgatccatcagctcccccaagtatgattacctgggagacaggcggccagtccctgcaggactgttcccctacaactacccaccatcccccacggtccacgataagatggatgaacttttagatcttcagttgcaaagaaacctagagtatttggatcagcagatgagtgagagcgagactctcatcagtatggtgaaccgcatggtggaaaactcctcccccaggtcccaactcttcatgcaagtccctccatacccagaagtgttccgggacagcctccacacctacaagttaaacgagcaagacacagataagctgctgggaaaattgtgtgagcagaacaaggtg

SEQ ID NO: 5698 - DNA, 373 bp, Homo sapiens
ccgtgcccgcatttactcccctgtccgctcacccagtgcccgttttgagcggctgccacctcgcagtgaggacatctatgctgaccctgctgcctatgtgatgaggcgatccatcagctcccccaagtatgattacctgggagacaggcggccagtccctgcaggactgttcccctacaactacccaccatcccccacggtccacgataagatggatgaacttttagatcttcagttgcaaagaaacctagagtatttggatcagcaggtccctccatacccagaagtgttccgggacagcctccacacctacaagttaaacgagcaagacacagataagctgctgggaaaattgtgtgagcagaacaaggtg

SEQ ID NO: 5699 - DNA, 250 bp, Homo sapiens
ccgtgcccgcatttactcccctgtccgctcacccagtgcccgttttgagcggctgccacctcgcagtgaggacatctatgctgaccctgctgcctatgtgatgaggcgatccatcagctcccccaagtatgattacctgggagacaggcggccagtccctgcaggactgttcccctacaactacccaccatcccccacggtccacgataagatgaagctgctgggaaaattgtgtgagcagaacaaggtg

SEQ ID NO: 5700 - DNA, 400 bp, Homo sapiens
ccgtgcccgcatttactcccctgtccgctcacccagtgcccgttttgagcggctgccacctcgcagtgaggacatctatgctgaccctgctgcctatgtgatgaggcgatccatcagctcccccaagtatgattacctgggagacaggcggccagtccctgcaggactgttcccctacaactacccaccatcccccacggtccacgataagatgatgagtgagagcgagactctcatcagtatggtgaaccgcatggtggaaaactcctcccccaggtcccaactcttcatgcaagtccctccatacccagaagtgttccgggacagcctccacacctacaagttaaacgagcaagacacagataagctgctgggaaaattgtgtgagcagaacaaggtg

SEQ ID NO: 5701 - DNA, 4203 bp, Homo sapiens
cttggacgcccggtccttcagttttttgagcacctcaagcttctggcctacaaaacgctcccggctcagctggagctttctgcgcccgggtcctagagtcgcccatttctctaaggcgccttggccctatttttagagagcggtatttagaaaccaagattagggtgctaacaatttttttttaaatttttatatttttaagacaggatctcactttgtaacacttccttttagtggaagcgccgacctcctgggagacccacgccccctgccgccttccgtcccgtttctcagaaaaccacccagacaccccgccccaccggccggggcccgccgcgcatgcgcgccgaggcgtgacgtcagaacggcggccaggacgccggacgtgcggcagttgcaggcgagcaggcgaggaatcgccgtggcgtcttggtgttctccacgctggttcgcaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgaggcttatggctatgggccatacggtggtgcgtacccgccaggaactcaagttgtctacgctgcgaatgggcaggcgtatgccgtgccctaccagtacccatatgcaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgcctgtaatcccagcactttgagagaccgaggcgggcggatcacgaggtcaggagatcgagaccatcctggctaacacggtgaaaccccatctctactaaaaatacaaaaaattagctgggcgtggtggcaggcgcctgtggtcccagctactcgggaggctgaggcaggagaatagtgtgaacccaggaggcggagcttgcagtgagccaagatagtgccactgcacttcagcctgggtgacagagtgagactctgtctcaaaaaaaaaaaaaaaatcctggagaagccagaacaatatacaaacaagtatgtggaggcagatttgctttattccaagaggctgtttgagtgtgtgtctgcctaagcctccttatagcctatttttctacttgctgagagagtaatattaaaggaacagtgagggagtggaaggagagccttagttagagcgttcccatttctggcctttgggggtttgcactgtgcgggagatgctctctcatcactctgaaggcccatcctgtgcagaagtgggactctgtggctgttcactgagcaccagggcagactgtagctgagcagacttgggttatggatgggatatggggcccagggaccctcaggacacagggaccggctcaaggtaccactcagcctggccaggacccccagctttgcttttgttcttgatctctttgtgatagagaagcttagaacattgaatttggaaccccaaaatgtgtgagtctttggaaaacccattccagcctttcttcaaatgctcttattttcagtatatgaagtgtgtatttgaaatattcatatttctgttatttcttgttttcaagctctgaattattgcagttttctgtcctgcatgctttcaacagtgtgcttttacagtggcagtttagcacagcgaatgtccctgccccacactccatatggtcctgttttcctgaaaatacactccaggtagcacagacttgttattttgcctggctggttacacacatgctgtcttgctttgctgctcagccacctccctctgaggccaacttaggccaacctacataggactccatctttagcgagacaccagagacacctagtgatgaccacgggtctgcttttctctctgatcctaggggacttgttgacatgggagtgtctgtttccacatggaaggatgtctgtttatctctcatctctgaatagatgtatgacaactctagtgtccatggtttaaaatgttgctttgaggattttccatcctgtataagaagaatggctttcttcagattataatcgttattaaagctgtatgtacactttacttaaaaactattaacagtttttcatgttgcactggtggtaattttgaacttggaattactgggtgggaattccaggaaccacagagtattgatttttgctgccaaaatgctcttgaagcagatgtccctgtgctcccctggctgcttctggctgaaggggggaggtgtagactgaagcttgggcactcatgtgtgtcccctccccagtccccatcctagtggggccagtctcattaggcagccatagataagcctggaacttggctgtcattagtgacttgatcctggtatgaaatgcatactgggtataaggttgctcaggtattttatttccttggccacaactcccatagatgccaatgttttgatagcctcagtttctcaacgatgtcttttgtttacagtgctacacttagtgtgagtcaagaagtgcttgagttacaagaaacttcttattcaggtttgagtaagcattttacttccatgtgtacttttaaataatccataccttgaagaagttggccaatgatattatatacatgctgatctgattgttcttttcattccttgagtcaacttcagggtcttggatactaaagagaaggagaactgtggttaatgttttggatcatcatttgtgaacaaggccagactttgcccattttaggctatccaggacttaaggtagccatctggatcataagaaggtcctgcagttgagacaaaatgacccaagtgtattttccacaagttttgatcctgtgtaatatttctttttccttccctagtgtatgtagatacaaggcatggaatgcagttccactttctccccagagttgatctttttgtgattgctttcccgtctctagtagtattctgttgtgtctagagaactgattttttcctacatacgcaaattgtacatttgtaagtgaaaatgtcaatacattaaagcattaaccttaaagcatg

SEQ ID NO: 5702 - DNA, 930 bp, Homo sapiens
atggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgaggagctgcacagtaaaggtcccaaaatacacaccaccacgagtgcaaaaacccaggcggttctcccaacgcgatgtttttttcccagcgaatctccgataagaaggtctgtgcagatttctgtgctcctacctgcagtaaatattcgtagacgtataaagctaacttttccccagcctgcccgtccgagggcaccaaggagcctttgcctttggcaaacatggtttgcagggaagagggcgcccagcctccccacagccgccaccgctccggctctcccgagctgcccctcgcccccggccccctcccaggcgctccctccctctctcgctggctggcgctctcctagcagcgctcccctccctcccgagcaggcgctggctccgcgctctttccagctgtcaaagcatcaggcccggccgcggccccatcgccctggaactcctcccgtgccggcttggcctggggtgccgccgccgcctcccgcaaggccgcccgctctccggtag

SEQ ID NO: 5703 - DNA, 4307 bp, Homo sapiens
atactttaggttataacttaatgcaatgtactttatattgctgctcaaattgtcccaggcgcggcccccggaagctctctgggtagatccctgcgcccttggacgcccggtccttcagttttttgagcacctcaagcttctggcctacaaaacgctcccggctcagctggagctttctgcgcccgggtcctagagtcgcccatttctctaaggcgccttggccctatttttagagagcggtatttagaaaccaagattagggtgctaacaatttttttttaaatttttatatttttaagacaggatctcactttgtaacacttccttttagtggaagcgccgacctcctgggagacccacgccccctgccgccttccgtcccgtttctcagaaaaccacccagacaccccgccccaccggccggggcccgccgcgcatgcgcgccgaggcgtgacgtcagaacggcggccaggacgccggacgtgcggcagttgcaggcgagcaggcgaggaatcgccgtggcgtcttggtgttctccacgctggttcgcaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgagcaggcttatggctatgggccatacggtggtgcgtacccgccaggaactcaagttgtctacgctgcgaatgggcaggcgtatgccgtgccctaccagtacccatatgcaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgcctgtaatcccagcactttgagagaccgaggcgggcggatcacgaggtcaggagatcgagaccatcctggctaacacggtgaaaccccatctctactaaaaatacaaaaaattagctgggcgtggtggcaggcgcctgtggtcccagctactcgggaggctgaggcaggagaatagtgtgaacccaggaggcggagcttgcagtgagccaagatagtgccactgcacttcagcctgggtgacagagtgagactctgtctcaaaaaaaaaaaaaaaatcctggagaagccagaacaatatacaaacaagtatgtggaggcagatttgctttattccaagaggctgtttgagtgtgtgtctgcctaagcctccttatagcctatttttctacttgctgagagagtaatattaaaggaacagtgagggagtggaaggagagccttagttagagcgttcccatttctggcctttgggggtttgcactgtgcgggagatgctctctcatcactctgaaggcccatcctgtgcagaagtgggactctgtggctgttcactgagcaccagggcagactgtagctgagcagacttgggttatggatgggatatggggcccagggaccctcaggacacagggaccggctcaaggtaccactcagcctggccaggacccccagctttgcttttgttcttgatctctttgtgatagagaagcttagaacattgaatttggaaccccaaaatgtgtgagtctttggaaaacccattccagcctttcttcaaatgctcttattttcagtatatgaagtgtgtatttgaaatattcatatttctgttatttcttgttttcaagctctgaattattgcagttttctgtcctgcatgctttcaacagtgtgcttttacagtggcagtttagcacagcgaatgtccctgccccacactccatatggtcctgttttcctgaaaatacactccaggtagcacagacttgttattttgcctggctggttacacacatgctgtcttgctttgctgctcagccacctccctctgaggccaacttaggccaacctacataggactccatctttagcgagacaccagagacacctagtgatgaccacgggtctgcttttctctctgatcctaggggacttgttgacatgggagtgtctgtttccacatggaaggatgtctgtttatctctcatctctgaatagatgtatgacaactctagtgtccatggtttaaaatgttgctttgaggattttccatcctgtataagaagaatggctttcttcagattataatcgttattaaagctgtatgtacactttacttaaaaactattaacagtttttcatgttgcactggtggtaattttgaacttggaattactgggtgggaattccaggaaccacagagtattgatttttgctgccaaaatgctcttgaagcagatgtccctgtgctcccctggctgcttctggctgaaggggggaggtgtagactgaagcttgggcactcatgtgtgtcccctccccagtccccatcctagtggggccagtctcattaggcagccatagataagcctggaacttggctgtcattagtgacttgatcctggtatgaaatgcatactgggtataaggttgctcaggtattttatttccttggccacaactcccatagatgccaatgttttgatagcctcagtttctcaacgatgtcttttgtttacagtgctacacttagtgtgagtcaagaagtgcttgagttacaagaaacttcttattcaggtttgagtaagcattttacttccatgtgtacttttaaataatccataccttgaagaagttggccaatgatattatatacatgctgatctgattgttcttttcattccttgagtcaacttcagggtcttggatactaaagagaaggagaactgtggttaatgttttggatcatcatttgtgaacaaggccagactttgcccattttaggctatccaggacttaaggtagccatctggatcataagaaggtcctgcagttgagacaaaatgacccaagtgtattttccacaagttttgatcctgtgtaatatttctttttccttccctagtgtatgtagatacaaggcatggaatgcagttccactttctccccagagttgatctttttgtgattgctttcccgtctctagtagtattctgttgtgtctagagaactgattttttcctacatacgcaaattgtacatttgtaagtgaaaatgtcaatacattaaagcattaaccttaaagcatgtttc

SEQ ID NO: 5704 - DNA, 1167 bp, Homo sapiens
cgaggaatcgccgtggcgtcttggtgttctccacgctggttcgcaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgaggagctgcacagtaaaggtcccaaaatacacaccaccacgagtgcaaaaacccaggcggttctcccaacgcgatgtttttttcccagcgaatctccgataagaaggtctgtgcagatttctgtgctcctacctgcagtaaatattcgtagacgtataaagctaacttttccccagcctgcccgtccgagggcaccaaggagcctttgcctttggcaaacatggtttgcagggaagagggcgcccagcctccccacagccgccaccgctccggctctcccgagctgcccctcgcccccggccccctcccaggcgctccctccctctctcgctggctggcgctctcctagcagcgctcccctccctcccgagcaggcgctggctccgcgctctttccagctgtcaaagcatcaggcccggccgcggccccatcgccctggaactcctcccgtgccggcttggcctggggtgccgccgccgcctcccgcaaggccgcccgctctccggtagctcgcgtgctcgcccggttccgcttgcgcggccctctgcgcccccagcaccgctgccgccgccgccggcgctggcctcatgtgtcacattttcttaatccagtctatggctgatggatatttgggttggttccaactttttgctattgtgaatagtgccgcaataaacatacgtgtgcatgtg

SEQ ID NO: 5705 - DNA, 2488 bp, Homo sapiens
aaaaaaaagctaaagcagaaaacaaaagtggcccatggtctcagcttccagataataactattgatttcaaaaaataaaatggcctgggattacaggcatgagctgctgcgcccggccaatttttgtatttttagtagagatgaggtttcaccatgttggccaggctggtctcgaattcctgacctcaggtgatccaccctcctcggcctgagccaccgtgcccagccgtgactgtttcttctaatttatcacttttaaagtctcatttaactttttttccatacagaagatttaaatttttatggagttgactttatgaacctttttcttgatgacttttgtttttttgccctgacctggccactccacgtcactcactgctgacaccagtgcagcacccctgcctgggccatgtggaccccactgggaacgccaaatgtaggcacctcagggctccagcaagccacgagaatcccccatgtccttgacagagctaaatcctgtgtccctggggctgctttatgtttgttgagtggtgttagactcggtcaggtgggctgggtggtgaggctgaaggcgagtgtgggaggaagggagggggtacagagtgcggggcacatgaaccccaatgaggaggtgtttgttaaatgccaggggggcactgagctaaaatggccttgggcccttcctcagctgatgctgaaggggataaggatagagactcgggccggacaggctattctctttctgggtatgattttgaacctgcctgtttttgttctgtaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgagcaggcttatggctatgggccatacggtggtgcgtacccgccaggaactcaagttgtctacgctgcgaatgggcaggcgtatgccgtgccctaccagtacccatatgcaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgcctgtaatcccagcactttgagagaccgaggcgggcggatcacgaggtcaggagatcgagaccatcctggctaacacggtgaaaccccatctctactaaaaatacaaaaaattagctgggcgtggtggcaggcgcctgtggtcccagctactcgggaggctgaggcaggagaatagtgtgaacccaggaggcggagcttgcagtgagccaagatagtgccactgcacttcagcctgggtgacagagtgagactctgtctc

SEQ ID NO: 5706 - DNA, 2210 bp, Homo sapiens
gaaagagagctggagaactgggatatcatgaggagttgtagacagttaaacctgaattctagcttttggaacaaaatagtaatgtaattgtagcagttctcacttttttattttttatttttttgagacggagtttcactcctgttgcttaggctggagtgcgatggcgcagtctcggctcactgcaacctccgcttcccgggttcaagggagtcccctgcctctgccccccaaatagctgggattacaggcgtgcgccaccatgctcggctaattttttgtatttttaatagagatggggtttcactatgttggtcaggctggtctcgaactcctgacctcaggtgatccgcctgccttggcctcccaaagtgttgggattataggcgtgagccaacgcgcctggccaattctcacttttggaccatctactacagggctgtttggacatacctcctttaattgtcacagtaaccccatgacgtaattggttgtgcctggtcatacaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgagcaggcttatggctatgggccatacggtggtgcgtacccgccaggaactcaagttgtctacgctgcgaatgggcaggcgtatgccgtgccctaccagtacccatatgcaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgcctgtaatcccagcactttgagagaccgaggcgggcggatcacgaggtcaggagatcgagaccatcctggctaacacggtgaaaccccatctctactaaaaatacaaaaaattagctgggcgtggtggcaggcgcctgtggtcccagctactcgggaggctgaggcaggagaatagtgtgaacccaggaggcggagcttgcagtgagccaagatagtgccactgcacttcagcctgggtgacagagtgagactctgtctc

SEQ ID NO: 5707 - DNA, 1460 bp, Homo sapiens
agttgcaggcgagcaggcgaggaatcgccgtggcgtcttggtgttctccacgctggttcgcaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgcctgtaatcccagcactttgagagaccgaggcgggcggatcacgaggtcaggagatcgagaccat

SEQ ID NO: 5708 - DNA, 1297 bp, Homo sapiens
gtcagaacggcggccaggacgccggacgtgcggcagttgcaggcgagcaggcgaggaatcgccgtggcgtcttggtgttctccacgctggttcgcaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttgcttatggctatgggccatacggtggtgcgtacccgccaggaactcaagttgtctacgctgcgaatgggcaggcgtatgccgtgccctaccagtacccatatgcaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggta

SEQ ID NO: 5709 - DNA, 1108 bp, Homo sapiens
ttgcaggcgagcaggcgaggaatcgccgtggcgtcttggtgttctccacgctggttcgcaggtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgagcaggcttatggctatgggccatacggtggtgcgtacccgccaggaactcaagttgtctacgctgcgaatgggcaggcgtatgccgtgccctaccagtacccatatgcaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttc

SEQ ID NO: 5710 - DNA, 1812 bp, Homo sapiens
ccggagcccaagccgccggctacgcgccctgcgcccccttggtgccgcgtccagtgcccagcgcgctttgatgctgcagctccgggccgggccgctctgcttctctgctcgctgggacgctctccgacggctccgccctcgcctctcgccccgagtccctgctgaccccggggaggtggggtccgggccgggcacagccccgctgaggcaggatgttcacgtccaagtccaactcggtgtcgccctcgccgtccctggagcaggctgactcggacgccctggatatcagcaccaaagtgcagctctacggcgtgctgtggaagaggcctttcggcaggccgtcggccaagtggtcccggcggtttttcatcatcaaagagagctttctgctttactactctgagagcgaaaaaaagagctttgaaaccaataaatacttcaatatacatcctaagggcgtcatccctctggggggctgcctggtggagcccaaggaagagcctagcatgccctatgccatgaagatctcccaccaggacttccatgggaacatcttgcttgctgctgagtcggagtttgagcagacccagtggctggagatgctgcaggagtctgggaaggtgacctggaagaatgcccagctgggagaagccatgatcaaaagcctggaggcccaggggctgcagttggctaaggaaaagcaggagtatttagacaaactgatggaagagaccgaagaactctgccttcagagggagcagagagaggagcttgagcgccttaaccaggtgctggaggccgagaagcagcagttcgaggaggtggtgcaggagctgagaatggagcaggagcagatcaagagggagctggaactgactgcaagatgccttaagggtgtagaacaagagaaaaaggaactgaggcacctcacggagtccttgcagcagacactggaggaactctccatagagaagaagaaaaccctggaaatgctggaggagaacgagaaccacctgcagacactggccaatcagagtgagcagccccctcccagtgggggcctccatagcaacctccggcagatcgaggagaagatgcagcagctcttagaggagaagctcctggcagagaagcggatgaaggagaacgaggagcgctcacgggccctggaggaggagcgtgagttctactccagccagtcccaggcactgcagaactcgctgcaggagctgacggcagagaagcagcaggctgagcgggagctcaaggctgaggtgaaggtccgcatggacctggagaggcgtctccgggaggcagaaggggccttgcgaagcctggaacaggggctgaattccaaggtgcggaataaggagaaggaggagaggatgcgggctgatgtgagccatctgaaaaggttctttgaggagtgcatccggaatgccgagctggaggccaagatgcctgtgatcatgaagaactccgtgtacatccataaggcagccactcgccgcatcaagagctgccgcttccaccgacgccggtccagcacctcctggaatgacatgaagccgtcccagtccttcatgacctcccagctggatgccaacaacatggaggagctaaaggaggtggccaagcggctcagcagggaccagcgcttccgggaatccatctaccacatcatggccacccagcctggagccccctcggcactctcccggggtggaaagtgatgggcgctcctcccctgcttcccaagtctcccctggatgggcgggggaggggaaggggtggcagagggaggcctcactc

SEQ ID NO: 5711 - DNA, 7136 bp, Homo sapiens
aatatttctacggaaggcgctgcacagactagcaaaggctgtttcttttacctgactgaggtcactgcatcagctgaaggcagacgatgtgcttaagcctgagtggagcagagatgggcaccagttgcgtcttgaagtgccatcagctgtaaccaaagttccacatcccaagacgacagccaggcgttcctgccctcaagaactgaagacaatggagctctctgatagtgaccgacccgtcagcttcggttccacatcatcctcggcctcttcccgcgacagccatggttccttcggcagcagaatgaccttagtttcaaatagccacatgggcttgtttaaccaggataaggaggtaggggccataaaactggagctgattcctgccaggccgttttccagcagcgagctgcagagggacaaccccgccacggggcaacagaacgcggatgagggcagcgaaaggccacccagagcgcagtggagagtggactcaaacggggcacccaagacgatcgcagactcggccacgagccccaagctcctctatgtggatagagttgttcaggaaattctggaaaccgaaaggacttatgtacaagatttaaaaagcatcgtagaggattaccttgactgcatcagggaccaaacaaaacttcccctggggaccgaagaaagatcagccctttttggaaacatacaggatatctaccacttcaatagtgaacttctgcaagatttggaaaactgtgaaaatgatcctgtggccatagcagagtgttttgtgtccaagagtgaagagttccacatttatacccagtattgcactaactatccaaggtccgtggctgtgctaacagagtgtatgaggaacaagatactggccaaattcttcagggagcgtcaggaaactctgaaacactcgctgcctctggggtcctatctcttgaaaccagttcagcggattctcaagtatcatctccttctgcatgaaatagaaaaccaccttgataaggacacagaaggctatgatgtggtgcttgatgctatagacacaatgcagcgagtcgcctggcatatcaatgacatgaagcggaaacacgagcacgcggtccggttacaggagatacagagtttgctcactaactggaaggggccagacctgaccagctacggggaactggtgcttgagggaaccttccgcatccagcgagccaagaatgagcggacgctcttcctcttcgacaagctgctgctcatcacgaagaagagagatgacacgtttacatacaaagctcacatcctgtgtggcaacctcatgcttgtggaggtgattccaaaagagccgctcagcttcagcgtcttccactacaagaatcccaagctgcagcacacagtccaggccaaatcccagcaagacaaacgcctctgggttctgcacctaaagagactgattctggagaaccatgcagccaagattccagctaaggccaagcaagcaatccttgaaatggatgccattcatcatccaggcttctgttacagtcctgagggagggacgaaagcactgttcggctctaaagaaggttctgctccatatcggctgagaagaaaatctgaaccttcctcacggtcacataaagttttgaagaccagtgaaacagcacaagacatccaaaaggtttctagagaggaaggatctccccagctgtcttcagcaaggccgtctcctgcccagagaaatagtcagcctagcagttctaccatgatcagcgtgcttcgagcgggtggagctctcagaaacatctggaccgatcaccagatcaggcaagccttgtttcccagccgacggtccccgcaggagaatgaggatgatgaagatgattatcagatgttcgtgccgtcattttcctcctcagatctgaactctaccagactatgtgaagatagcacttctagtcgcccttgcagctggcatatgggacagatggagtccacagagacctccagctctggtcacaggattgtcaggcgggccagcagtgctggggagagcaacacatgccctcctgaaataggaactagtgacagaactagggaactgcagaacagccccaaaacagaagggcaggaggagatgactccctttgggtcatccatagagttgactattgatgacatagaccatgtctatgataacatcagttatgaggacttaaaactaatggttgctaagcgggaagaagctgaatccactccctctaaatcagccagggactccgttcgccccaagagcaccccagagttagccttcacaaagaggcaagctggccacagtaagggctctctttacgcacaaacagatggcaccctctcaggtggagaggcatccagccaaagcacgcatgaactccaagcggttgaggagaacatctatgacaccatagggctcccagatcctccgtcgctgggttttaagtgcagcagcctaaagcgtgcaaagcggagcacctttttgggtctggaggccgacttcgtgtgctgtgacagcctgaggccatttgtttcccaagacagcctccagctcagtgaggacgaagccccttaccatcaggccactcccgatcatggttatctgagtttgctgtatgactctcccagtggtaacttgtctatgcctcataagcctgtatctgataaactgtccgaagaagtagatgaaatctggaatgacctggaaaattacatcaagaaaaatgaagacaaggccagagaccgtctcctggcagcgtttcctgtgagcaaggatgatgtgccagacaggctgcacgcagagagcacccctgagctgagccgggacgtggggcgctctgtgtccacgctgtccctgcctgagagccaggctctcctcacgcccgtgaagagcagggctggcagagccagccgcgccaactgcccctttgaggaagacctgatttctaaagaaggctcctttatgagccttaaccggctttctctggctagtgaaatgcccctcatggacaatccctacgacctggccaacagtggcctgtctcaaacagacccagaaaaccctgacctggggatggaggccacagataagacaaaaagcagggtgtttatgatggctcggcagtacagtcagaagattaagaaggcgaatcaacttttaaaagtgaaaagtctggagctggagcagccgccggccagtcagcatcagaaatccatgcacaaagacctggctgccatcttggaagagaagaagcaaggagggcccgccattggtgccaggattgctgagtattcccagttgtatgaccagattgtattcagagagtctcccttgaaaattcagaaggatggctgggccagccctcaagaatcctccctcctgaggtctgtgtcaccttcccaggtccaccatggtagtggagactggcttctgcattcaacctatagtaatggagagttagcagatttctgtctcccaccagagcaagacttgaggtcaagatatcccacgtttgagatcaatacaaaaagtactcccaggcaattgtccgcagcttgctctgtgccttctcttcaaacctctgaccctctgccaggctctgtgcagagatgcagcgtggtagtaagtcagcccaacaaagagaactggtgtcaggaccatctttacaactccttgggtcggaaagggatcagcgctaaatctcagccttatcacaggtcccagtcatcttcctccgtcttgatcaacaaatcaatggattccatcaactaccctagtgatgtgggaaagcagcagctgctgtctttacacagaagttcaaggtgtgagagtcaccaggacttgctgccagatattgctgactcgcatcaacagggcactgaaaaactctcagatctcacactccaagactcacagaaagttgtggtggtcaatagaaatttacccttaaatgcccaaattgcaacacagaattatttttccaatttcaaagagactgatggagatgaagatgactatgtggaaatcaagtcagaagaagatgagtcggagttggagctatctcacaatcgtagaaggaaatctgactcaaagtttgtggatgctgacttttctgataatgtctgcagcggcaacacattgcattctttgaatagtccgcgcactccaaaaaagccggttaacagcaaacttggcctttcaccatatctgacaccatataatgattctgacaaactgaatgactatctttggagggggccatctcccaatcaacaaaatattgtccagtctctaagggaaaaatttcagtgtctcagttcaagcagctttgcttaaggttcttcataataactgcttgaatcaacttcttattttgctcataaaacgttacagatactgatgaggtgttttatgtataccagattaaaacaattttgtaagaaccagaggtgtaaaatatactttcttttacagcacaacttttggaaatggctgacgatgcagcccggattgtactgtagcacatgttggcatcaacagtatattttctcatgctgagtgtcttcatgtttcatgtaagtcaatcttacttgaaagtttttagacttttaacacgatggccataacctgacaatagtgcccacaccttaagaaatgcaataatcctttcctgttatccagaaggcccaggtagttttatcctgtgactcaaaggcagcaaggagactttttcacattttaaaaggcaacgaaagctgttgaaagaattatgcttatatctcacattttggttatatttgtggtaacaccttaggataacgtaagccagagatctgtaaattggactgcagtctgaggtgcccattttagggtttttgtgctagtattcttttatgtcattttgatgcagaaattgtgtgactgttgaaaattaaaatgtagcgggacccattttctgtacgcagaaccctttacctgtattcctggacaaggcctagagaacgagctgctcatcatgtttctaatataatttctggggtgaaatgaatgatttccttactggcttagagaaaaccaaggtcaataaaatgcagattgacttaactattagaaaagatgggatgacttctgggaaccacttaactcttcaaatgactgttgaaagagaaaaagcaaaactgaaatcccaccagaccattttgtgtgcctgtttctaatcgatacaaagttaagcatgagctaaaatcagacaaagcactttaaatttatcctttccagagcgctttgcacatgcaccctcctgagtttgggattctgccaaatgaccaacttgatcctggccctgaggagtcattggctgcaggaatagggcaagaatctatttcctaaactacacataacatgggagcctttttttcgttgttttcaggtatattaaagaatgaaatctttggttactaggtgctgactaataaataacaccttttatattctgaccatttgtcacatttcattgtgatactgtatactgatctaactccttatgaaaggcaacaaacaaaaataagacattgaataaaaagcaaaatcaaagaagctaaagagaaaaatgaaggcagatatattgcaactttataacatattctattttattgaagactgcaattaatgcagcaagaatgctttctcaagcggtggcctttgtattctcattttaatcaggtgtacattctatggcctctcccccatgctgttagtttctattttaaaagatacaataatatatgtagggaaaggggcctgggctcttcatttaaaggtaagcagtaatattgagtaagtgacataattctttttctctttgttaagtcctatgcctctttttcttaactgtaaaacatagaatatgagcgtttttatcttacaaataggtacctaaggcatgtgattttatttttaaataacaaaaaataacccaagtttcttgcttctccaaagtattcttctcatagcttataaaagaaagtccacattgaatagcatggtctgggaacattccttctttattgtgtttatttgaacatgatatgagtttccaagatgaaatgatcaaaaaagataagtaccacaagaaagtttttttgtttggttggtttttttgtttgtttgtttttttcttgagactgagtctctccctgttgcccaagttggagtgcaatcttggctcactgcagcctccacctccccggttccagcgattctcctgcctcagcctcttgaatagctgggattacaggcgcccgccaccacacctggctaatttttgtgttgttagtagaggcggggtttcatcatgttggccaggctggtctcgaactcctgatctcatgatccgtctgcctcggcctcccagagtgctgggattacaggcatgagccactgcgcccggccaagaaagtatgtttttagaggtgtgtgtaagtgcatttgtattacctatgaacaaaattacctgactcttgtcccaggaaagctgtttcgcattttcgctttttgattggtattatccagttctatgtagttcatattattgttctgtctgactctcagaaattacttcttcacgccagtgtcttgttgcatgactttgatgtcacctataggaatacacctcactgcacgtaagtgggtatcttactgtataaaaggtctacatggctttaggttttaggacaaatgtgtagatttatagaccatttctgttggccaggacacagattttgagagctgtgtgtatatatatataatcatgtttgtatttttttcctgaaagttatcaattgcttttgtttaaaacagtttgttttagaggtggggtggggatgtatataacgaggaaaagttatatgtactttaaagtatgtcaagttcttactagtttcctgtactgaaggttcaattttttttatataagtttacttttcacctgctctattctttgtggggaaaaaatgcatctagaaaaacatagtttaaatactgtatataagataatgaaagttagtaacgtccattatttaataaagtttgtaaagtacaaggt

SEQ ID NO: 5712 - DNA, 478 bp, Homo sapiens
ccgagcctgagcccgagcccgagcccgacggcggctgcagggcgctccggcagcccgagccggcgcagcgcagcccgcaccctccccgcccgacctgcgagcgccgcccgggcatgcgaagccgtccctccccgggaaaggagagtgaatatctatggatattgccctggcccttaagaaggtgaagactgatgagaagagtctgtgggtgaagacattgaaaaggtttcaactataaaaatgggcaccagttgcgtcttgaagtgccatcagctgtaaccaaagttccacatcccaagacgacagccaggcgttcctgccctcaagaactgaagacaatggagctctctgatagtgaccgacccgtcagcttcggttccacatcatcctcggcctcttcccgcgacagccatggttccttcggcagcagaatgaccttagtttcaaatagccacatgggcttgtttaaccaggataa

SEQ ID NO: 5713 - DNA, 7237 bp, Homo sapiens
gaggaagaggaagtcggagcccgagcctgagcccgagcccgagcccgacggcggctgcagggcgctccggcagcccgagccggcgcagcgcagcccgcaccctccccgcccgacctgcgagcgccgcccgggcatgcgaagccgtccctccccgggtgaagactgatgagaagagtctgtgggtgaagacattgaaaaggtttcaactataaaaatgggcaccagttgcgtcttgaagtgccatcagctgtaaccaaagttccacatcccaagacgacagccaggcgttcctgccctcaagaactgaagacaatggagctctctgatagtgaccgacccgtcagcttcggttccacatcatcctcggcctcttcccgcgacagccatggttccttcggcagcagaatgaccttagtttcaaatagccacatgggcttgtttaaccaggataaggaggtaggggccataaaactggagctgattcctgccaggccgttttccagcagcgagctgcagagggacaaccccgccacggggcaacagaacgcggatgagggcagcgaaaggccacccagagcgcagtggagagtggactcaaacggggcacccaagacgatcgcagactcggccacgagccccaagctcctctatgtggatagagttgttcaggaaattctggaaaccgaaaggacttatgtacaagatttaaaaagcatcgtagaggattaccttgactgcatcagggaccaaacaaaacttcccctggggaccgaagaaagatcagccctttttggaaacatacaggatatctaccacttcaatagtgaacttctgcaagatttggaaaactgtgaaaatgatcctgtggccatagcagagtgttttgtgtccaagagtgaagagttccacatttatacccagtattgcactaactatccaaggtccgtggctgtgctaacagagtgtatgaggaacaagatactggccaaattcttcagggagcgtcaggaaactctgaaacactcgctgcctctggggtcctatctcttgaaaccagttcagcggattctcaagtatcatctccttctgcatgaaatagaaaaccaccttgataaggacacagaaggctatgatgtggtgcttgatgctatagacacaatgcagcgagtcgcctggcatatcaatgacatgaagcggaaacacgagcacgcggtccggttacaggagatacagagtttgctcactaactggaaggggccagacctgaccagctacggggaactggtgcttgagggaaccttccgcatccagcgagccaagaatgagcggacgctcttcctcttcgacaagctgctgctcatcacgaagaagagagatgacacgtttacatacaaagctcacatcctgtgtggcaacctcatgcttgtggaggtgattccaaaagagccgctcagcttcagcgtcttccactacaagaatcccaagctgcagcacacagtccaggccaaatcccagcaagacaaacgcctctgggttctgcacctaaagagactgattctggagaaccatgcagccaagattccagctaaggccaagcaagcaatccttgaaatggatgccattcatcatccaggcttctgttacagtcctgagggagggacgaaagcactgttcggctctaaagaaggttctgctccatatcggctgagaagaaaatctgaaccttcctcacggtcacataaagttttgaagaccagtgaaacagcacaagacatccaaaaggtttctagagaggaaggatctccccagctgtcttcagcaaggccgtctcctgcccagagaaatagtcagcctagcagttctaccatgatcagcgtgcttcgagcgggtggagctctcagaaacatctggaccgatcaccagatcaggcaagccttgtttcccagccgacggtccccgcaggagaatgaggatgatgaagatgattatcagatgttcgtgccgtcattttcctcctcagatctgaactctaccagactatgtgaagatagcacttctagtcgcccttgcagctggcatatgggacagatggagtccacagagacctccagctctggtcacaggattgtcaggcgggccagcagtgctggggagagcaacacatgccctcctgaaataggaactagtgacagaactagggaactgcagaacagccccaaaacagaagggcaggaggagatgactccctttgggtcatccatagagttgactattgatgacatagaccatgtctatgataacatcagttatgaggacttaaaactaatggttgctaagcgggaagaagctgaatccactccctctaaatcagccagggactccgttcgccccaagagcaccccagagttagccttcacaaagaggcaagctggccacagtaagggctctctttacgcacaaacagatggcaccctctcaggtggagaggcatccagccaaagcacgcatgaactccaagcggttgaggagaacatctatgacaccatagggctcccagatcctccgtcgctgggttttaagtgcagcagcctaaagcgtgcaaagcggagcacctttttgggtctggaggccgacttcgtgtgctgtgacagcctgaggccatttgtttcccaagacagcctccagctcagtgaggacgaagccccttaccatcaggccactcccgatcatggttatctgagtttgctgtatgactctcccagtggtaacttgtctatgcctcataagcctgtatctgataaactgtccgaagaagtagatgaaatctggaatgacctggaaaattacatcaagaaaaatgaagacaaggccagagaccgtctcctggcagcgtttcctgtgagcaaggatgatgtgccagacaggctgcacgcagagagcacccctgagctgagccgggacgtggggcgctctgtgtccacgctgtccctgcctgagagccaggctctcctcacgcccgtgaagagcagggctggcagagccagccgcgccaactgcccctttgaggaagacctgatttctaaagaaggctcctttatgagccttaaccggctttctctggctagtgaaatgcccctcatggacaatccctacgacctggccaacagtggcctgtctcaaacagacccagaaaaccctgacctggggatggaggccacagataagacaaaaagcagggtgtttatgatggctcggcagtacagtcagaagattaagaaggcgaatcaacttttaaaagtgaaaagtctggagctggagcagccgccggccagtcagcatcagaaatccatgcacaaagacctggctgccatcttggaagagaagaagcaaggagggcccgccattggtgccaggattgctgagtattcccagttgtatgaccagattgtattcagagagtctcccttgaaaattcagaaggatggctgggccagccctcaagaatcctccctcctgaggtctgtgtcaccttcccaggtccaccatggtagtggagactggcttctgcattcaacctatagtaatggagagttagcagatttctgtctcccaccagagcaagacttgaggtcaagatatcccacgtttgagatcaatacaaaaagtactcccaggcaattgtccgcagcttgctctgtgccttctcttcaaacctctgaccctctgccaggctctgtgcagagatgcagcgtggtagtaagtcagcccaacaaagagaactggtgtcaggaccatctttacaactccttgggtcggaaagggatcagcgctaaatctcagccttatcacaggtcccagtcatcttcctccgtcttgatcaacaaatcaatggattccatcaactaccctagtgatgtgggaaagcagcagctgctgtctttacacagaagttcaaggtgtgagagtcaccaggacttgctgccagatattgctgactcgcatcaacagggcactgaaaaactctcagatctcacactccaagactcacagaaagttgtggtggtcaatagaaatttacccttaaatgcccaaattgcaacacagaattatttttccaatttcaaagagactgatggagatgaagatgactatgtggaaatcaagtcagaagaagatgagtcggagttggagctatctcacaatcgtagaaggaaatctgactcaaagtttgtggatgctgacttttctgataatgtctgcagcggcaacacattgcattctttgaatagtccgcgcactccaaaaaagccggttaacagcaaacttggcctttcaccatatctgacaccatataatgattctgacaaactgaatgactatctttggagggggccatctcccaatcaacaaaatattgtccagtctctaagggaaaaatttcagtgtctcagttcaagcagctttgcttaaggttcttcataataactgcttgaatcaacttcttattttgctcataaaacgttacagatactgatgaggtgttttatgtataccagattaaaacaattttgtaagaaccagaggtgtaaaatatactttcttttacagcacaacttttggaaatggctgacgatgcagcccggattgtactgtagcacatgttggcatcaacagtatattttctcatgctgagtgtcttcatgtttcatgtaagtcaatcttacttgaaagtttttagacttttaacacgatggccataacctgacaatagtgcccacaccttaagaaatgcaataatcctttcctgttatccagaaggcccaggtagttttatcctgtgactcaaaggcagcaaggagactttttcacattttaaaaggcaacgaaagctgttgaaagaattatgcttatatctcacattttggttatatttgtggtaacaccttaggataacgtaagccagagatctgtaaattggactgcagtctgaggtgcccattttagggtttttgtgctagtattcttttatgtcattttgatgcagaaattgtgtgactgttgaaaattaaaatgtagcgggacccattttctgtacgcagaaccctttacctgtattcctggacaaggcctagagaacgagctgctcatcatgtttctaatataatttctggggtgaaatgaatgatttccttactggcttagagaaaaccaaggtcaataaaatgcagattgacttaactattagaaaagatgggatgacttctgggaaccacttaactcttcaaatgactgttgaaagagaaaaagcaaaactgaaatcccaccagaccattttgtgtgcctgtttctaatcgatacaaagttaagcatgagctaaaatcagacaaagcactttaaatttatcctttccagagcgctttgcacatgcaccctcctgagtttgggattctgccaaatgaccaacttgatcctggccctgaggagtcattggctgcaggaatagggcaagaatctatttcctaaactacacataacatgggagcctttttttcgttgttttcaggtatattaaagaatgaaatctttggttactaggtgctgactaataaataacaccttttatattctgaccatttgtcacatttcattgtgatactgtatactgatctaactccttatgaaaggcaacaaacaaaaataagacattgaataaaaagcaaaatcaaagaagctaaagagaaaaatgaaggcagatatattgcaactttataacatattctattttattgaagactgcaattaatgcagcaagaatgctttctcaagcggtggcctttgtattctcattttaatcaggtgtacattctatggcctctcccccatgctgttagtttctattttaaaagatacaataatatatgtagggaaaggggcctgggctcttcatttaaaggtaagcagtaatattgagtaagtgacataattctttttctctttgttaagtcctatgcctctttttcttaactgtaaaacatagaatatgagcgtttttatcttacaaataggtacctaaggcatgtgattttatttttaaataacaaaaaataacccaagtttcttgcttctccaaagtattcttctcatagcttataaaagaaagtccacattgaatagcatggtctgggaacattccttctttattgtgtttatttgaacatgatatgagtttccaagatgaaatgatcaaaaaagataagtaccacaagaaagtttttttgtttggttggtttttttgtttgtttgtttttttcttgagactgagtctctccctgttgcccaagttggagtgcaatcttggctcactgcagcctccacctccccggttccagcgattctcctgcctcagcctcttgaatagctgggattacaggcgcccgccaccacacctggctaatttttgtgttgttagtagaggcggggtttcatcatgttggccaggctggtctcgaactcctgatctcatgatccgtctgcctcggcctcccagagtgctgggattacaggcatgagccactgcgcccggccaagaaagtatgtttttagaggtgtgtgtaagtgcatttgtattacctatgaacaaaattacctgactcttgtcccaggaaagctgtttcgcattttcgctttttgattggtattatccagttctatgtagttcatattattgttctgtctgactctcagaaattacttcttcacgccagtgtcttgttgcatgactttgatgtcacctataggaatacacctcactgcacgtaagtgggtatcttactgtataaaaggtctacatggctttaggttttaggacaaatgtgtagatttatagaccatttctgttggccaggacacagattttgagagctgtgtgtatatatatataatcatgtttgtatttttttcctgaaagttatcaattgcttttgtttaaaacagtttgttttagaggtggggtggggatgtatataacgaggaaaagttatatgtactttaaagtatgtcaagttcttactagtttcctgtactgaaggttcaattttttttatataagtttacttttcacctgctctattctttgtggggaaaaaatgcatctagaaaaacatagtttaaatactgtatataagataatgaaagttagtaacgtccattatttaataaagtttgtaaagtacaaggt

SEQ ID NO: 5714 - DNA, 3621 bp, Homo sapiens
ctcaattgaatgatgtcatgtttcatttaaggctcttagtgatgctgaagtctgtggtctgcacactagggggaaaaaggcagtgagaaagttgcaaatcaggtttttgtaaagcctttgtgtgttgggtttgggagataaaagctgactcatgcaatatttctacggaaggcgctgcacagactagcaaaggctgtttcttttacctgactgaggtcactgcatcagctgaaggcagacgatgtgcttaagcctgagtggagcagagatgggcaccagttgcgtcttgaagtgccatcagctgtaaccaaagttccacatcccaagacgacagccaggcgttcctgccctcaagaactgaagacaatggagctctctgatagtgaccgacccgtcagcttcggttccacatcatcctcggcctcttcccgcgacagccatggttccttcggcagcagaatgaccttagtttcaaatagccacatgggcttgtttaaccaggataaggaggtaggggccataaaactggagctgattcctgccaggccgttttccagcagcgagctgcagagggacaaccccgccacggggcaacagaacgcggatgagggcagcgaaaggccacccagagcgcagtggagagtggactcaaacggggcacccaagacgatcgcagactcggccacgagccccaagctcctctatgtggatagagttgttcaggaaattctggaaaccgaaaggacttatgtacaagatttaaaaagcatcgtagaggattaccttgactgcatcagggaccaaacaaaacttcccctggggaccgaagaaagatcagccctttttggaaacatacaggatatctaccacttcaatagtgaacttctgcaagatttggaaaactgtgaaaatgatcctgtggccatagcagagtgttttgtgtccaagagtgaagagttccacatttatacccagtattgcactaactatccaaggtccgtggctgtgctaacagagtgtatgaggaacaagatactggccaaattcttcagggagcgtcaggaaactctgaaacactcgctgcctctggggtcctatctcttgaaaccagttcagcggattctcaagtatcatctccttctgcatgaaatagaaaaccaccttgataaggacacagaaggctatgatgtggtgcttgatgctatagacacaatgcagcgagtcgcctggcatatcaatgacatgaagcggaaacacgagcacgcggtccggttacaggagatacagagtttgctcactaactggaaggggccagacctgaccagctacggggaactggtgcttgagggaaccttccgcatccagcgagccaagaatgagcggacgctcttcctcttcgacaagctgctgctcatcacgaagaagagagatgacacgtttacatacaaagctcacatcctgtgtggcaacctcatgcttgtggaggtgattccaaaagagccgctcagcttcagcgtcttccactacaagaatcccaagctgcagcacacagtccaggccaaatcccagcaagacaaacgcctctgggttctgcacctaaagagactgattctggagaaccatgcagccaagattccagctaaggccaagcaagcaatccttgaaatggatgccattcatcatccaggcttctgttacagtcctgagggagggacgaaagcactgttcggctctaaagaaggttctgctccatatcggctgagaagaaaatctgaaccttcctcacggtcacataaagttttgaagaccagtgaaacagcacaagacatccaaaaggtttctagagaggaaggatctccccagctgtcttcagcaaggccgtctcctgcccagagaaatagtcagcctagcagttctaccatgatcagcgtgcttcgagcgggtggagctctcagaaacatctggaccgatcaccagatcaggcaagccttgtttcccagccgacggtccccgcaggagaatgaggatgatgaagatgattatcagatgttcgtgccgtcattttcctcctcagatctgaactctaccagactatgtgaagatagcacttctagtcgcccttgcagctggcatatgggacagatggagtccacagagacctccagctctggtcacaggattgtcaggcgggccagcagtgctggggagagcaacacatgccctcctgaaataggaactagtgacagaactagggaactgcagaacagccccaaaacagaagggcaggaggagatgactccctttgggtcatccatagagttgactattgatgacatagaccatgtctatgataacatcagttatgaggacttaaaactaatggttgctaagcgggaagaagctgaatccactccctctaaatcagccagggactccgttcgccccaagagcaccccagagttagccttcacaaagaggcaagctggccacagtaagggctctctttacgcacaaacagatggcaccctctcaggtggagaggcatccagccaaagcacgcatgaactccaagcggttgaggagaacatctatgacaccatagggctcccagatcctccgtcgctgggttttaagtgcagcagcctaaagcgtgcaaagcggagcacctttttgggtctggaggccgacttcgtgtgctgtgacagcctgaggccatttgtttcccaagacagcctccagctcagtgaggacgaagccccttaccatcaggccactcccgatcatggttatctgagtttgctgtatgactctcccagtggtaacttgtctatgcctcataagcctgtatctgataaactgtccgaagaagtagatgaaatctggaatgacctggaaaattacatcaagaaaaatgaagacaaggccagagaccgtctcctggcagcgtttcctgtgagcaaggatgatgtgccagacaggctgcacgcagagagcacccctgagctgagccgggacgtggggcgctctgtgtccacgctgtccctgcctgagagccaggctctcctcacgcccgtgaagagcagggctggcagagccagccgcgccaactgcccctttgaggaagacctgatttctaaagaaggctcctttatgagccttaaccggctttctctggctagtgaaatgaccctctgccaggctctgtgcagagatgcagcgtggtagtaagtcagcccaacaaagagaactggtgtcaggaccatctttacaactccttgggtcggaaagggatcagcgctaaatctcagccttatcacaggtcccagtcatcttcctccgtcttgatcaacaaatcaatggattccatcaactaccctagtgatgtgggaaagcagcagctgctgtctttacacagaagttcaaggtgtgagagtcaccaggacttgctgccagatattgctgactcgcatcaacagggcactgaaaaactctcagatctcacactccaagactcacagaaagttgtggtggtcaatagaaatttacccttaaatgcccaaattgcaacacagaattatttttccaatttcaaagagactgatggagatgaagatgactatg

SEQ ID NO: 5715 - DNA, 6989 bp, Homo sapiens
cctcgctccctcctgccctcccgctgcagctccggctccgctcgacttcctgccgggcgctggcaagccgcgcgctgcctggggtctccgggggccgcgcttgcagctggccgagtccgggccagctgaggggctggcggtgggcgggagcggtcggcggcctcagccccttcagagagcgactttcaaactcgcgcccgcgtcgcggcagcacctgggcagccccgcacgccgtgcgcgtcccgagcccgcggggcagctaccgctcgaatctccctggggtgccctccccaggcagcaatgccaggatgcctgtgtccacctccctccaccaggatggcagccaggagcggccggtgagcctgacctctaccacctcctcgtcgggctcctcctgtgacagtcgcagtgccatggaggagcccagcagctccgaggctcccgccaagaatggggcaggctccctgagaagccggcatctgcccaacagcaacaacaactccagcagctggttgaacgtgaaggggcccctctccccgttcaacagccgggcagcggcagggcctgcacaccacaagctcagctacctgggccgagtggtgcgggagatcgtggagacagagcgcatgtacgtacaggacctgcgcagcatcgtggagagccaagagtttgatatctacactcagtattgcaacaattaccccaactccgtggccgccctgacggaatgcatgcgggacaagcagcaggccaagttctttcgggaccggcaggagctgctacagcactcgctgcccttgggctcctacctgctgaagccagtccagcgcatcctcaagtaccacctgctgctccaggaaattgccaagcattttgatgaagaagaggatggctttgaggtggtggaggatgccattgacaccatgacctgtgtggcctggtacatcaacgacatgaagaggaggcatgagcacgcggtccggctccaggagattcagtcactcctcatcaactggaaggggcccgacctgaccacctacggggagcttgtcctggagggcacattccgcgtgcatcgcgtgcgcaatgaaaggacctttttcctctttgacaaaacactgcttatcaccaagaagcggggcgatcactttgtctacaagggcaacatcccgtgctcctccctgatgctgatcgaaagcaccagagactccctgtgcttcactgtcacccactacaagcacagcaagcagcagtacagcatccaggccaagacagtggaggagaaacggaactggactcaccacatcaagaggctcatcctagagaaccaccatgccaccattccccagaaggccaaggaagccatcttggaaatggattcctattatcccaatcggtaccgctgcagcccagagcggctgaagaaggcttggtcctcccaggatgaggtgtccaccaatgtgcgccaggggcgccggcaatctgagccaaccaaacacctgctcaggcaactcaacgagaaagcccgagcagcaggaatgaagggaaaggggcgcagggagtctgaaagctccaggagcagcagaaggcccagtggccggtctccaaccagtactgagaagcgcatgagcttcgagtccatttcttccctgccagaggttgagccggaccctgaggctgggagtgagcaagaggtattttctgctgtggaagggcccagtgccgaggagacgccttcagacacagaatctccagaagtcctggagacacagcttgatgcccaccagggccttctggggatggaccccccaggtgacatggtggacttcgtggcagctgagagcactgaggaccttaaggccctgagcagcgaggaggaagaagaaatgggaggtgccgcccaggagcctgagagccttctgccaccctctgtgctggaccaggccagcgtcattgcggagcgatttgtcagcagcttctctcggcggagcagcgtggcacaggaggacagcaagtccagtggctttgggagcccgcggctggtcagccggagcagcagcgtgctcagcctggagggcagcgagaagggcctggcccggcatggcagtgccacagactccctcagctgtcagctctccccagaagtggacatcagtgtgggggtggccacagaggacagcccttctgtcaatgggatggagcccccaagcccaggctgcccagtggagcctgaccggtcttcctgcaagaagaaggaatcagcactctccacccgagaccggctgttgctagacaagattaagagctattatgaaaatgcagaacaccatgatgcaggcttcagcgtccgtcgccgggagagcctctcctacatccccaaaggactggtaagaaactccatctccaggttcaacagccttccccggccagacccagagccagtacctccagtggggagcaagagacaggtgggctcccggccgacttcgtgggccctgtttgagctcccaggaccaagccaggcagtcaaaggggacccacctcccatctcagatgctgagttccgcccatcttcagaaattgtgaagatctgggagggaatggagtcttccggagggagccctgggaaggggccaggccagggccaggccaatggctttgacctgcatgagccactcttcatcctggaggagcatgagctgggagccatcacagaggagtcggccactgcctccccggaaagctcctctcccactgaggggcgcagcccggcccacctggcccgggagctgaaagagctggtgaaggagctgagcagcagtacccagggggagctggtggccccactgcacccccgcatcgtgcagctctcccacgtaatggacagccacgtgagcgagcgcgtcaagaacaaggtctaccagctggcccgccagtacagcctccggatcaagagcaacaagccagtgatggccaggccaccactgcagtgggaaaaggtggcccctgagagggatgggaagagccccactgtgccctgtctacaggaagaggctggagagccattaggtggcaaaggtaagaggaagccggtgctgtctctatttgactatgagcagctgatggcccaggagcacagccctcccaagccctcctcggctggggagatgtcaccacagcgtttcttcttcaacccgtctgctgtcagccagaggaccacctcgcctgggggccggccctccgcccggagccccctcagccccacagagaccttcagctggcccgacgtccgtgagctctgctccaagtatgcctcccgcgatgaggcacgccgagcagggggcggccggccccgcggcccacccgtcaacaggagccactcggtgccggagaacatggtagagccacctctgtcgggcagggtgggccgctgccgcagcctgagcaccaagaggggccggggaggcggagaggctgcccaatcccctgggcctctgccccagagcaagccggatggaggcgagaccctgtatgtcactgcagacctcaccctggaggacaaccggcgggtgattgtcatggagaagggaccccttcccagccccactgcagggctggaggagagcagtggccagggaccaagctcaccggtggccctgctggggcaggttcaggacttccagcagtctgcagagtgccagccgaaggaagagggttccagggacccggcagacccgagccagcagggcagagtgagaaaccttagagagaagttccaggccttgaactctgtcggttgatgctgactcctgggggagggaggagtcatgttggaggttggggaagaacctgggcatccttcccctcaagcctgggctcatggagcccctgcccagggccctcaggtgggcggaaagtccatcccctccgcccttcaggaaggatgctcccgtgtgcaggggtctcctgcctgtgccatccactggggctcgagacaatttcccactcacctgtgaggccggtgtggctgcttcccttgtaaatagttgttctctggtaagaagccaaatatttaagctcacttcttcccagagagaggaagctctgctcaggcctccagcgttggctggccatggccacagccagatggaggagcccatccccaggagactcaggcagtggcctggagaggctttgttctgtaacggtgccttttcttagggtccaggcaggaatgaagccaataatttattgctttccattctgtggtatgatgtgcgtgtgcgtgagtgtgtggcccctgtttattcccctcctgtcaagaatgaagtggattcagttcaggtacttttgagggttgttgtgctgaccctgtggttgtcgctgatgtacacacatttcattatttgccaatggtgcaataaccactgctgaccaacccactatgtgtgaactccttcctaggcttggctggggtagggaaggttattcatgggccagggatgtcttagggagatggagacatggaggttgttccttccacactcaattgtcacttgggcttatgaaacataaggcacccgggtactggtgggggaggtggggcaggaggatgtgagggcgggctttttctttctgctgcctagactcccatgggcttctctgtctagcagcagcctgctgtcctgtctagggtagggggtcccgcatgccagccttttgctcttttccccaagggccagagttggaccaagaaaaagggaggtggtgaggtggatagactgtttttctcataagcagatgctcccagtatctggtgccttttgcgtttctctccggtccccaggaaacatcctagaagacaaggattttttttttttttttttttgagacagagtcttattctgtcacccaggctggagtgcaatggcgtgatcttggcttactgcaacctccgcctcccaggttcaagcaattctcgttgtctcagcctcccaggtcgctgggactacaggcatgagccaccacacccagctaattttttgtatttttagtagagacggggtttcgccgtgttgaccaggctggtctcgaacttctgacctcaggtgatccacccacctcggcctcccaaagtgctgggattacaggggtgagccactgcatgcggctgaaggtaaggattctaaactcggagactagaaatgtcctaaaggtgtctgcaacattggatgaggagtacaagtgcatttttctgggatgattcctccctttttatcacattctcagaagtatctttgattcagaagagttaggaatgcctccctatttcagttgggttttctgccctttctccacagaggtccagactcattttgcttaattttttttctagctggggcctgggaggtagaggcttcagggcctgggtggtagagctgcctgacaagtgttcagcagggctgctgggtcagggccctgtgggccttctgacccaacctgaagatgggtctgctaagtctaacaaggtcaagggaagatcagagggacccagattcttttttatcccccacttgaaacggagtcttgctctgtcgcccaggctggagcgcagtggtgcaatcttggctcactgcaacctccgcctccctgaccctcacactgtccagtgcccttgtggttactcagcatcatatcttgagactggcctggcaggagccagtgactgtggaatgaccacagaagattcagggcagctgccagaccaggggctatctctgccctgcgctgcttctgctcaagagaggttgtcactagcctctgatcttcccttgaagaacccgactggggctcttcagagggtggggcccaggaagttgtagttaaccccttccccaggcagtccttacacggccatctaggtatgcctgggaaccttgcaccaggtcggtggttctcactggctgcccattggaattatctggggagccttctggaaacgcagtgcttacattccatctccctagaccaacagaaactgccctctggaggtgaatcccaggcttagagattctgatgattctgcggtccagtgagtgctgagatctgtcctgagctctgtggggaggggcctggactgatcactgcttggaaatgattttgccctacagtaggccttcaagttgatcaaatgcatgaatgagcaagcttttcttggagtttgtgatgaagcccaggaaccgggtgcttgcagtcgtcccataaggctcccagggacaagctagagaatctggctgtccctctgtctccatggtgccagccctcttaggctcagttcaaagggagaggaggctagttaaataagaaactgagagaaacatggagcattattgatttattagaaaaactagtaaatgggtttcctctggttggtggaagcacggttgagcaggtggaggacaggacccagctggccccagggccagccccagattgcatggtctgtgcccaacagggttgcattcctctgcagccgccgcctcctcatttcctccctgagcttgtttgtccaagccaccaagccatgtggtcccgctggcttcatcctcctctggattcctgcccccctcccatgaagggaggaagaggattcagggtcagcctaggggaccctggctccctccgataggcaggaaggaggagggatgcggaggagaggctgagccttccacgggcctcctgttaggggtgttggtggaggccaggttggggagggaagcctaaggaccctccacacctcccacagccagagtcagttgaggctgggacaaaggggaaggagagagggaaggaggaccgcctgaccttgcccagaaggagcttcctctaaactgccctgggaaggaagcctggtatgctggtgtggactggagctgtgtcaacctcgtttgggaatactgtcaaaagactgtagagtagaataaggagag

SEQ ID NO: 5716 - DNA, 4396 bp, Homo sapiens
ctcagccccttcagagagcgactttcaaactcgcgcccgcgtcgcggcagcacctgggcagccccgcacgccgtgcgcgtcccgagcccgcggggcagctaccgctcgaatctccctggggtgccctccccaggcagcaatgccaggatgcctgtgtccacctccctccaccaggatggcagccaggagcggccggtgagcctgacctctaccacctcctcgtcgggctcctcctgtgacagtcgcagtgccatggaggagcccagcagctccgaggctcccgccaagaatggggcaggctccctgagaagccggcatctgcccaacagcaacaacaactccagcagctggttgaacgtgaaggggcccctctccccgttcaacagccgggcagcggcagggcctgcacaccacaagctcagctacctgggccgagtggtgcgggagatcgtggagacagagcgcatgtacgtacaggacctgcgcagcatcgtggaggactacctcttgaagatcattgacacacccgggctgctgaagccagaacaggtcagcgccctctttgggaacatagaaaatatctacgcgctgaacagccagctcctcagagacctggacagctgcaatagtgaccccgtggctgtggccagctgctttgtggaaaggagccaagagtttgatatctacactcagtattgcaacaattaccccaactccgtggccgccctgacggaatgcatgcgggacaagcagcaggccaagttctttcgggaccggcaggagctgctacagcactcgctgcccttgggctcctacctgctgaagccagtccagcgcatcctcaagtaccacctgctgctccaggaaattgccaagcattttgatgaagaagaggatggctttgaggtggtggaggatgccattgacaccatgacctgtgtggcctggtacatcaacgacatgaagaggaggcatgagcacgcggtccggctccaggagattcagtcactcctcatcaactggaaggggcccgacctgaccacctacggggagcttgtcctggagggcacattccgcgtgcatcgcgtgcgcaatgaaaggacctttttcctctttgacaaaacactgcttatcaccaagaagcggggcgatcactttgtctacaagggcaacatcccgtgctcctccctgatgctgatcgaaagcaccagagactccctgtgcttcactgtcacccactacaagcacagcaagcagcagtacagcatccaggccaagacagtggaggagaaacggaactggactcaccacatcaagaggctcatcctagagaaccaccatgccaccattccccagaaggccaaggaagccatcttggaaatggattcctattatcccaatcggtaccgctgcagcccagagcggctgaagaaggcttggtcctcccaggatgaggtgtccaccaatgtgcgccaggggcgccggcaatctgagccaaccaaacacctgctcaggcaactcaacgagaaagcccgagcagcaggaatgaagggaaaggggcgcagggagtctgaaagctccaggagcagcagaaggcccagtggccggtctccaaccagtactgagaagcgcatgagcttcgagtccatttcttccctgccagaggttgagccggaccctgaggctgggagtgagcaagaggtattttctgctgtggaagggcccagtgccgaggagacgccttcagacacagaatctccagaagtcctggagacacagcttgatgcccaccagggccttctggggatggaccccccaggtgacatggtggacttcgtggcagctgagagcactgaggaccttaaggccctgagcagcgaggaggaagaagaaatgggaggtgccgcccaggagcctgagagccttctgccaccctctgtgctggaccaggccagcgtcattgcggagcgatttgtcagcagcttctctcggcggagcagcgtggcacaggaggacagcaagtccagtggctttgggagcccgcggctggtcagccggagcagcagcgtgctcagcctggagggcagcgagaagggcctggcccggcatggcagtgccacagactccctcagctgtcagctctccccagaagtggacatcagtgtgggggtggccacagaggacagcccttctgtcaatgggatggagcccccaagcccaggctgcccagtggagcctgaccggtcttcctgcaagaagaaggaatcagcactctccacccgagaccggctgttgctagacaagattaagagctattatgaaaatgcagaacaccatgatgcaggcttcagcgtccgtcgccgggagagcctctcctacatccccaaaggactggtaagaaactccatctccaggttcaacagccttccccggccagacccagagccagtacctccagtggggagcaagagacaggtgggctcccggccgacttcgtgggccctgtttgagctcccaggaccaagccaggcagtcaaaggggacccacctcccatctcagatgctgagttccgcccatcttcagaaattgtgaagatctgggagggaatggagtcttccggagggagccctgggaaggggccaggccagggccaggccaatggctttgacctgcatgagccactcttcatcctggaggagcatgagctgggagccatcacagaggagtcggccactgcctccccggaaagctcctctcccactgaggggcgcagcccggcccacctggcccgggagctgaaagagctggtgaaggagctgagcagcagtacccagggggagctggtggccccactgcacccccgcatcgtgcagctctcccacgtaatggacagccacgtgagcgagcgcgtcaagaacaaggtctaccagctggcccgccagtacagcctccggatcaagagcaacaagccagtgatggccaggccaccactgcagtgggaaaaggtggcccctgagagggatgggaagagccccactgtgccctgtctacaggaagaggctggagagccattaggtggcaaaggtaagaggaagccggtgctgtctctatttgactatgagcagctgatggcccaggagcacagccctcccaagccctcctcggctggggagatgtcaccacagcgtttcttcttcaacccgtctgctgtcagccagaggaccacctcgcctgggggccggccctccgcccggagccccctcagccccacagagaccttcagctggcccgacgtccgtgagctctgctccaagtatgcctcccgcgatgaggcacgccgagcagggggcggccggccccgcggcccacccgtcaacaggagccactcggtgccggagaacatggtagagccacctctgtcgggcagggtgggccgctgccgcagcctgagcaccaagaggggccggggaggcggagaggctgcccaatcccctgggcctctgccccagagcaagccggatggaggcgagaccctgtatgtcactgcagacctcaccctggaggacaaccggcgggtgattgtcatggagaagggaccccttcccagccccactgcagggctggaggagagcagtggccagggaccaagctcaccggtggccctgctggggcaggttcaggacttccagcagtctgcagagtgccagccgaaggaagagggttccagggacccggcagacccgagccagcagggcagagtgagaaaccttagagagaagttccaggccttgaactctgtcggttgatgctgactcctgggggagggaggagtcatgttggaggttggggaagaacctgggcatccttcccctcaagcctgggctcatggagcccctgcccagggccctcaggtgggcggaaagtccatcccctccgcccttcaggaaggatgctcccgtgtgcaggggtctcctgcctgtgccatccactggggctcgagacaatttcccactcacctgtgaggccggtgtggctgcttcccttgtaaatagttgttctctggtaagaagccaaatatttaagctcacttcttcccagagagaggaagctctgctcaggcctccagcgttggctggccatggccacagccagatggaggagcccatccccaggagactcaggcagtggcctggagaggctttgttctgtaacggtgccttttcttagggtccaggcaggaatgaagccaataatttattgctttccattctgtggtatgatgtgcgtgtgcgtgagtgtgtggcccctgtttattcccctcctgtcaagaatgaagtggattcagttcaggtacttttgagggttgttgtgctgaccctgtggttgtcgctgatg

SEQ ID NO: 5717 - DNA, 658 bp, Homo sapiens
gtgagccatcatgcctggccgagaaagcgagttttctagaagactgattcactgattgatgactgactggattgattcatgttgcaagatggaagaggtcatggctggggcatacttaagagaactggagacccaatctccctggggtgccctccccaggcagcaatgccaggatgcctgtgtccacctccctccaccaggatggcagccaggagcggccggtgagcctgacctctaccacctcctcgtcgggctcctcctgtgacagtcgcagtgccatggaggagcccagcagctccgaggctcccgccaagaatggggcaggctccctgagaagccggcatctgcccaacagcaacaacaactccagcagctggttgaacgtgaaggggcccctctccccgttcaacagccgggcagcggcagggcctgcacaccacaagctcagctacctgggccgagtggtgcgggagatcgtggagacagagcgcatgtacgtacaggacctgcgcagcatcgtggaggactacctcttgaagatcattgacacacccgggctgctgaagccagaacaggtcagcgccctctttgggaacatagaaaatatctacgcgctgaacagccagctcctcagagacctggacagctgcaatagtga

SEQ ID NO: 5718 - DNA, 635 bp, Homo sapiens
ccatgctgtctcgggaggcggtgatagcagaatctccctggggtgccctccccaggcagcaatgccaggatgcctgtgtccacctccctccaccaggatggcagccaggagcggccggtgagcctgacctctaccacctcctcgtcgggctcctcctgtgacagtcgcagtgccatggaggagcccagcagctccgaggctcccgccaagaatggggcaggctccctgagaagccggcatctgcccaacagcaacaacaactccagcagctggttgaacgtgaaggggcccctctccccgttcaacagccgggcagcggcagggcctgcacaccacaagctcagctacctgggccgagtggtgcgggagatcgtggagacagagcgcatgtacgtacaggacctgcgcagcatcgtggaggactacctcttgaagatcattgacacacccgggctgctgaagccagaacaggtcagcgccctctttgggaacatagaaaatatctacgcgctgaacagccagctcctcagagacctggacagctgcaatagtgaccccgtggctgtggccagctgctttgtggaaaggagccaagagtttgatatctacactcagtattgcaacaattaccccaa

SEQ ID NO: 5719 - DNA, 11513 bp, Homo sapiens
cgggggaccccacttgtgtgcagcctagacgctggttcagggagtcgtacatggaagccttgcggaaccccatgcccctgggcagctctgaggaggccctcggggacctggcctgcagctccctgactggagccagcagggacctggggactggggcagtagccagtgggacccaggaggaaacctctggcccccggggagacccccaacagaccccaagtctagagaaggagaggcacacacccagccggacaggtccaggagctgcagggcggactcttcccaggagatctcggtcctgggaaagggcacccagaagctccagaggggcccaggctgcagcctgccacacctcccaccactcagcaggctccaggcctgggggccacctaggaggacaagctgtggggaccccaaactgtgtcccagtagagggtcccggctgcaccaaagaggaagacgttcttgcatcctcagcctgtgtcagcacagacggcggcagcctccattgccacaaccccagcgggccttccgatgtgcctgcccggcagccacaccccgagcaagaagggtggccacccggcacaggagacttccccagccaggtgcccaagcaggtgctggacgtcagtcaggagctgctgcagtccggggtcgtcaccctcccagggacccgagaccgtcatggcagagcagtggtgcaggtccgcaccaggagcctgctctggaccagggaacactcgtcctgtgctgagctgacccgcctgctgctgtacttccatagcatccccaggaaagaggtccgggacctggggctggttgtcctggtggatgcacgcaggagtccagctgcccctgccgtctcccaggccctctcaggattgcagaacaacacatctcctataattcatagtatcttgctgttggtagataaagaatctgcatttaggcctgacaaggatgcaataattcagtgtgaggtcgtgagctccctgaaggccgtgcacaaatttgttgacagctgccagctgaccgcagacctcgacggctcctttccctacagccatggtgactggatctgcttccgtcagaggctggaacacttcgctgcaaactgtgaagaagccatcattttcctacagaattcattctgctccctgaacacccacagaaccccaagaacagcccaggaagtcgccgagttaattgaccagcatgagacgatgatgaagcttgtcctggaagacccactgcttgtgtctctcaggctggaggggggcaccgtcctggcgcggctgaggagagaagagcttggcacagaagacagccgggacaccctggaggccgccacaagcctgtacgaccgagtggatgaggaggtgcacaggctggtcctcacctcgaacaatcgtctccagcagctggagcacctccgggagctggcgtcactcctggaagggaatgaccagcaatcctgccagaaaggactacagctggcgaaggagaacccgcaacgtacagaggaaatggtccaggatttcagaaggggcctgagcgccgtggtcagccaggctgagtgcagggagggagagctggccaggtggacccgctcgtccgagttgtgcgagacggtgagcagctggatggggcccctggacccggaggcttgtccctcctcacccgtggctgagtgtttgaggagctgtcaccaggaggctacctcggtggctgcagaggccttccccggggcaggtgtggcagtgctgaagcctcatgccctggggaaaccgtgggcatcacagcaagacctgtggctgcagtacccccagacccggctccgtctggaagaggccctttctgaggctgccccagaccccagcttaccgccccttgcccagagccccccaaagcatgagcgtgcccaggaggccatgaggaggcaccagaagccaccctcattccccagcacggacagtgggggtggtgcctgggaacctgcgcaaccactgtccggcctccctggacgagcgcttctgtgtggacaggacggggagaccctgcgcccagggctgtgtgctctgtgggacccactgtccctcctcaggggccttccaggggcaggggccaccacggcccacctggaggacagctctgcctgttcctctgagcccacccagaccctggccagccgccccaggaaacatccccagaagaaaatgataaagaaaacgcaaagtttcgagatacctcagcccgacagtggccccagggactcctgccagccagaccatactagtgtcttcagcaagggcctggaggtaaccagcactgtagccacagagaagaagctcccgctgtggcagcatgccaggagccccccggtcactcagagccggagtctgtcctccccctcggggctccaccctgctgaggaggatgggaggcagcaggtgggcagcagccgactgaggcacatcatggccgagatgatcgccacagagagggagtacattcggtgcttaggatacgtcattgacaactattttccagaaatggaaagaatggacttgccccagggccttcgagggaagcaccacgttattttcggcaacttggagaagctccacgacttccaccagcagcacttcctccgggagctggagcgctgccagcactgccccttggccgtgggccgcagtttcctgagacacgaagagcagtttgggatgtacgtgatctacagcaaaaacaagccgcagtcggatgccctgctcagcagccatggcaacgccttcttcaaggacaagcagcgggagctaggtgacaaaatggacctggcctcctacctgctgcggcccgtgcagcgtgtggccaagtacgcgctgctactccaggacctgctcaaggaggccagctgtggcctggcccaggggcaggagctgggcgagctccgagccgccgaggtcgtggtctgcttccagctgcgtcacggcaatgacctgctggccatggacgccatccgcggctgtgacgtgaatttgaaggaacaggggcagctgagatgccgggatgagtttatcgtttgctgcgggaggaagaagtatctgaggcatgtgttcctctttgaagacctcatcctgtttagcaagacccagaaggtggagggcagccacgacgtctacctgtacaagcagtccttcaagacggccgagatcgggatgacagagaacgtcggggacagtggcttgaggtttgagatttggtttcgcaggcggcggaaatctcaggacacctacattctccaagcaagctcggcagaggtcaagagtgcatggaccgatgtcatagggaggatcctgtggcggcaggcactaaagagcagagaactcagaatccaagaaatggcatccatgggtataggcaaccagccattcatggatgtcaagcccagagaccggacccctgactgtgcagtgataagcgaccgggctcccaaatgtgcagtgatgagcgaccgagtccccgacagcatcgtcaagggcacagagtcacaaatgagagggtccacagcggtgtcctcctctgaccacgccgcccccttcaagcgaccacactccaccatctcagacagcagcacctcctcttctagcagccagtcctcctccatcctggggtcgctgggcctgcttgtgtcctccagcccagcccacccgggcctatggagccctgcccacagcccctggtcatctgatatcagagcctgcgtcgaggaagatgagccagagccagaactagagacgggcacccaggctgcagtgtgtgagggggctcctgctgtgctgctgagccgcacacgccaggcctgatgactgtcagggtggcagtgcccatcatgtggctagaacaatacagagggagcagcacgccaggcctgatgactctgggggtggcggtgcccatcgcgtggctggaacgatccagagggaatagcacagcaggtgtccaggtatttcccaggattttagacattccctaacattttcaaacaaatttataattttgtcttatttaaaaaacaaaccttccacttccacccaagacaacagcataggaaacagacctaaaacaagacaaaaaaagactaaacatgaaacaaaagatgtcaagacacaagacatttggcaacaaaggaccgcgatccctgagagacaggaaaacgggaggtgagcccggtgatggcctcagacctccctccgccttgagagtttgcaggcctcagtgcagggaggggcccaggaagagcccagcagcctccgtgagttgaagagaccaagtcagcaggagttggcaggtcagagtgccagagagagatgcctgcatggggaaagactcaccagatcagcccctccagcacctagtgggttgctacccattcgcacactcaaacagggaggctaccaaggctgggagcaacctttgaaaagaccaaagatcaattcctggtactcatgtgggctggggacaggacccgttcccaccagccagactagggaaactctcaatagatcaattcctgatactcatgtgggctggggacaggacccactcccaccagccagactaggaaaactcccaatctgtgagcattaggtggagttctcagaaaatcttgcctcaggaatggggataattagccctagactgagccctgctcctgactcgcctacaaaatcataaaagcaagacctaaaatgatcaaaccattcccagataattcactttatcccagaacaaagctccagatgatctaggggttaccaaagtgtccacaccctgcaaggtaaactcacagtgcctgacctcggagtgccaggcgtgcagaggagcagccaagggcaaacactccaaggagagtcgcctggcaaagccaaccacccagagccagcgtctgtgctagaatcacagaattcaaactgtggctgaaatcgcagcccaggcgtccagaaagttaaagttaagaacctataatcccagcactttgggaggccgaggcaggcggatcacgaggtcaggagatcaagaccatcctggctaacatggtgaaaccccgcctactaaaaatacaaaaaattagccgggcatggtgttggccgcctgtagtcccagctacttgggaggctgaggcaggagaatggcatgaacccgggaggcggagtttgcagtgagctgagatcacgccactgcactccagcctgggcgacagagcaagactctgtctcacaaaaaaggttaagaaatgacttaatggaagagattcagaagacccagaccgaccttacagggatgagaaactacaatattgacagtggaaactatcctggatggggtaacagattggatttcacagaagagaccatgaggcaccttgaagacacatcagtggaaactatttgcatttgttgggcctccagagagacagaaccaataggagatagctagatatatatacagacagatagatagatagatagatcgatagatagatagatagatagatagatagatagatagactgacagacagatgagaggggccttaggggcattggctgacacaattttggcaggtcaagagccccacaataggccatccacaagctggagacccaaggaagctgctagtgtgcccagtccgagtcctaaagcctcagagccagggaagccagtggtgtaattctcagaggccaaaggcctgagaacctgggggccactggtataagtctgagtccatagacccagtgaactccaaacacaagagatacgagtgcacatcataatcaaattgcatataaccagtgataaacagaaaatcctaaaaccagtcagaggacaagggcatgttctgttgggaggcacaaagctgatgaggatggctgactcctcaggagcagcatgggtgagaggcagtggaatgtactaaggagaaaactgccaaattcacattctgtacctgacaaaatctttccgaagcgatggtgacataaagacattttcatacacacagaaactaagagtttcatccccagcagacctgcactacaagaaatgttaaatgatgtgcttcagggaaaagaaaaatgaagagcatgtgcaccatccaggattttcctcgttatttaaatccctttagcccatctcccatttgccccaaggaatgagtgctggcagtgagctgcactttttttttctctaaacgggaaatgggttaaaagatgagtggcttggccgggtgcggtggctcatgtctctaatcccagcactttgggaggctgaggccagaggatcacttgacttgagcccaggaactggggggtcatgctgggaaacatggcaagaccgcatctctattaaaaataaataaaagttaactgactgtttaaacaaaagtattaacgtatctgcggtttgtactatacgcacaggtaaactgtgtgaccacagcagcgtgatggctgggagacgctggatgtgatacgtgaagtgaggggtatcacttgaaggtagattgtggtaagctaaagatgtactgataaacccttgaaacacccactaacaaagaattacagctaatagaccaacagaggagataaaatggaatttttaaaaatccagtccaaaaatacgtagagaaagagggaaagggaagaatggacttgggggcgacacagaagacaagtggagagagactgaagcagccactggccatcacagcaaacacaagcagggcgcaggacgccggcaagccacagacaggcctgctctctgaattggtgaccacatgagtaacttcacgggtctgttctatgtccagagttgtcaaactgcatgctttaaagatgtgcagtggatcgtatgtcgcttaaatcccaacaaagcagtatttttttaaagtacaatcatgcacacagcacttcccctgggaggcaggggctgtgcccacagaagtcgttacctctgcgtcctgagtatggacagccaccatcacacagccccagaggccgcccaggctctagccacactctggcactgcctgggacaggtgccctcaggaacccaaatgccactgcccccgtgaaagccacttcaagcgtgttgcttcaaatcagaaggcatctacgcctgtggaagaggaggctgctgggggcccaggtgtgcagggggcagggccaggtgcaggggcacagcttatgcctgtggccaacccactggggagcaaggctggggatatgcccaggccagcagggccagcaggagtgactgcgccatcctgaacacgtccttgggcctcccaggaccttggtgcctcccatctgggctggcacaagcctccagtcaaaagatgggtctctctctcctgatagcatggagcctggatgtgggaatggagccacaccagccccacgggagccccacgacccatcgggctgtgggatgcatccccacggccgggacccctcagcctgtgacttggtctgggcagatgcaaaggccaccctgcagggctgaggtgtctgtggggaaggaggtgcccagccctgggaggccatcttgctcctgctttttatttaacccatggggctctttggcctcattttctgttttttgagtttctcgtgcactccaaactgtcctggagccagccctggtgtgaaacagaggcttcctgctggcagaagaggcccaccgagttacgtccacaccagctggccctgggcacctctctctctggccttctgtccacactgggatttggctctgatttccagaaggcagggttaggaaacacctgtttccaggcagagtaatgcttctgtctgaatcaggcctcatgggcttcaccagcagacacgaaggtttcatttagatggcgaacacgtgttctcatttctccagggttctggacccgtgagctgaagcaggtgctgagaagtgggagaggcggccactgggtccctcagggtcactcaccccgccacgtgaggccacttccgcccagcactgggggcgctgggagctgaggggcccacaggggacgtgggagacagccccgatgcgtccccatccgcagtgacgctagcgcggagtcgtcgccaagcacgtggagggacagccctggagccctggcctggcccagcatctcccagagtcacttcctgatgcctccccagccctgcccaggaagggtttgtggccacagccccacagcggccccctcgcctcgaccaccagtgcctccttccaagctgcctgagcaatcctgggtggtgagctccaccactcccacccacgcctcagcactgggaccccccagggatggtgtggggattcctgccccccgtccatgcctcagcactgggagctgggaaggtgtgtgatttcctcccccacctcagtactgggacccccaggaagggtgtgtggccccaccatcctgaatgctcagggctggtggtcagcgaggtggtttctaaaccaagccctgggaggagccatcctgggactgtgcttggacaaggttggggctcccgcagtgagctctagccctccccaggaccctcccacggccccagggtgccggccttcagattgaccccattcgtggatgagtctacaaggctccccagtgcccagcaagagtgtttttacattcagaggtgaggaaggggtgccggcatctgccccagacacaaccgggcaggtacagatgtcatccccttgaggacagcagggaggcgactcaggagaggctgatcagacgggagccgcatccccatcaccttccagagagacctcttcttttgccaggtgtcgtgagggctgtggcttagctgggcctgcgtccatccccggttctggggagatgcccgggcccctcctggatggcagcagcagtggaggtttgggttttgagggagccctaagaacctgagagacttagatggagcatggcacgccctggagagtccacgtccccagacccctcatgccaacaccattccacccagcagtttcttccctgtggtcagaacaaaacccccaagcctcaggcctcaggctggttttctgacaggcaaaatgctccttacataaggaaagacctttccttggctgaccctaaagtagccaaggggagctcacatcgcctggcctgccgccaccaccaggctgcctgaccagctcaccgccttgttctagatgcttctgaagcaacagctcgcctggccccacccccatcaagcatctgctgggcagcctccctccccggcccgcctgtagctcccaaaggtctcaagcctcaacatcctggtaaccaagtgcacccagagggctggcagggtcacatggaggcaggggacccttggccccagggtggtcgtcttcccaggaggtccgcctgtcaggtcagagggcagcaggaggccaccccacctccccgggttccctcgagcattcctttgtcaggagcagctcccccaggatccaggcatccctggcccccctttgcccccgccctgctctcaggagccccctgccaggtgctctgaccacaggaaacaggagccctcagggccactgccagaggacggattctgctgccaaccagaggtcctggggctggcggcgctggtgtgcctgccctgggccttcagcagcccccataaggagaaagctccagcctcccgttcagagaaggctccatcctggggacacgcctctcccaaggtcacccacgtgggggctttgttactcatgcttcccagactgcgtgctgtgtcagagttttcacacctgcctgatgtcctgggggggctcacagaggaccgaccctgcagggagatgctgacccaccctgagacccaggagaagaaaacggccagggtccaggctgctcccaccatccctgggggattagcaccttggctgagcccgaactgaccacctggggcgtaggtccaagatttaattacaaaacgataggtgaatgtgggttctgtgtgcctgtgacatagagaatgttttccacaccgcgtgtgaaatgacgagagcttttgtgtcacacatgtagctgctacgagacagacgctcttgttccggatcagagcagcagacagaaccggcacttttagggtccaaaccctgttgcccacagaacgcccatgacaccagctgggtggagctgccgccgagtccacgccccgtctggctgggacctggagctcccctcaagctgcagatccactctgcaccacaaggtggcctcgcagaggagcctcccgagctttggaaccagaggcaggctcagcgatgctctccatccggcctggccccaccgtgtgtatcaggtgtcagaggccttgctgggtgccaggccacgtctgtgctgtcacagctttgaggggccagcgggtcctagggagaggcccgtgcgacgtgagtaacagcagtttttcttctgacagctgggatggaggtgggtcctccagggagtgccccagtcctcgagagccagacttgtgcacgggcctggaaatgaaggtctcaggcaggggctgcgcacaccgatggtcagcattgccgttcggggcctgcagtcgcccataatgggccctgccccctaggcctggcctcttttgctttcctcctggatggttcctctacccctggtccagcagggactcagcagtgcctgccagctgcagacccccatgctcctgcagcctggaaccctcctgccctccaaaggtcatggggtgacccagggtgggaacaccagaccccctcaccccgtgtccaccgcccatggccgggctcacagtgtctcagagccgtggtgagccatcctaggaccagtgtacctcacaacctttcagaccagtgaaggccagtgggctgggtggtccaggcatgtccccaacgcaggtccagccatctctgcacagaactggaatctcggttcatttcggtttcagcaggtcccatgtagttagcaggacagcacttgagttaggtctgagaaagaacgcctgtttgtcatggcatttcctgtaaggagcccagagccgtggccccaggttgggacggcggcgccagagctgggcctgagtctgacccaacctgtgctgagtggtcctgctggaatgggaaccccaagaggaccacccctctctaaaagaagggaaaacagtaagcgagagggaggctgcaggggcccagaccttggctgaccttcctagccatggtctccaccctccgagacccaggggccccgcagtgacagcagggtgttgggccacacagagcccgagtaggtaaaggaaggttctggaaaccacttttcagaacccaaaaggtgtctgggaaatggcgttacctgccactgttgttaagtgtttactttgtatcaatactgaattgttaaaaattttaatcataaaaaccaatggaacatgtttt

SEQ ID NO: 5720 - DNA, 3584 bp, Homo sapiens
gaaaattaccagcttcaggggctatgacttctacggtcttaaggataagacctgggatgaagtcttggaaacacatcacaaactcccgaccgatcaattagacctgaaaaagcagcaagaggccgtgtgggaacttttcacaagtgaatgcacctattttttggaccatttattagttcttaagatgatctttatgaatacactaagatatctgcaaactcatgaatatctcctagatgtggatttatggagactttttgcaaacctggaggagttaactcagacaagccttggttttgtgaacagtctctttggcatcatcaaggactatgtagacgcttctgagatttcctcatcactggattttatttccgtgctcacaaagtatttccgagggagtctctgtcagagccaccagacctactgcctgaactattcagctgctatcttttatcttgagagcctgaggcagagagatgactttggaatttatttaaaatggtgtgagcagaatgaacaatgcagacggctccacgtgccagagctgctagtggccccactacagaggctcactcgatatccgttgttgctgaagaatatctggaaaaggagcatggactctgctgagaaaatcatgatctactccatcaaggaaaaggtggaaaagtccatccgggaccttgaaggaaaagtgaagtggctggacaatttccaaaaatttagatatctacaggagattatagtgtggccaccgctttgggatagagataaaaggtttttcattccagagtgtttgaaacacatttttaaagaacacatggcagaaaacatcttgtcaccaaccagcagacaccttctctatgaaggaaaattaactcttgcagaaagcacgagattcctagatgtttatctgtttctcttcaatgatttcctcttagttacgaaaactaagtgcaacaaaaagaaacttggaggctcagaccctggtttaatgtgtccttctcttactcctgagttgcaagcagtaataaaagagggtggttcgtgtacagtactcgatcagcctattccactagatagattggtagtcaaaagtattgaaccactccatgtgtcagtctttgggctgagaaatgcttttcttatacaacacgaaaacagatatcgacagtgtatagcagcattcttattacaagcccaaacggaaaacatcaaaaaaacatggatggcacaaataacaactgcaatttcttgctttaccaagagtcaggaaaccaagaaaatatctttattcacattgcccgcagaatcctctgaaatttagggacctaaaacaagtggcatgtctttttagaagattatggtttaaggtataatttcattcaaagttttgtaacacttagctagtgataagctagaaggaaatttgcattttaaagaagtttcagaatttgaaattttgagctaggaaaatcctcagtatagaggaataatgactgcaacaaatttgaactctgaggaatttcttgacaaatatatactgacatccagattaccttctaatgcttccgtcaggtttgtaagaggtgtgagtgaagaaaggtgctaatttgtaaagggtgaatgatcagataaatggagtatcagaaggaaaacaatgtccactgcttatgtccaatatgaactccagcatcttactctgtatccataaaataatgaaaccaattttccttcatggcctgtcaatcagtcttaaccgctttatagtcctacctcaaacataatgataaatctttagatacaaagcttgattgttcttttaatatacaaagcaataaatagggactacatttaagtagcagttttaaaattcctattctcaaactcatctcaggtatatagtactctaacgtggaagtagaaaatcccaaagactaaattccattactttaagataggaagaaaaaaaaaatctggctttcaccagttaacacttttgcatggcttttcttggcctgttgtgaagtgtacagattttcatagacatagtaaggtatctgtctcttaactttattttttgaagaatgatggtgtttgccataaaaatactttctggttttgattggtgtgtgtgtgtgtgtgtgtgtgtgttagcacagtacagtcacttaattttatttggcaggacttcaaatttcttcagaatttttatcatgaaaggcagtttgaataattattatcatggcaggatatatactattaactacattcaaggaactagttcttagggtcagattattgcatcaaagggaagtccacaaacttccatttcagaatcgtaccttttgcaatttgcaaagtgaaagtagtaaatttatcaaatttggctgcaagacaactgaagccttagctgattttgttaagctgaagaatggggtagagaggataatgtttgggcaagtcatgtgcccagtaattccttgaggaaggtgaaatttcactatgcaaacaaagcagtaaagacaagtgcagcagaaaggcttttgtacaaggcaagcactattagaatggagactaataacctctttataataatgtcagaaatttaatagaagaaaaaaaggaaaatctggaggacagtaactattgttaatagctaagaataaatgaggtggaggggagaaaaaggggagaatagacttcaagcttcaagtgaattcctagagatggcatctggatgggactgaaagcagttatgtccaggagaatacaatatagattatgcaagagaagattttataaagaaatttctggttaaaaaaaatttttacattaacaatcatcttgcaaatgtttagatataaactaacctcggaggtgagcagtggactaggatgaggtggcctctcaaattcctttagtcccatgaatccagcaaccacagacttacatgtataaaggtagttttctccctctgaatctcattaaagggagagacagactgactaaattaacaaaatatataaaacagctcaagaatatgctgtacataaactggaattctataaagctcacaaagtaacatgtctaatatacaatatattagatgtttgaggatatgcacattaaactctttggagggtttagaatgaagcacattcgaatgaagggatcacgggggtcagaacaaaaaccattctagaaccgtggctcccaggaagaaaaaatagcaaaaaacaatggcacattgggccttccaaaaagtatctttggggaggggagggagaaaaataaataaataaataaataaataatgttttaagtatctttaaatggtcatctgggtattaaatgcagacacacaatgaaataaggggttaattacatattttttatatttgtttttagttttgttaattctctacaatattaaatggaatgtctaaggcaaaatggcattaataatttctcttgagatcaggaatttaattactattcgaaattgaacaacattaaaacaccactgtctatatccaagtgcaaagtcctaatattctgtaaataaattaatgcaaaatggttaa

SEQ ID NO: 5721 - DNA, 6604 bp, Homo sapiens
gggactccggcgagagcgacgcaaggtcggctgcggcggcggcccgagggcgcccgtgtgcccagtgcgcggcggggacggccgcgagctcgctggagggctccccagaataatccagaagtcgattccatcatggcagaactcaaggtggaggcgccggccagcgtagactggcagaaacgctgcctgaccctggaaactcagcttttccggttccgcctacaggccagcaagataagggagctgctggctgacaagatgcaggagctggagcagaggctgctggaggcagagcagagagcagagaacgctgagacccaggtgggtgtcatggaagagaaggtaaaactatccaatctgaagaatgtggactctgaggggagcctgcaccggaaataccaagaattgctgaaagccataaagggcaaagatgagctcatcagccagctagaggctcagctggagaagcagaagcagatgagggcagaggaagcaaaaactgttcaagaaaaagctgcaaagatcaaggaatgggtgacactcaagttggcaaagcttgagatggagaatcagcatctgaaaagccataatcagcgcctggtggagcaggtgggatcccttcaagatgcgctagaagctattcagatagctccttcacggaagctgctggtgcccccctacggagctgcagagcaggattctgtcccttcagagccgggaatccagcctatgggccaggacagtggctcccaggcccagggtctgaaggcagctgtgcttgcaccttccccaggtgccctgcagagcaaggactctgtttctgaagcagcaagccccttggaggattctagttccagcacggtccattctggggaaacagtagaggccaagccccttcaacctcatctgggaagagagagccctccccaccagccatgcatgaagcttcttaccttcagatgtagttcagcttcctggggtgagggtctggttactgctcagagagggatgctccctgggacaaagacctctgccagggaaggtggtcctggcagcagtctgaccctaccaaaggtgcgggctcctggcaccccgcgggacagcatccagttggccaaaaggcaccacagccagccccaggtgggccatgggcactttggccgtgtggtgaacattgagactgaggccttctcagccctccacccctctggccttcctgagctggagtcccgagctaggtcccgggaggaaccagagaagatggagatggaggagccacccccagcagggaagaatgaggaaagagagagcccaaaggcccttggagctgagctggaggaagtggagctgggtaacaagccacctacacccccgctgcaccagttttcatcctgggagagccggatctatgctgtggccacatcgggcatgcggctctcagatatgtctcccagaagtaatactgcatgctgcgcttcaagccctcctgcccttgtttcccctgggtctttctctggcctggtctacaagaatgtcactgtgcctgtctacacagcactgaaggggagagctacacagatcagcaacatgccctttatggacgagtcctctgggtctgacgatgactgcagctctcaggcgagtttccgaatctcggtcccctcctctgagtccaggaagaccagcggactaggcagcccccgggccatcaagagaggcgtctccatgtcctcactgagctccgagggtgactacgccatccccccggacgcctgctcactggacagtgactactcagagcctgagcacaaactgcagcgcacctcatcctactccaccgacgggctgggcctgggcggggagtcactggagaagtcgggctacctgctgaaaatggggagccaggtgaagacgtggaagaggcgctggtttgtcctgagacagggacagattatgtactacaagtccccgagtgatgtcatccggaaacctcaaggccaagtggatctgaactcccgctgccaaattgttcgaggggagggttcacagacgtttcagctcatctctgagaagaaaacctactacctgacggccgattcacccagcctgctggaggagtggatccgagtactccagagcctgctgaaggtgcaggccaccgggcctccagctctgcttcggggtggcaccaagcccaccgtgaagggctggctgaccaaggtaaagcatggccactccaaggtggtctggtgcgctcttgttgggaaaatcttctactactatcggagccatgaggacaagcgacccctgggctgcctgcctgtgcgggatgcgcacatagaggaagtagatcgatcctgtgactcagacgaggactatgaggctggaggaaccagacggttgctttcctcccactgcaccctggtgatccaccccacagagcacagccccacctacctcctcattggcaccaagcatgaaaaggatacgtggctctaccacctcacagtggctgcaggtggcagcagtgccaaggtgggcactgcctatgagcagctcattggaaaactgatggatggtgaaggagatccagattcgccgctctggaggcaccccatgctgtgctacagcaaagacggcctatacgcctccctcaccaccctgccctctgaggccttgcagacggaggccctcaagctcttcaagtcctgccagctcttcatcaacgtgccggtggaagctgcctcggtggactaccatgtgtccctggcccagaccgcactgcaggtctgcctggttcaccccgagctgcagagtgagatctactgccaactcatgaagcagaccagctgccgcccacctcagaagtactccctcatgcagtgctggcagctcctcgctctgtgtgctccacttttcctgcctcagcatcacttcctctggtatgtcaagcagcagctccaacgccatgcagatcccagaagtgaaactggccagtatgccacctactgccagcgggcagtggagcggaccctgcggaccggggagcgggaagccaggccatcgcgcatggaagtggtgtccatcctgctgcgtaaccccttccaccactccttgcccttcagcatccccgtgcactttaccaacgggacttaccatgtggttggttttgacggctcttccacggttgatgagttcctccagcggctgaaccaggagataggcatgagaaagccatcccactctggctttgccctcttcacggacgatccctcgggcagggacctggagcactgcctgcagggaagtgtcaagatctgtgatgccatctccaagtgggaacaagccatgaaggagctgcaccccggaaagtctgagggtgggacacgcgtcgtgaagctgatgtacaagaacaggctgtactttcgcagtcaagtcaaaggggagacggaccgagaacggctgctccttgcctctcaaaccagtagagagatagtggcagggaggtttcctatcaacaaggaattggctcttgagatggctgccctgatggcccaggtagaatatggggacttggagaagcctgccctgccaggccctggaggcacatcccctgccaaggctcagcatcttctccagcaggtcctagacaggttccaccccaggcgctatagacatggggcccccgctgaacagctgaggcacctggcagatatgttgaccacaaaatgggcaacattgcaaggatgctcccctcctgagtgcatccgcatctacctgaccgtggccaggaaatggcctttctttggtgctaaactttttgctgctcagcctgcccagctgtcttccaaggagaacgctctggtgtggattgctgtgaatgaggatggcgtcagcatcctggaccacaacactatgcaagtgcacatcacttacccctactcttcagtgacaacgtttggtggctgcagggatgacttcatgcttgtgattagatctatcccagacaagagctctggaaaaagccacattgagaagttgatcttccggatggctgctcccaagattgcagaagctaccttcatcatggccagctatatgaaccattgcactacaactgtgaacccccccaccaacccacccggagcctgccagctgtgggaactggatggacgacagttcttttcttctgtttcctgtgctaccaaggggccaacgttgctgtgaatatttctcctacccgattccccaacaccactagtgcctctggatttagagatatatatcctagggtatgatactactgtgacgggtctaacagcccccggctactcttgttctgtgaaatgtgtattttagtctctgtgaagcctttactctctaggtgccttataatgtttcagggctcaactttttaaaatccagacccagtgttaaaaccatttattccttttttcataagaataatgactccagatgctacctgattctagacatagacagggatgatccactgttactgagggcatcagtgctataagttaaggctttctgcactggtactctcaaggaagctaattttctttctggggggggcgggggacacagtgtcactatgtcacccagtccacagggttcaagcaattctcctgcctcagccttcggagtggctgggattacaggtgtgcgccaccatgcccggctaatttttgtatttttagtagagacggggtttcaccatgttggccaggctggtctcgaactcctgacctcaggtgatctgcccactttggcctcccaaagtgctgggattacaggcatgagccatcgcccagcccagaagctaattttttaatattgtatatggtcttatttatacttgaagttttgtgaacgtcgctaaacaggataggactaaaatttccaattctcctacactctgtcagaagcctagaactcactaaactgggctgcctttcccaaatgggaaaggtgctgacagagttggagaaaaaagaatagactcatttttccccattattggtatgtaggcattggtacagccccttctggggcagtctttgcaggataacatgctatacctgctaagattcaagctgttttcctcacactggactttaggccaaacccagtaccacgcaatgtgcaagcaagggcaggaggtaggtccaatctgacccctccctgtctcattttaatgactggacagcgctcggtgaaggctgtgttcactgtagtgggccatcatttgtttccttcttcttgtaaaagaccaagcaaatgcactctgctttttgctgctgtaagaccaccaaaaatgagtcagaaacacagaagactatttcaggcatgtgggcctggatatgctccttgagacttctggcaaacttctgctgggaattagtttgagggtgagggtacatatgtgacatttgccctagcctaagagtagcaggtaaaaaaaagtttctttcatcttttgccttactgataataccataatccccctcaattcagaccttctgattgagtgcagaggagactagacagtctcctctagacaggttgtagacacaccctcccctaacaaaaacaaaacgaaagagttcatactctgattttccaacatctaggaaactgagttttatttcctagctctaaggcagccttactatatgtcagtaaagtgctgaaaactgtatatttagcagtagcacccaaaaccaagcctttaaccccaacaatgtgtgtatcttttgcacagcaaaaactgcgaggccagaactagtttatctgaacacctcagctgctgtaagcttctcctctctcaccccgtaaactgacaagcatgatgaaaaaagaagcacatccaagtttctgcctcttttaaatgtacttgactttgcaaggcaagtagttttacagccatttctgttcacacttttcaccccacaacttggggatctagctgagacatttctacctcgaacaagtcacatgtaccacaggttcctgaataattcctgcagggctggtgacagacataacagctctggttttataatatcttgggtatctctaaggccaataaggataacattatctacccagagagtttagaagaaaagtaggagtccaaaggaagagtaaacaagaatggagctgtgttcacactgaatttggggtcaatctatttcccccaccctctctcctccccaacccttcaggaaccctttagtttattaatcttatacagaagaaactaacttagaaacaaaggattcaatatttgcttatttattctttgttaacatgagagtcccatgtctgaaaaccaaagtccaatttctgtctggccttttgtctcatccttcttggcaaaagtagcttttgaactgatataaaaaaaaatgctgagtaacagaaaagtattaatgtgcttgacaccatgactgaaatactatgatcttgtttgtcaataaaaagcagctatctgtgaaccaggtaactgtgtgttttggaagatctgtttattaacagtaaataaataagccctgtacagaacacaggcactaggttgaca

SEQ ID NO: 5722 - DNA, 1820 bp, Homo sapiens
acttttcctgcctcagcatcacttcctctggtatgtcaagcagcagctccaacgccatgcagatcccagaagtgaaactggccagtatgccacctactgccagcgggcagtggagcggaccctgcggaccggggagcgggaagccaggccatcgcgcatggaagtggtgtccatcctgctgcgtaaccccttccaccactccttgcccttcagcatccccgtgcactttaccaacgggacttaccatgtggttggttttgacggctcttccacggttgatgagttcctccagcggctgaaccaggagataggcatgagaaagccatcccactctggctttgccctcttcacggacgatccctcgggcagggacctggagcactgcctgcagggaagtgtcaagatctgtgatgccatctccaagtgggaacaagccatgaaggagctgcaccccggaaagtctgagggctgtactttcgcagtcaagtcaaaggggagacggaccgagaacggctgctccttgcctctcaaaccagtagagagatagtggcagggaggtttcctatcaacaaggaattggctcttgagatggctgccctgatggcccaggtagaatatggggacttggagaagcctgccctgccaggccctggaggcacatcccctgccaaggctcagcatcttctccagcaggtcctagacaggttccaccccaggcgctatagacatggggcccccgctgaacagctgaggcacctggcagatatgttgaccacaaaatgggcaacattgcaaggatgctcccctcctgagtgcatccgcatctacctgaccgtggccaggaaatggcctttctttggtgctaaactttttgctgctcagcctgcccagctgtcttccaaggagaacgctctggtgtggattgctgtgaatgaggatggcgtcagcatcctggaccacaacactatgcaagtgcacatcacttacccctactcttcagtgacaacgtttggtggctgcagggatgacttcatgcttgtgattagatctatcccagacaagagctctggaaaaagccacattgagaagttgatcttccggatggctgctcccaagccccagcatcatgcagtcctcagttgggtgcttacgtgctcttctcttccttgcagcagtcctcaaggcagggcagattcctctttaagagctaaccagagcagaacactgggcctccttttctcagaagggcactgtgcatctgagaggatctccagaccaacaggagcccacaccactgggcctctgaacagcacagttatgattccctttggatattttctcccagattgcagaagctaccttcatcatggccagctatatgaaccattgcactacaactgtgaacccccccaccaacccacccggagcctgccagctgtgggaactggatggacgacagttcttttcttctgtttcctgtgctaccaaggggccaacgttgctgtgaatatttctcctacccgattccccaacaccactagtgcctctggatttagagatatatatcctagggtatgatactactgtgacgggtctaacagcccccggctactcttgttctgtgaaatgtgtattttagtctctgtgaagcctttactctctaggtgccttataatgtttcagggctcaactttttaaaatccagacccagtgttaaaaccatttattccttttttcataagaataatgactccagatgctacctgattctagacatagacagggatgatccactgttactgagggcatcagtgctataa

SEQ ID NO: 5723 - DNA, 3057 bp, Homo sapiens
ggggtcccagctctgtgctcgcgcccccagcgcgccagtcccggggctgcagggagcgcagcgcgcgcggcccgggccccggccaccggacgccctaccggacacgaccctccctggagcttggacaactgcccacctcggacgctgcaccggacactgccccccacagggctggacactccaacggacactacttcccagctccggacattgctccctcctctcccggggccctggacgcttttccccctcccccctccgggggcccagacactgagcccccctcagcgtctggctagcgtccccttgcaccccagcccaggacactgcctcctccctgtcctcttctcccttctgctcctcccacctcatctttcccctgctcgggtcggagccccgccagttcctccgaccccctactgctcggccgcggctgcccgcgcccccatccgcagctcctcgcccggatgcctctccccgggggactatggtggcttctctgctgccgtcgaggcttcactcttctgcaccgggactacggggacggcgagcttagcggggacggggacgaggacgaggacgaggaaacctttgagctgcggaccccgagtccagcgggcggcgggaggggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcgggaaaggggcgcggcgtctcgggagcctcgtgctcaccagcctgtgctcggtgaccggcccagagcgcaggcgtaaggagacaggtctgtggtcagtgactgtgtctggtcggaaacacagtgtccgcctctgctccccacgccaggcagaggctgagcgctggggggtggcattgcgggaagtgatcgcctccaaggcacccctggagacccccacccagctactgctcagggacatacaggaaagttgcggggacccagaggccgttgccctcatttacctgaggaacccgattctgagacacactagtggagccttgtatgccccactcctgcccctgccctatggagtcagcgccccaggtccgggctatgcacccctgcgcgaggaggcggtgcggctgttcttggcgctgcaggcgctggagggggcgcggcgccccgggcccttgatgcagggtgtgctccaaacctgccgggacttgcccgcgctccgggatgaactcttcctgcagctggctaagcagacctcgggccctgcaggtccccccgggctcccggctacccaagaccctgcggccctgcggtactggcaactcctcacctgcatgagctgcaccttccgacctgggggagctgtgcgggggcacctcctggggcacttggagaggaccgagcaggcactcccggactcggaactggcggaatatgcgcgcttcatccggaaagcgctgggccggacgcgcggcagagagctggtgccctcgctggcggagatttccgcgttgagccaacggcaggagctgctgtgtaccgtgcactgtccgggggctggtgcctgtgctgtggccatcgactcccacaccacggcgggggaggtggctcgagagctggtggggcggctgggcttggcccggagccgcaacgcattcgcgctgtacgagcagcgaggggcccaggagcgagccctggctggggggaccctcgtggccgacgtgctcaccaggtttgagaacttggccgcggaggaagctgggttggaggactcgcccgactccgggtggagactatgtctgcgtcttcacggacctctgcaccctgaggggctgtccccagacggtcacgaactgcctttcctctttgagcaggctcacgctctgctgctgcggggccggccgcccccacccgacgacacgctgcgcgccctggcggcgctgcgcctgcagagcctgcagcgggacttctctccgcgggtgcccctgccccgcctggaccgcctgctcccgcccccggccccgccgcgcgaagacccgccccgcccgacccccaggccgcccccttccgctgccctgctggccggggcgctctggagcccgggcctggccaagaggcgggcggagcgggcccggcgcggcggggccggccgcactgcgggaagcattgcccgcgagggaggaggcggcgccggcacggcagctgccgtgctgggcggctggaagcggctacggggcatgggccgagctgaggccatggccgcctacctggccctggcggcgcagtgtccggggttcggcgctgctcggtatgacgttctggagctgagcacggagcctggtcggggtgctccacagaagctgtgcctgggcttgggagccaaggccatgtccctctcccggccaggggagacggagcccatccacagtgtcagctatggccatgtggccgcctgccagctaatgggcccccacaccctggccttgagggtgggagagagccagctcctcctgcagagcccccaggtggaagagatcatgcagctggtgaatgcctacttggccaacccctcccccgagaggccctgcagcagctcttctcctccatgccaagacctgccagacacctcccctcccagccagcgcccgggcctggacgagccccagggacagtctggctgcttggggcagctgcaggactgagcctgccaagaggtcacgacttccctcctgcctgcagcctgggccaggactgctctgagatttgagggaaacatggacccttttggccctgcagggacagggcacatcccacacccaagggctacaatgggtgtgggtaattttctagtttgtttcttaatttatttgtagaagagaagcaaaaaaaaaaaaaaagtttcttatttac

SEQ ID NO: 5724 - DNA, 2526 bp, Homo sapiens
ggggtcccagctctgtgctcgcgcccccagcgcgccagtcccggggctgcagggagcgcagcgcgcgcggcccgggccccggccaccggacgccctaccggacacgaccctccctggagcttggacaactgcccacctcggacgctgcaccggacactgccccccacagggctggacactccaacggacactacttcccagctccggacattgctccctcctctcccggggccctggacgcttttccccctcccccctccgggggcccagacactgagcccccctcagcgtctggctagcgtccccttgcaccccagcccaggacactgcctcctccctgtcctcttctcccttctgctcctcccacctcatctttcccctgctcgggtcggagccccgccagttcctccgaccccctactgctcggccgcggctgcccgcgcccccatccgcagctcctcgcccggatgcctctccccgggggactatggtggcttctctgctgccgtcgaggcttcactcttctgcaccgggactacggggacggcgagcttagcggggacggggacgaggacgaggacgaggaaacctttgagctgcggaccccgagtccagcgggcggcgggaggggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcgggaaaggggcgcggcgtctcgggagcctcgtgctcaccagcctgtgctcggtgaccggcccagagcgcaggcgtaaggagacaggtctgtggtcagtgactgtgtctggtcggaaacacagtgtccgcctctgctccccacgccaggcagaggctgagcgctggggggtggcattgcgggaagtgatcgcctccaaggcacccctggagacccccacccagctactgctcagggacatacaggaaagttgcggggacccagaggccgttgccctcatttacctgaggaacccgattctgagacacactagtggagccttgtatgccccactcctgcccctgccctatggagtcagcgccccaggtccgggctatgcacccctgcgcgaggaggcggtgcggctgttcttggcgctgcaggcgctggagggggcgcggcgccccgggcccttgatgcagggtgtgctccaaacctgccgggacttgcccgcgctccgggatgaactcttcctgcagctggctaagcagacctcgggccctgcaggtccccccgggctcccggctacccaagaccctgcggccctgcggtactggcaactcctcacctgcatgagctgcaccttccgacctgggggagctgtgcgggggcacctcctggggcacttggagaggaccgagcaggcactcccggactcggaactggcggaatatgcgcgcttcatccggaaagcgctgggccggacgcgcggcagagagctggtgccctcgctggcggagatttccgcgttgagccaacggcaggagctgctgtgtaccgtgcactgtccgggggctggtgcctgtgctgtggccatcgactcccacaccacggcgggggaggtggctcgagagctggtggggcggctgggcttggcccggagccgcaacgcattcgcgctgtacgagcagcgaggggcccaggagcgagccctggctggggggaccctcgtggccgacgtgctcaccagcttggccgcggaggaagctgggttggaggactcgcccgactccgggtggagactatgtctgcgtcttcacggacctctgcaccctgaggggctgtccccagacggtcacgaactgcctttcctctttgagcagcctgactctgcctctctgtctgcaggagcctggtcgggctatggccatgtggccgcctgccagctaatgggcccccacaccctggccttgagggtgggagagagccagctcctcctgcagagcccccaggtggaagagatcatgcagctggtgaatgcctacttggccaacccctcccccgagaggccctgcagcagctcttctcctccatgccaagacctgccagacacctcccctcccagccagcgcccgggcctggacgagccccagggacagtctggctgcttggggcagctgcaggactgagcctgccaagaggtcacgacttccctcctgcctgcagcctgggccaggactgctctgagatttgagggaaacatggacccttttggccctgcagggacagggcacatcccacacccaagggctacaatgggtgtgggtaattttctagtttgtttcttaatttatttgtagaagagaagcaaaaaaaaaaaaaaagtttcttatttac

SEQ ID NO: 5725 - DNA, 2406 bp, Homo sapiens
tccttccgcctccgccagcgccgaggaatgtggcgaggccggctgggcggctcgaacgcctgggtccccctccgctcccagttcgcaagtgcggaggccagatgcgagagctcccgctgcggagacctggacgagggggagaagtcatcccaggattggggtctgtggcggggaccccaaggagagggagggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcgggaaaggggcgcggcgtctcgggagcctcgtgctcaccagcctgtgctcggtgaccggcccagagcgcaggcgtaaggagacaggtctgtggtcagtgactgtgtctggtcggaaacacagtgtccgcctctgctccccacgccaggcagaggctgagcgctggggggtggcattgcgggaagtgatcgcctccaaggcacccctggagacccccacccagctactgctcagggacatacaggaaagttgcggggacccagaggccgttgccctcatttacctgaggaacccgattctgagacacactagtggagccttgtatgccccactcctgcccctgccctatggagtcagcgccccaggtccccccgggctcccggctacccaagaccctgcggccctgcggtactggcaactcctcacctgcatgagctgcaccttccgacctgggggagctgtgcgggggcacctcctggggcacttggagaggaccgagcaggcactcccggactcggaactggcggaatatgcgcgcttcatccggaaagcgctgggccggacgcgcggcagagagctggtgccctcgctggcggagatttccgcgttgagccaacggcaggagctgctgtgtaccgtgcactgtccgggggctggtgcctgtgctgtggccatcgactcccacaccacggcgggggaggtggctcgagagctggtggggcggctgggcttggcccggagccgcaacgcattcgcgctgtacgagcagcgaggggcccaggagcgagccctggctggggggaccctcgtggccgacgtgctcaccagcttggccgcggaggaagctgggttggaggactcgcccgactccgggtggagactatgtctgcgtcttcacggacctctgcaccctgaggggctgtccccagacggtcacgaactgcctttcctctttgagcaggctcacgctctgctgctgcggggccggccgcccccacccgacgacacgctgcgcgccctggcggcgctgcgcctgcagagcctgcagcgggacttctctccgcgggtgcccctgccccgcctggaccgcctgctcccgcccccggccccgccgcgcgaagacccgccccgcccgacccccaggccgcccccttccgctgccctgctggccggggcgctctggagcccgggcctggccaagaggcgggcggagcgggcccggcgcggcggggccggccgcactgcgggaagcattgcccgcgagggaggaggcggcgccggcacggcagctgccgtgctgggcggctggaagcggctacggggcatgggccgagctgaggccatggccgcctacctggccctggcggcgcagtgtccggggttcggcgctgctcggagcctggtcggggtgctccacagaagctgtgcctgggcttgggagccaaggccatgtccctctcccggccaggggagacggagcccatccacagtgtcagctatggccatgtggccgcctgccagctaatgggcccccacaccctggccttgagggtgggagagagccagctcctcctgcagagcccccaggtggaagagatcatgcagctggtgaatgcctacttggccaacccctcccccgagaggccctgcagcagctcttctcctccatgccaagacctgccagacacctcccctcccagccagcgcccgggcctggacgagccccagggacagtctggctgcttggggcagctgcaggactgagcctgccaagaggtcacgacttccctcctgcctgcagcctgggccaggactgctctgagatttgagggaaacatggacccttttggccctgcagggacagggcacatcccacacccaagggctacaatgggtgtgggtaattttctagtttgtttcttaatttatttgtagaagagaagcaaaaaaaaaaaaaaagtttcttatttacac

SEQ ID NO: 5726 - DNA, 1206 bp, Homo sapiens
ggcgccggccccagcctgagcggggacggcggccgggagggcgcggcccgggttcccgttccccgcggagccatgcggtacaacgagaaggagctgcaggctctgtcccggcagccggccgagatggcggccgagctgggcatgaggggccccaagaagggcagcgtgctgaagcggcggctggtgaagctggtggtgaatttcctcttctactttcggacagacgaggccgagcccgtcggagccctgctgctggagcgctgcagagtcgtccgggaagagcccggcaccttctccatcagcttcattgaggaccctgagaggaagtatcactttgagtgcagcagcgaggagcagtgtcaggagtggatggaggctctgcgtcgggccagctacgagttcatgcggagaagcctcatcttctacaggaacgaaatccggaaggtgacgggcaaggaccccctggaacagttcggcatatccgaggaggccaggttccagctgagtggcttgcaggcgtgagcgcagggcacggtggtcagcgtgcagcgggacgggactggccctgcccagccatgaatcgcttggccatgcctggatctgttttgttttggtttttggtttttgggtcagggtttcactgtgttgcccaggctagagtgcagtggtgccacagctcactgtgaccttgaccttctggactcaagtgatcctcctgcctcagcttcccaagtagcggggatcacaggcatgagccgccacacccggccatcacacctggattttcagtgggaggtttttggtttggagacatccaaagcctgaagccaggtgggtgtgggcaggggctgcattttatgaaactgcccagcaagctgcgctccctggggccccaggatccacctaactggcctggcacctggtgccacgtgctgctgccgccaggatatgcgccttcccacaggtgccctgcctgagttgtgtgcatccaggggcctggtgagcccccaggctggtggcatggcccccctgccccgtgctgaatgaatgtacagagccagacaaagctgtgaatggcctaggggctgagtcccacaccagctgtgaattctcctgcagacaggagggccctggctgtgcacctggggaagtggttgccctggggccagggtgcttgttctgttcaaataaaggtacctcttttcc

SEQ ID NO: 5727 - DNA, 4004 bp, Homo sapiens
aggcgaggcgagggccgggcggcgggcgccgggccccgcggccggcacgacggagcccccgtacggccggcggcagcggttggcggcggcccccggcccccggcgcgggaagcggcggcggggcggcggcggcggtggcggtggcggtggcggcgacggtggcagcgccatggagccgggggaggtgaaggaccggatcctggagaacatctcgctgtcggtgaagaagttgcagagctattttgctgcatgtgaggatgagatccctgccatccggaaccatgacaaggtcctacagcgtctgtgtgagcacctggaccacgccctgctgtacggactgcaagacctctcctctggctactgggtgctcgtggtgcattttactcggagagaggccatcaagcagatcgaggtgctgcagcacgtggccaccaacctggggcgcagccgtgcctggctgtacctggccctcaacgagaactccttggagagctacctgcggttgttccaggagaacctgggcctgctgcataagtactacgtcaagaatgccctggtctgcagccacgatcacctgacgctcttcctgaccttggtgtccgggctagagttcattcgtttcgagctggatctggatgccccttacctagacctggccccctacatgcccgactactacaaacctcagtacctgctggactttgaagaccgccttcccagctcggtccacggctcagacagtctgtccctcaactctttcaactccgtcacctccaccaacctggagtgggatgacagtgcgattgccccatctagtgaggatggagacctcacagacacggtcagtggtccccgctccacagcctccgacctgaccagcagcaaggcctccaccaggagccccacccagcgccagaaccccttcaacgaggagccggcagagactgtgtcctcctctgacaccacccccgtgcacaccacctctcaggagaaggaggaggcccaggccctggacccgccggatgcctgcacggagctcgaggtcatcagggtcaccaagaagaagaaaattggcaagaagaaaaagagcagatcagatgaggaggcaagtccactccaccccgcctgcagccagaagaaatgtgccaagcagggggacggtgacagccgcaacggcagcccaagccttgggcgggactcgccagacactatgcttgcctccccccaggaggagggagaggggccgagcagcaccacggagagcagcgagcgctccgagccgggcctgctgatccctgagatgaaggacacctccatggagcgcttggggcagcccctgagcaaggttatcgaccagctcaacgggcagctggaccccagcacctggtgctcccgtgctgagcccccagaccagtcctttcggaccggctctcccggggatgccccggagaggccgccgctttgcgactttagtgaggggctttcagccccaatggacttctaccgctttaccgtcgagagtccaagcactgttacatcaggtggcggccaccatgaccctgcagggcttggccaaccgctgcatgttcctagtagccctgaggctgctggccaagaagaagagggaggaggaggagagggacagacgcctcggcccctagaggataccacgagggaggctcaggagctggaggcccagctgtccctggtcagggaggggcctgtgtctgagccagagcctgggacccaggaggttctctgccagctcaagcgagaccagcccagcccgtgtctgagtagcgctgaggattctggggtggatgagggacaggggagcccttcggagatggtccattcctcggagttcagagtagacaacaatcacctgctcctgctcatgatccacgtgttccgagaaaacgaagagcagctgttcaaaatgatccggatgagcaccgggcacatggagggcaacctgcagctgctgtacgtgctgctcacagactgctatgtctacctgctccggaaaggggccacagagaagccatacctggtggaagaggccgtttcttacaatgaacttgactatgtgtcggttggccttgaccagcagacggtgaagctggtgtgcaccaaccgcaggaagcagtttctgctggacacggctgatgtggcgctggctgagttctttttggcttctttgaagtcagccatgatcaaaggctgtcgagaacctccctaccccagcatcctgacggatgccaccatggagaagctggcactggccaaatttgtggcccaagaatcgaagtgtgaggcatctgctgtcaccgtgcgcttctacggccttgtgcactgggaggaccccacagacgagtccctgggccccacgccctgccactgctcaccccccgagggcaccatcaccaaagaaggcatgctgcactacaaggcgggcacctcctacctgggcaaggaacactggaagacgtgcttcgtggtgctcagcaacgggatcctctaccagtacccggaccgcaccgacgtcatccctctgctctcggtgaacatggggggggagcagtgcggtggctgccggagagccaacaccacggatcggccccacgccttccaggtcattctctccgaccggccctgcctggagctaagtgccgagagcgaggccgagatggccgagtggatgcagcatctctgccaggctgtgtccaaaggggtcatcccccagggcgtagctcccagcccctgcataccctgctgcctggtcctcacggatgaccgcctctttacgtgccatgaggattgccagaccagcttcttccgctctttgggcacagccaagctgggcgacatcagcgccgtctccaccgagccgggcaaggagtactgcgtcttggagttctcccaggacagccagcagctcctcccgccctgggtcatctacctgagctgcacttctgaactggaccgattgctgtctgcactgaactctgggtggaaaaccatctatcaggtggacctcccccacacggcgatccaggaagcctccaacaagaagaaattcgaggatgccttgagcctcatccacagcgcctggcagcggagcgacagtctctgccgcggccgagcctcccgagacccctggtgctgaggcagagctggttggcgtccctggtgggcaggaaaggaaggcacgccagccggcaggcacactgtcacggctgttgtcatgctgtcgggagcctacagtccacccctgccctgggcggcagaaccaccgagtgtggcttaagacagggtccctccactccagggatccagatcaggtgcccggcacccctgggcatcctgcccgacaggtagcgaatggaggtcgctgggggcagagggtccgagccctgtgggctctgcggatgcacgccctcctcccgggcctccgcctcagtctgcagaatttctgccgagtggcaccgagaacaccatccatctaaggacgaacaaaagaaccaggagggcgggacccccctcttcctctcctgggttgggggctggggccctgagtgcccagccatccttgttcgtgtttgaacactctcctggccacgtggggaagcgggaacacggggtgtctgcgcatgtttcctcctcctagctccatcactgcgcacacagctgcctgcctcgccagatgcaggggggcgggcagccctccctggctgccaggaggctctgcatgcccacagtcctgccctgcctgtcccctcaacccggcagtgcctgtagcaccgaggagcaaagggggtggatggggggcttggagaagggcggagcccaccagcctggcatccatgttgacatcttctgactgtcccctgcttggctggagccaggcccttccctagagtttcgtcaagagcctcctggggaaggggtcaggtggtttgggttttgttttttaaaataaaatagacatgttatattgccaa

SEQ ID NO: 5728 - DNA, 2644 bp, Homo sapiens
agcatttcagagtgggaccgcgagaagccgcttgtaaacagagccgggccgggatggtcagcgcccgggcgggctgtcaccgtgaggcgggcggcaggctgcgggagtcaagcccctccaggagcggactgaaggccccgcaggtgaatggagagtagcagccggggcccaggaaatcaaggattggcgtggcattgctttgacaagtacttgctgttgtcttcacagaggtctcactgaagaataatctcaaaggaacatttggtctccctatacatctgttaatgcccattagccactagcaaatgcttttaattaccaggaaaacatcaaccactttgggtttggcctgctccagggagcccaatgaaggtttcttccagttgtttccatagctctattgctgaagcacccctcttggttgggtgaatgttcatgaagccatttctggaaccagcttaggaggctaaggcctcctggagcctgtgacatggaagctttggaagtggatgatatcagcccagccttagaagttacggaggaattctttagtactttggatagtaatctagaaaaggctgtgcagcaggcagaggtttatgggatccaggaagtccctgaactggtggggcatgaggtactcagtaacataacagacaatggtgctatgagaaatgtcacctccctgggcaaggggggcatgatttgggaccactgtaagagcaggctcttagaaaccaaagctcaaaatgtcttccctgccaaagaacagtttatggtccagagagggacaaccccagataatctttcctggatggaacaaaaggaagcatcaacctttaatttcttcaatatctgtcagcgtcggagggaccggcctcgttctgtaaatgacttactggatgagacctcaactttcaagccagggcatgctcgatcacgatcagatattacccaagtggactggagggtagtcctcaaaaccacgcctttgcagcagcagcaacagcagcagccattgcttcaaggcccgcatgtcaccaggccatcttttctgttgccctcaccaaataagatagaagatgctcaaggaaatactgaacacaagcagacattcccaaacattctaaagaagggttacctggagattagaaaggaccatgacagttactggcaaagctgttatgcagaactttcaccttacaacttatacttctacagcctcgacagcagtgggaatcaaaacctttatgccacgtaccagctttcacacttccagagcatatctgttttaggcaacctggaggccaggatggtggatactgttttgtatgacaacactcagctacagctaaaggcagagtcaccatgggaggctttggactggggacagaagctttgggaagtagtgcatgctgctgtgcccggttacatggggcggcagaatgagctgacaatctcaccagggcttggccatcatgatgactatacacagaatcatagtttccagaagaaaaccagtgggctgctgccaccgtcccctgtcctggacagctccaaacagtaccaaaacatcctcaaatcagggactctctacaggctgactgtccaaaacaactggaaggcatttacatttgtgctgagcagggcttaccttatggcttttcagcctggcaagctagacgaggatccactgttgagctacaacgtggacgtgtgtctggctgtccagatggacaacctggatggctgcgactcttgctttcaagtcattttcccccaggatgtccttcgcctccgagctgagacccgacagagggctcaggaatggatggaggctctgaagatagctgccaatgtggcgaggagttcagagcaaaacctgcaagtcacactgaggaacaaacccaaggatcaaatgggtgggcatgaactcaggaagaacaaacgccaatctgtgactaccagcttcctgagcattttgacgactttgtctttggaacgaggactcactgctcagagtttcaaatgtgcaggctgccagcgatccataggtctttccaatgggaaagccaaggtgtgcaactacagtgggtggtattactgcagtagctgccacgtggatgacagctttctcattccagcacgcatagtccacaactgggatacttcaaagtataaggtgtcgaagcaggccaaggagtttctggagtacgtgtacgaagagccgctcatcgacatccagcaggagaacgccatgctgtaccaccacgcagagccgctggccgccgtgctgcggctgcggcagcggctgaagtcgctccgagcctatttgttcagctgccgggcagcggtggcagaggatctccgccgcagaattttccccagagaatacctccttcaacagatccacctgtattcacttgccgacctgcagcaggtaatagagggaaagctggctccattcttgggcaaggtcattaaatttgccacctcacacgtgtacagctgcagtctttgtagccagaaggggttcatctgtgaaatctgtaacaatggagagatcctctacccttttgaggatatttcaacaagcagattcggagacccatatgcagatttattacaaggatatgtggcctga

SEQ ID NO: 5729 - DNA, 2792 bp, Homo sapiens
agcatttcagagtgggaccgcgagaagccgcttgtaaacagagccgggccgggatggtcagcgcccgggcgggctgtcaccgtgaggcgggcggcaggctgcgggagtcaagcccctccaggagcggactgaaggccccgcaggtgaatggagagtagcagccggggcccaggaaatcaaggattggcgtggcattgctttgacaagtacttgctgttgtcttcacagaggtctcactgaagaataatctcaaaggaacatttggtctccctatacatctgttaatgcccattagccactagcaaatgcttttaattaccaggaaaacatcaaccactttgggtttggcctgctccagggagcccaatgaaggtttcttccagttgtttccatagctctattgctgaagcacccctcttggttgggtgaatgttcatgaagccatttctggaaccagcttaggaggctaaggcctcctggagcctgtgacatggaagctttggaagtggatgatatcagcccagccttagaagttacggaggaattctttagtactttggatagtaatctagaaaaggctgtgcagcaggcagaggtttatgggatccaggaagtccctgaactggtggggcatgaggtactcagtaacataacagacaatggtgctatgagaaatgtcacctccctgggcaaggggggcatgatttgggaccactgtaagagcaggctcttagaaaccaaagctcaaaatgtcttccctgccaaagaacagtttatggtccagagagggacaaccccagataatctttcctggatggaacaaaaggaagcatcaacctttaatttcttcaatatctgtcagcgtcggagggaccggcctcgttctgtaaatgacttactggatgagacctcaactttcaagccagggcatgctcgatcacgatcagatattacccaagtggactggagggtagtcctcaaaaccacgcctttgcagcagcagcaacagcagcagccattgcttcaaggcccgcatgtcaccaggccatcttttctgttgccctcaccaaataagatagaagatgctcaaggaaatactgaacacaagcagacattcccaaacattctaaagaagggttacctggagattagaaaggaccatgacagttactggcaaagctgttatgcagaactttcaccttacaacttatacttctacagcctcgacagcagtgggaatcaaaacctttatgccacgtaccagctttcacacttccagagcatatctgttttaggcaacctggaggccaggatggtggatactgttttgtatgacaacactcagctacagctaaaggcagagtcaccatgggaggctttggactggggacagaagctttgggaagtagtgcatgctgctgtgcccggttacatggggcggcagaatgagctgacaatctcaccagggcttggccatcatgatgactatacacagaatcatagtttccagaagaaaaccagtgggctgctgccaccgtcccctgtcctggacagctccaaacagtaccaaaacatcctcaaatcagggactctctacaggctgactgtccaaaacaactggaaggcatttacatttgtgctgagcagggcttaccttatggcttttcagcctggcaagctagacgaggatccactgttgagctacaacgtggacgtgtgtctggctgtccagatggacaacctggatggctgcgactcttgctttcaagtcattttcccccaggatgtccttcgcctccgagctgagacccgacagagggctcaggaatggatggaggctctgaagatagctgccaatgtggcgaggagttcagagcaaaacctgcaagtcacactgaggaacaaacccaaggatcaaatgggtgggcatgaactcaggaagaacaaacgccaatctgtgactaccagcttcctgagcattttgacgactttgtctttggaacgaggactcactgctcagagtttcaaatgtgcaggctgccagcgatccataggtctttccaatgggaaagccaaggtgtgcaactacagtgggtggtattactgcagtagctgccacgtggatgacagctttctcattccagcacgcatagtccacaactgggatacttcaaagtataaggtgtcgaagcaggccaaggagtttctggagtacgtgtacgaagagccgctcatcgacatccagcaggagaacgccatgctgtaccaccacgcagagccgctggccgccgtgctgcggctgcggcagcggctgaagtcgctccgagcctatttgttcagctgccgggcagcggtggcagaggatctccgccgcagaattttccccagagaatacctccttcaacagatccacctgtattcacttgccgacctgcagcaggtaatagagggaaagctggctccattcttgggcaaggtcattaaatttgccacctcacacgtgtacagctgcagtctttgtagccagaaggggttcatctgtgaaatctgtaacaatggagagatcctctacccttttgaggatatttcaacaagcaggtgtgaaagctgtggagccgttttccattctgaatgcaaagaaaagtctgtcccctgcccgaggtgtgttcgccgagagctgcagaagaagcagaagtctttctggcagagactgaacatggacgagagtctagaggaggcttgcaccatgttcgagctgtcctaccagaacacctgactccagccgacccgaa

SEQ ID NO: 5730 - DNA, 1915 bp, Homo sapiens
gaatcaaaacctttatgccacgtaccagctttcacacttccagagcatatctgttttaggcaacctggaggccaggatggtggatactgttttgtatgacaacactcagctacagctaaaggcagagtcaccatgggaggctttggactggggacagaagctttgggaagtagtgcatgctgctgtgcccggttacatggggcggcagaatgagctgacaatctcaccagggcttggccatcatgatgactatacacagaatcatagtttccagaagaaaaccagtgggctgctgccaccgtcccctgtcctggacagctccaaacagtaccaaaacatcctcaaatcagggactctctacaggctgactgtccaaaacaactggaaggcatttacatttgtgctgagcagggcttaccttatggcttttcagcctggcaagctagacgaggatccactgttgagctacaacgtggacgtgtgtctggctgtccagatggacaacctggatggctgcgactcttgctttcaagtcattttcccccaggatgtccttcgcctccgagctgagacccgacagagggctcaggaatggatggaggctctgaagatagctgccaatgtggcgaggagttcagagcaaaacctgcaagtcacactgaggaacaaacccaaggatcaaatgggtgggcatgaactcaggaagaacaaacgccaatctgtgactaccagcttcctgagcattttgacgactttgtctttggaacgaggactcactgctcagagtttcaaatgtgcaggctgccagcgatccataggtctttccaatgggaaagccaaggtgtgcaactacagtgggtggtattactgcagtagctgccacgtggatgacagctttctcattccagcacgcatagtccacaactgggatacttcaaagtataaggtgtcgaagcaggccaaggagtttctggagtacgtgtacgaagagccgctcatcgacatccagcaggagaacgccatgctgtaccaccacgcagagccgctggccgccgtgctgcggctgcggcagcggctgaagtcgctccgagcctatttgttcagctgccgggcagcggtggcagaggatctccgccgcagaattttccccagagaatacctccttcaacagatccacctgtattcacttgccgacctgcagcaggtaatagagggaaagctggctccattcttgggcaaggtcattaaatttgccacctcacacgtgtacagctgcagtctttgtagccagaaggggttcatctgtgaaatctgtaacaatggagagatcctctacccttttgaggatatttcaacaagcagattcggagacccatatgcagatttattacaaggatatgtggcctgatgctgagatggagtttcactcttgttggccaggctggggtgcaatggcgcgacctcagctcactgcaacctctgcctcctgggttcaagcgattctcctgtctcagcctccggtgtatctgggattacaggcacccaccaccatgccccactagtttttttgtgtttttagtagagactgggtttcatcatgttggccaggctggtgtcaaactcctaacctcaggtgatcctcccccgcctcggcctcccagagtgctgggattacaggcgtgagccactgcacccagcctcaaacacaaattaaatacatacctctctttaacctaaatagaaaaaccgtaaagcccagattgcaagatttttaaatacaataagaatatcctgaattataaaactgctttgctaaagcctaatccaggatttatcctcctagaggactacaaggaaagcacagccttgggagagataaacattttgacaaaacaatgataaaattccacatcct

SEQ ID NO: 5731 - DNA, 2287 bp, Homo sapiens
gggacccagacttgccgacctgtacgactctggccatggggaacagccactgtgtccctcaggcccccaggaggctccgggcctccttctccagaaagccctcgctgaagggaaacagagaggacagcgcgcggatgtcggccggcctgccgggccccgaggctgctcgaagcggggacgccgccgccaacaagctcttccactacatcccgggcacggacatcctggacctggagaaccagcgagaaaacctggagcagccattcctgagtgtgttcaagaaggggcggcggagggtgcctgtgaggaacctgggaaaagttgtgcattacgccaaggtccagctgcggttccagcacagccaggatgtcagcgactgctacctggagctattccccgcccacctgtacttccaggcccacggctcggaaggactcacatttcaggggctgttaccgctgacggagctgagtgtctgcccgctcgaggggtcccgagagcacgccttccagatcacaggcccactgcccgcacccctcctggtgctctgccccagccgggccgagctggaccgctggctttaccacctggagaagcagacggccctcctcggggggccgcggcgctgccactcggcacccccacaggggtcctgcggagacgaactcccctggactttgcagcgccgtctaacccggctgcggacggcgtcagggcacgaacccggcggcagtgctgtctgtgcctcgagggtcaagctgcagcacctgcccgcacaggagcagtgggaccggctcttggtcctgtacccaacgtccttggccattttctccgaggagctggacgggctttgcttcaagggggagctcccactccgtgccgtccacatcaacctggaggagaaggagaagcagatccgctccttcctgattgaaggccccctcatcaacaccatccgcgtggtgtgcgccagctacgaggactacggtcactggctgctgtgccttcgcgctgtcacccacagggagggggccccgccgctgcctggtgccgagagcttcccagggtcgcaggttatgggcagtggccgaggctcactctcctcaggcggacagaccagctgggactcggggtgcttggcgcccccctccacccgcaccagccactccctgcctgagtcctcagtgccatccaccgtgggctgctcctcccagcacacaccgctgcacaggctgagcctggagagcagcccagatgcccctgaccacacttcggaaacatcacactcgcccctctatgccgacccctacacaccacccgccacctcccaccgcagggtcacagatgtccggggcctggaggagttcctcagtgccatgcagagtgcacgtggacccacgccctcgagcccactcccctcggtgcctgtgtctgtgcctgcctctgaccctcgctcctgctcctccggccccgctggcccctacttgctctccaagaagggagccctgcagtccagagccgctcagagacaccggggctcagccaaggatggggggccgcagcccccagacgcccctcagcttgtctcctctgccagggaaggttcgcccgaaccctggctgcctctgacagatggtcggtcccccaggaggagccgggaccccggctacgaccacctctgggacgagactttgtcttcctcccaccagaagtgcccccagcttggagggcctgaggccagtggggggcttgtgcagtggatctgatggccgcggtgaggtgggttctcaggaccaccctcgccaagctccagggtacctgcccctctaacccacttcaaattacaagtcagggtctgaacccagtgtgatggggggagtctctggggccctgagttcagagcccgtccctcagctcctgttccttggtgccagcagctggggcagggaagggtgggaggggccccatccaaaggatgccctggccagcgaggctgggtcacaggtcagggaggtcctggccgtccacagggtcggccctcagctcagcccgccaggagtcagggaggagactcgctgggagtgggagggcagcacgggcgtgaaggtcggaggacagagaaaggtcagcagggtcagagtatgtgaggtcagagggcatgagggtcacaggtcagcaaggtgtgaggagcacaagccagggtgccccgaggaggagggtgggtgggtccttgtgtggcctggcgcgcaccacagggcagcacgggagacgttgacaccaccggacg

SEQ ID NO: 5732 - DNA, 2455 bp, Homo sapiens
ccagacttgccgacctgtacgactctggccatggggaacagccactgtgtccctcaggcccccaggaggctccgggcctccttctccagaaagccctcgctgaagggaaacagagaggacagcgcgcggatgtcggccggcctgccgggccccgaggctgctcgaagcggggacgccgccgccaacaagctcttccactacatcccgggcacggacatcctggacctggagaaccagcgagaaaacctggagcagccattcctgagtgtgttcaagaaggggcggcggagggtgcctgtgaggaacctgggaaaagttgtgcattacgccaaggtccagctgcggttccagcacagccaggatgtcagcgactgctacctggagctattccccgcccacctgtacttccaggcccacggctcggaaggactcacatttcaggggctgttaccgctgacggagctgagtgtctgcccgctcgaggggtcccgagagcacgccttccagatcacaggtgtttgggatgcttcccgggcccccagaggcactcctgacccaggacttggagaggggcctgccctgtggctgcggagcacgtgtgtgtatgtgtgtgccctctctgccctgcccgcaggcccactgcccgcacccctcctggtgctctgccccagccgggccgagctggaccgctggctttaccacctggagaagcagacggccctcctcggggggccgcggcgctgccactcggcacccccacaggggtcctgcggagacgaactcccctggactttgcagcgccgtctaacccggctgcggacggcgtcagggcacgaacccggcggcagtgctgtctgtgcctcgagggtcaagctgcagcacctgcccgcacaggagcagtgggaccggctcttggtcctgtacccaacgtccttggccattttctccgaggagctggacgggctttgcttcaagggggagctcccactccgtgccgtccacatcaacctggaggagaaggagaagcagatccgctccttcctgattgaaggccccctcatcaacaccatccgcgtggtgtgcgccagctacgaggactacggtcactggctgctgtgccttcgcgctgtcacccacagggagggggccccgccgctgcctggtgccgagagcttcccagggtcgcaggttatgggcagtggccgaggctcactctcctcaggcggacagaccagctgggactcggggtgcttggcgcccccctccacccgcaccagccactccctgcctgagtcctcagtgccatccaccgtgggctgctcctcccagcacacaccggaccaggccaactctgaccgtgccagcattggccgacggaggaccgagctgagacgcagtggcagcagccggtcacccgggagcaaggcccgggcagagggccgcggccctgtcaccccactgcacctggacctgacccagctgcacaggctgagcctggagagcagcccagatgcccctgaccacacttcggaaacatcacactcgcccctctatgccgacccctacacaccacccgccacctcccaccgcagggtcacagatgtccggggcctggaggagttcctcagtgccatgcagagtgcacgtggacccacgccctcgagcccactcccctcggtgcctgtgtctgtgcctgcctctgaccctcgctcctgctcctccggccccgctggcccctacttgctctccaagaagggagccctgcagtccagagccgctcagagacaccggggctcagccaaggatggggggccgcagcccccagacgcccctcagcttgtctcctctgccagggaaggttcgcccgaaccctggctgcctctgacagatggtcggtcccccaggaggagccgggaccccggctacgaccacctctgggacgagactttgtcttcctcccaccagaagtgcccccagcttggagggcctgaggccagtggggggcttgtgcagtggatctgatggccgcggtgaggtgggttctcaggaccaccctcgccaagctccagggtacctgcccctctaacccacttcaaattacaagtcagggtctgaacccagtgtgatggggggagtctctggggccctgagttcagagcccgtccctcagctcctgttccttggtgccagcagctggggcagggaagggtgggaggggccccatccaaaggatgccctggccagcgaggctgggtcacaggtcagggaggtcctggccgtccacagggtcggccctcagctcagcccgccaggagtcagggaggagactcgctgggagtgggagggcagcacgggcgtgaaggtcggaggacagagaaaggtcagcagggtcagagtatgtgaggtcagagggcatgagggtcacaggtcagcaaggtgtgaggagcacaagcca

SEQ ID NO: 5733 - DNA, 2404 bp, Homo sapiens
gggacccagacttgccgacctgtacgactctggccatggggaacagccactgtgtccctcaggcccccaggaggctccgggcctccttctccagaaagccctcgctgaagggaaacagagaggacagcgcgcggatgtcggccggcctgccgggccccgaggctgctcgaagcggggacgccgccgccaacaagctcttccactacatcccgggcacggacatcctggacctggagaaccagcgagaaaacctggagcagccattcctgagtgtgttcaagaaggggcggcggagggtgcctgtgaggaacctgggaaaagttgtgcattacgccaaggtccagctgcggttccagcacagccaggatgtcagcgactgctacctggagctattccccgcccacctgtacttccaggcccacggctcggaaggactcacatttcaggggctgttaccgctgacggagctgagtgtctgcccgctcgaggggtcccgagagcacgccttccagatcacaggcccactgcccgcacccctcctggtgctctgccccagccgggccgagctggaccgctggctttaccacctggagaagcagacggccctcctcggggggccgcggcgctgccactcggcacccccacagcgccgtctaacccggctgcggacggcgtcagggcacgaacccggcggcagtgctgtctgtgcctcgagggtcaagctgcagcacctgcccgcacaggagcagtgggaccggctcttggtcctgtacccaacgtccttggccattttctccgaggagctggacgggctttgcttcaagggggagctcccactccgtgccgtccacatcaacctggaggagaaggagaagcagatccgctccttcctgattgaaggccccctcatcaacaccatccgcgtggtgtgcgccagctacgaggactacggtcactggctgctgtgccttcgcgctgtcacccacagggagggggccccgccgctgcctggtgccgagagcttcccagggtcgcaggttatgggcagtggccgaggctcactctcctcaggcggacagaccagctgggactcggggtgcttggcgcccccctccacccgcaccagccactccctgcctgagtcctcagtgccatccaccgtgggctgctcctcccagcacacaccggaccaggccaactctgaccgtgccagcattggccgacggaggaccgagctgagacgcagtggcagcagccggtcacccgggagcaaggcccgggcagagggccgcggccctgtcaccccactgcacctggacctgacccagctgcacaggctgagcctggagagcagcccagatgcccctgaccacacttcggaaacatcacactcgcccctctatgccgacccctacacaccacccgccacctcccaccgcagggtcacagatgtccggggcctggaggagttcctcagtgccatgcagagtgcacgtggacccacgccctcgagcccactcccctcggtgcctgtgtctgtgcctgcctctgaccctcgctcctgctcctccggccccgctggcccctacttgctctccaagaagggagccctgcagtccagagccgctcagagacaccggggctcagccaaggatggggggccgcagcccccagacgcccctcagcttgtctcctctgccagggaaggttcgcccgaaccctggctgcctctgacagatggtcggtcccccaggaggagccgggaccccggctacgaccacctctgggacgagactttgtcttcctcccaccagaagtgcccccagcttggagggcctgaggccagtggggggcttgtgcagtggatctgatggccgcggtgaggtgggttctcaggaccaccctcgccaagctccagggtacctgcccctctaacccacttcaaattacaagtcagggtctgaacccagtgtgatggggggagtctctggggccctgagttcagagcccgtccctcagctcctgttccttggtgccagcagctggggcagggaagggtgggaggggccccatccaaaggatgccctggccagcgaggctgggtcacaggtcagggaggtcctggccgtccacagggtcggccctcagctcagcccgccaggagtcagggaggagactcgctgggagtgggagggcagcacgggcgtgaaggtcggaggacagagaaaggtcagcagggtcagagtatgtgaggtcagagggcatgagggtcacaggtcagcaaggtgtgaggagcacaagccagggtgccccgaggaggagggtgggtgggtccttgtgtggcctggcgcgcaccacagggcagcacgggagacgttgacaccaccggacgagaaagaaaaaa

SEQ ID NO: 5734 - DNA, 3720 bp, Homo sapiens
cttgggcccccggcagccggcgggacagaacgcggagagtcgccgcctggccgggcgtagacgcggtggcagagcccgcgcggcgctggaagcgagtggcggagcggcgggacctcggcggactcgccatggaggaggagggtgtgaaggaagccggtgagaagcctcggggagcacagatggtggacaaggctggctggatcaagaagagcagtgggggcctcctgggtttctggaaagaccgatatctgctcctctgccaggcccagctgctggtctatgagaatgaggatgatcagaagtgtgtggagactgtggagctgggcagctatgagaagtgccaggaccttcgtgccctcctcaagcgaaaacaccgctttatcctgctgcgatccccagggaacaaggtcagcgacatcaaattccaggcacccaccggggaggagaaggaatcctggatcaaagccctcaatgaagggattaaccgaggcaaaaacaaggctttcgatgaggtaaaggtggacaagagctgcgccctggagcatgtgacacgggaccgggtgcgagggggccagcgacgccggccaccaacgagagtccacctgaaggaggtggccagtgcagcttctgacggtcttctgcgcctggatcttgatgttccggacagtgggccaccagtgtttgcccccagcaatcatgtcagtgaagcccaacctcgggagacaccccggcccctcatgcctcctaccaagcctttcctagcacctgagaccaccagccctggtgacagggtggagacccctgtgggggagagagccccaacccctgtctcagcaagctctgaggtctcccctgagagccaagaggactcagagaccccagcagaggaggacagtggctctgagcagcctcccaacagcgtcctgcctgacaaactgaaggtgagctgggagaaccccagcccccaggaggcccctgctgcagagagtgcagaaccgtcccaggcaccctgttctgagacttctgaggctgcccccagggagggtgggaagccccctacacccccacccaagatcttatcagagaaactgaaagcctccatgggtgagatgcaggcttctgggccacctgctccaggcacagtgcaggtctcagtgaatggcatggatgacagtcctgagcctgccaagccctctcaggctgagggcaccccaggaactcctccaaaggatgcaacaacatccacagcactgcccccctgggacctgccacctcagttccatccccgctgctcctcccttggggacttgcttggggaaggcccgcggcatcccttgcagcccagggaacggctatatcgggcccagctggaggtgaaggtggcctcggaacagacggagaaactgttgaacaaggtgctgggcagtgagccggcccctgttagtgccgaaacattgctcagccaggctgtggagcagctgaggcaggccacccaggtcctgcaggaaatgagagatttgggagagctgagccaggaagcacctgggctaagggagaagcggaaggagctggtgaccctctacaggagaagtgcaccctagggccttctgggccagaggcaccatcccttctggccatccatcaagtccatcaaggcccagccctgctgagaaatgtgcttctgcttctacagcaatggctgcaggagggccattgggcatgtcagggtttggccatgacccgaagagactcctggcgtccttcctactctgctctggccagtggtgccaggtgccacccagggctactgcctggctatctggcctggcctctgggctggggctggggctgggagcacacacgctgggacctatgtgtttgtgtggtcgttccaaactgccccagggctttgggggcggcacttggggtttctgggaatgacatcatctctgttccccatccccagtagtttacattcctgacttctgaatacagcacagctgagccccctgcagctcccatctccagctattcctaggcaaagagcctcatggctaaggcagcctcaaagccagcccctcctcccacctattctgagtagctgcagaggccttgggtccaggctctaggttcatccctcagttggggggaacgtaggacccagctggagcctcttgagggagatgagaggcctctttgtgaggaggacattagctgtgtggcctctctctctttggccctgtttccttttttgcaaaacaaggacattttctgcagccccttcctctcagtgagctatgattggagggcttaggtctggaggattcaagagtggaagaggaatttaaggggtcccctagtctagtctctgcccctggatagtgtccagccttgtatatttctgaagaggtggatcccagagtggctctgatgtccacattagaaaaacttacttgtaatgatcatgtcagccttcagaagagaatccccaccaacttctgtgcctcctcagatggggatttatctggatctctgtggttccttctcagccgaaacaggtccagtatcccagtcatttcttcaaatgctgataggggtatgttggaatccgaagccacttccccgccttcaagccccagatgggctgctctcctgtaactttctaggagaagagacattttcttctttccctttcctggtccatccctgcaccctggtcctctcccagcctctcccccacattgtccctgactctaggggcacatccagtctccatcgtgctgcagcagctggactgagggcagagcctgtaggtgcagaggccctggctcccgaggtccagccactctccctggggcctctggggtgagagcagcttccgataggacctgcccagatttctgcatgtgcacttttgtttactgaaagagagaaaggggggggtcacagcaacatgccctggcctttctgctctgttccccaaccccactgaggcctgctgcacaggtcaatgccttcgttatcgttattgtactgtcactttgttcttgaggtagtagtcaaggatcaggaggggcagatgtcttctctgggctgcgtggggccggagcagaggtgagcagcaatgcactggttcgggagcccccatcagcctccttgtgcaaactgggcccccatgccacagtctggctttccctccatctgccccaggacaagagcaagaaggacatcagttgcccagtcatgtgatcccctgccatcttgccttaggaacagccttcccccaccagcagccatggctggctggggctttagccaagccacctactgccaggaattggagcctcagttccctcctgtgtcaagtagctaactgcagcagctggactgagggcagagtctgtgggtgcagagaccctgcatgtaggtcacaggttgaggcccagccactctccctggggcctggtgggtaggcaagtagctctggggccacctcaagtgaccaaatgctattaatttccatcctttagcaggctgggccctaggcaggaagctggcttctgggagaggagtgagaacgtgcagggcctgcctagcttgcgtgcttgaggaaggtggcattccgtgcttgcctccttgaggagggtggcattctgtgtcttctgcttatgaagcgcctttcttaaagtttggcaataaatccatttttatggaacttca

SEQ ID NO: 5735 - DNA, 2390 bp, Homo sapiens
agaacgcggagagtcgccgcctggccgggcgtagacgcggtggcagagcccgcgcggcgctggaagcgagtggcggagcggcgggacctcggcggactcgccatggaggaggagggtgtgaaggaagccggtgagaagcctcggggagcacagatggtggacaaggctggctggatcaagaagagcagtgggggcctcctgggtttctggaaagaccgatatctgctcctctgccaggcccagctgctggtctatgagaatgaggatgatcagaagtgtgtggagactgtggagctgggcagctatgagaagtgccaggaccttcgtgccctcctcaagcgaaaacaccgctttatcctgctgcgatccccagggaacaaggtcagcgacatcaaattccaggcacccaccggggaggagaaggaatcctggatcaaagccctcaatgaagggattaaccgaggcaaaaacaaggctttcgatgaggtaaaggtggacaagagctgcgccctggagcatgtgacacgggaccgggtgcgagggggccagcgacgccggccaccaacgagagtccacctgaaggaggtggccagtgcagcttctgacggtcttctgcgcctggatcttgatgttccggacagtgggccaccagtgtttgcccccagcaatcatgtcagtgaagcccaacctcgggagacaccccggcccctcatgcctcctaccaagcctttcctagcacctgagaccaccagcccctcctcccacctattctgagtagctgcagaggccttgggtccaggctctaggttcatccctcagttggggggaacgtaggacccagctggagcctcttgagggagatgagaggcctctttgtgaggaggacattagctgtgtggcctctctctctttggccctgtttccttttttgcaaaacaaggacattttctgcagccccttcctctcagtgagctatgattggagggcttaggtctggaggattcaagagtggaagaggaatttaaggggtcccctagtctagtctctgcccctggatagtgtccagccttgtatatttctgaagaggtggatcccagagtggctctgatgtccacattagaaaaacttacttgtaatgatcatgtcagccttcagaagagaatccccaccaacttctgtgcctcctcagatggggatttatctggatctctgtggttccttctcagccgaaacaggtccagtatcccagtcatttcttcaaatgctgataggggtatgttggaatccgaagccacttccccgccttcaagccccagatgggctgctctcctgtaactttctaggagaagagacattttcttctttccctttcctggtccatccctgcaccctggtcctctcccagcctctcccccacattgtccctgactctaggggcacatccagtctccatcgtgctgcagcagctggactgagggcagagcctgtaggtgcagaggccctggctcccgaggtccagccactctccctggggcctctggggtgagagcagcttccgataggacctgcccagatttctgcatgtgcacttttgtttactgaaagagagaaaggggggggtcacagcaacatgccctggcctttctgctctgttccccaaccccactgaggcctgctgcacaggtcaatgccttcgttatcgttattgtactgtcactttgttcttgaggtagtagtcaaggatcaggaggggcagatgtcttctctgggctgcgtggggccggagcagaggtgagcagcaatgcactggttcgggagcccccatcagcctccttgtgcaaactgggcccccatgccacagtctggctttccctccatctgccccaggacaagagcaagaaggacatcagttgcccagtcatgtgatcccctgccatcttgccttaggaacagccttcccccaccagcagccatggctggctggggctttagccaagccacctactgccaggaattggagcctcagttccctcctgtgtcaagtagctaactgcagcagctggactgagggcagagtctgtgggtgcagagaccctgcatgtaggtcacaggttgaggcccagccactctccctggggcctggtgggtaggcaagtagctctggggccacctcaagtgaccaaatgctattaatttccatcctttagcaggctgggccctaggcaggaagctggcttctgggagaggagtgagaacgtgcagggcctgcctagcttgcgtgcttgaggaaggtggcattccgtgcttgcctccttgaggagggtggcattctgtgtcttctgcttatgaagcgcctttcttaaagtttggcaataaatccatttttatgg

SEQ ID NO: 5736 - DNA, 2591 bp, Homo sapiens
ggtggggccgggccggggccggtggggccgggatggccggatgccgaggccacgggtggggcaagcccgtggctccctcctccctcgggagctgttggacctgttgtcccccctccacttccgggctgctggggagggggaccgggcggcctctctcctccctcttcccctgccacctgtctcataggcagaagcggccgtgcccagcgcgcagagcggagcgcgccgaagcctgagctcgtgagggggccgaggctgtggggaggtggcagttggacttcggaatctcaaggactccgactcctggcttgttcagagaaggagagccccgactcctggatccctgggagtcccagcggccatggggacgcgaagcagccccgaggaggggaccccgccgccgctggtcccggaatgcgacgtggaggtccagccccagggccatcccgaggagtcccgggaacaggaggcatccgaagtcctggcggaaccttcgagccgcgggggagctgagcagcaggcagaggaagaagaagtgggagaaggcagcagcactgagagcagccgcgacgcgcccgaggctacgcctccgatagctatggcggccacacctcccgcatccacctcttcgcgggaaggggtgcgaggggcggcgcggcgcctgcaaggacagcagctggaggcattgactcgtgtggccctgatggagcagcgagtgaaggagctacagcgccagaggaaggagctgaggatcgagatggaggtggaggtggccttgctgcggggtgagctggctggggagcgagtggccgctcgccgggaggaggagcagctgcgggagctgctggagcagcaggcggcctcggagcagcgcggccgccagcagcgggaacaggaacagaggcggctgagccaggaacgggatcgcctagagggtcttcgccagagactccgcaaggcccagggacagctcgactcacagccagaggaccaacgcgagcggcttctgcagggtgtgcaggagatgagggaacaactggatgtggcccaacgtgcctatgaggacctggagttccagcaactggagcgggagagccggcaggaggaggaggatcgggacagccctgggccccaggtgccagaccccaaggtccaggaactccaggccagcatggcgcagcacagaaggggtgctctgcagcaccggatccgggtcctggaagagcagctcaagtcactgggggagcagatggcagccgagagccgggggttgagccggaagaaggaggaggcccttcaggccctgtcacaggaacggagccggctgctcgagctcaattgccttcagggaacacctggcggggacttctctgagcccaacccggccctcactaagctgctgttcacccagaagacagaccgccagctgctggtgctccaggatgccgtggcccactccgctgccacccctacttcttcctgcctcttttctgtccacagctccctgcagggctccattggcctccagaggactgggagcctgccccggaaaaggggggagagggggagccagagaggatccccccgacctctgtccttccattgtactgaatccctggaggcctcagctctcccgccagcagtgggggactccggcagataccccctctaccagctgctgaactgtggccgtgggaatagctgtggggccatccatccagacattgcccacatggagcggctcctgcagcaggccatggcggagagggagcggctgctcaaggcccgggaaggaacaagaaggggcacggaaggttcctcaggccctgctgttcctgccatcacggccccacccaccccaccccaccctccaggcccgcgaatcttggatctccggcagcatctggagggatggggccacaacccggaaaactgcccacatgtgcaggtgtctgggtgctgctgccgtggacccctggtgaagatgggcggccgcatcaagacctggaggaagcgatggttctgctttgaccgccaagcccgccgcttggcctactatgcggacaaggaagagaccaagctcaaaggtgtcatctacttccaggccattgaggaagtctattatgaccacttacgctgtgccttcaagagccccaacccccgcctgaccttctgcgtcaaaacctacgaacgccttttctacatggtggctccgagccccgaagccatgcgcatttggatggacgtcatcgtgaccgccgctgacgaaaaccacgccccctgagtggccccgccctcttggggggaagtcccttcgaggctccgccggcgcggggcgcgggggcgttcctaggccccgcccactgccggaaaacttggacgcaccgctttggaactctcccgggaattccgcaggcgcggcagttcagctggcctgagctgctgcgttctgggttgcaggtgccttgcccccgacgggatcgccggcccctaaggccctgcccggggcaggaggaagattgcaggggcgggaagaaactatttattggtgctcctgtgataccgaattaaatacggaggaaaaacaggaa

SEQ ID NO: 5737 - DNA, 773 bp, Homo sapiens
cttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggtgcgaagcccagcggtgcagagtccagcaaaggtgcagcctttgtgtccaagcaggagggcagcgaggtagtgaagagacccaggcgctacctgtatcaatggctgggagccccagtcccctacccggatcccctggagcccaggagggaggtgtgtgagctcaatccggactgtgacgagttggctgaccacatcggctttcaggaggcctatcggcgcttctacggcccggtctagggtgtcgctctgctggcctggccggcaaccccagttctgctcctctccaggcacccttctttcctcttccccttgcccttgccctgacctcccagccctatggatgtggggtccccatcatcccagctgctcccaaataaactccagaagaggaatctg

SEQ ID NO: 5738 - DNA, 852 bp, Homo sapiens
aacttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctgcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggtgcgaagcccagcggtgcagagtccagcaaaggtgcagcctttgtgtccaagcaggagggcagcgaggtagtgaagagacccaggcgctacctgtatcaatggctgggagccccagtcccctacccggatcccctggagcccaggagggaggtgtgtgagctcaatccggactgtgacgagttggctgaccacatcggctttcaggaggcctatcggcgcttctacggcccggtctagggtgtcgctctgctggcctggccggcaaccccagttctgctcctctccaggcacccttctttcctcttccccttgcccttgccctgacctcccagccctat

SEQ ID NO: 5739 - DNA, 2162 bp, Homo sapiens
gctcgggtcccactcatcccatggcccatcacctgcctgcagccatggagagccatcaggacttccggagcatcaaagcaaagttccaggcctctcagccggagcccagcgacctgcccaaaaaacctccgaagcctgagtttggtaaactgaagaagttctcccagcctgagctaagcgagcaccccaagaaggccccgctgcctgagtttggtgcagtgtccttgaagcccccgccgcctgaggtcactgacctccccaagaagcccccgccgcctgaggtcactgacctccccaagaagcccccgccgcctgaggtcactgacctccccaagaagcccccgccgcctgaggtcactgacctccccaagaagccgtccaaactggagttgagtgacctctccaagaagttcccacagctgggggccactccgtttccaaggaagcccctgcagcctgaggtcggtgaggcccctttgaaggcctcgctgccggagcctggtgcgccggcccggaaacccctgcagcccgacgaactcagtcaccccgccagacccccctccgaacccaaatccggcgcattccccaggaagctctggcaacccgaggccggtgaggctaccccgaggtccccgcagcctgagttgagtacctttcccaagaagcctgcgcagcctgagttcaacgtgtaccccaaaaagcctccgcagcctcaggtcggtggcctccctaagaagtccgtgccgcagcctgagttcagcgaggccgctcagactcccctctggaagcctcagtccagcgagccgaagcgcgactccagcgcctttcccaaaaaggcctcccagcctccgctgagtgactttcccaagaagcctccgcagcctgagcttggggacctcaccaggacctcctcagagcccgaagtcagcgtgcttcccaagaggccgcggccggccgaattcaaagcgctctccaagaagcccccgcagcccgagctgggcggcctccccaggacctcctcagagcccgagttcaactcactccccaggaagctgctgcagccggagcgccgggggccaccccgcaagttctcacagcctgagcccagcgctgtcctcaagagacacccgcagcctgagttcttcggtgatctccctcgaaagcctccactccccagctccgcttccgagagctcactgcctgcggccgtggccggcttcagctcccggcacccgctcagccctgggtttggagcggctgggacaccccgctggaggtcaggaggcctggttcacagtggaggggccaggccaggcctcagacccagccatccaccccggcggaggcctctgccccctgccagcagcctgggacaccctccagccaagcccccgctgcccccggggcccgtggatatgcagagctttcggagaccctctgcagcatccatagatctacggaggacccgctcggccgctgggctccacttccaggaccgacagcctgaagacatcccggtcccagatgagatctacgagctgtatgacgatgtggaacccagagatgactccagccccagccccaagggcagagatgaagcgccctcagttcagcaagccgccaggaggccaccacaagacccagcgctcaggaaggagaaggatccccagccacagcagttgccacccatggacccaaagttgctgaagcagctgaggaaggcagagaaggccgagagggagttccggaagaagttcaagtttgaaggggagatcgtggttcacacgaagatgatgatcgaccccaacgctaagacacgtcgcgggggtggcaagcacctcgggatccggcgcggggagatcctggaggtgatcgagttcaccagcaatgaggagatgctgtgccgggaccccaaaggcaaatatggctacgtgcccagaacagcgctcctgcccctggagacggaggtgtacgatgatgtcgacttctgcgatcccctggaaaaccaaccactccccctgggacggtaagaccggtaggcgtggggccaggacagccagccagcccagcgcccgctcacccaggagccctggatcccggcgcgggaaagtcacagagctgcctgggcttgtacctggccacataaagccccagtttaaagc

SEQ ID NO: 5740 - DNA, 2060 bp, Homo sapiens
agtcacttcctgaaggcagcggccccagctcgggtcccactcatcccatggcccatcacctgcctgcagccatggagagccatcaggacttccggagcatcaaagcaaagttccaggcctctcagccggagcccagcgacctgcccaaaaaacctccgaagcctgagtttggtaaactgaagaagttctcccagcctgagctaagcgagcaccccaagaaggccccgctgcctgagtttggtgcagtgtccttgaagcccccgccgcctgaggtcactgacctccccaagaagcccccgccgcctgaggtcactgacctccccaagaagcccccgccgcctgaggtcactgacctccccaagaagcccccgccgcctgaggtcactgacctccccaagaagccgtccaaactggagttgagtgacctctccaagaagttcccacagctgggggccactccgtttccaaggaagcccctgcagcctgaggtcggtgaggcccctttgaaggcctcgctgccggagcctggtgcgccggcccggaaacccctgcagcccgacgaactcagtcaccccgccagacccccctccgaacccaaatccggcgcattccccaggaagctctggcaacccgaggccggtgaggctaccccgaggtccccgcagcctgagttgagtacctttcccaagaagcctgcgcagcctgagttcaacgtgtaccccaaaaagcctccgcagcctcaggtcggtggcctccctaagaagtccgtgccgcagcctgagttcagcgaggccgctcagactcccctctggaagcctcagtccagcgagccgaagcgcgactccagcgcctttcccaaaaaggcctcccagcctccgctgagtgactttcccaagaagcctccgcagcctgagcttggggacctcaccaggacctcctcagagcccgaagtcagcgtgcttcccaagaggccgcggccggccgaattcaaagcgctctccaagaagcccccgcagcccgagctgggcggcctccccaggacctcctcagagcccgagttcaactcactccccaggaagctgctgcagccggagcgccgggggccaccccgcaagttctcacagcctgagcccagcgctgtcctcaagagacacccgcagcctgagttcttcggtgatctccctcgaaagcctccactccccagctccgcttccgagagctcactgcctgcggccgtggccggcttcagctcccggcacccgctcagccctgggtttggagcggctgggacaccccgctggaggtcaggaggcctggttcacagtggaggggccaggccaggcctcagacccagccatccaccccggcggaggcctctgccccctgccagcagcctgggacaccctccagccaagcccccgctgcccccggggcccgtggatatgcagagctttcggagaccctctgcagcatccatagatctacggaggacccgctcggccgctgggctccacttccaggaccgacagcctgaagacatcccgcaggtcccagatgagatctacgagctgtatgacgatgtggaacccagagatgactccagccccagccccaagggcagagatgaagcgccctcagttcagcaagccgccaggaggccaccacaagacccagcgctcaggaaggagaaggatccccagccacagcagttgccacccatggacccaaagttgctgaagcagctgaggaaggcagagaaggccgagagggagttccggaagaagttcaagtttgaaggggagatcgtggttcacacgaagatgatgatcgaccccaacgctaagacacgtcgcgggggtggcaagcacctcgggatccggcgcggggagatcctggaggtgatcgagttcaccagcaatgaggagatgctgtgccgggaccccaaaggcaaatatggctacgtgcccagaacagcgctcctgcccctggagacggaggtgtacgatgatgtcgacttctgcgatcccctggaaaaccaaccactccccctgggacggtaa

SEQ ID NO: 5741 - DNA, 69 bp, Homo sapiens
aagttctcccagcctgaggtagctgaggggatgtccaggcagaacttgggcctgaaactcagggggagg

SEQ ID NO: 5742 - DNA, 3689 bp, Homo sapiens
agtgcgcaggcgcgcgctgcgacgccaacctcggcttctcgccgctaacggcatcgagtctggacgccccgtgacccgcctgggccggagcgggggcggacggcgccttcttggccctttctgcctctagcagcggcgccggggtagccggagccagcgactgggaaacggctgcattccactgcgtctccttggcctggctgggcggtcggaggctgatctgccaagattactgtttggagaccgctgcagcccacgtccacctgatagactatttactacacatagtaggttcagagccgctaaatgtccaagaccatggcgatgaaccttctggaggattggtgcaggggaatggaagtggacatccacaggtccttgttggtcacaggcatcccagaggactgtgggcaggcagaaattgaggagaccttgaatggggtcctctccccactgggcccgtaccgcgtgctcaacaagatttttgtgagggaagagaatgttaaagctgccctcattgaggttggtgaaggtgtgaatctgagcaccatcccccgtgaattcccaggaaggggtggtgtctggagagtggtctgtagagaccctacccaggatgccgagtttttaaaaaatctgaatgaattcctggatgccgaggggcgcacctgggaggatgtggtccgcctgctccagctcaaccaccccaccctgtcccagaaccagcatcagcccccagagaactgggcagaagctctgggggtgcttctgggagcagtggtgcagatcatcttctgcatggatgccgagatccgcagccgggaggaagccagggcccaggaggccgctgaattcgaggagatggcagcctgggctttagcagcagggaggaaggtgaagaaagaaccggggcttgcagcagaggtgggttctgccttaaaggcagagacccccaacaactggaatgccacggaagaccagcatgagcctaccaaacctttggttcgcagggctggagctaagtctcgctccaggagaaagaagcagaagaagaactccaggcaggaagcagtgccctggaaaaaacccaaaggcatcaattccaacagcacagctaacttggaggatcctgaggtgggtgatgctgaaagcatggcgatctcagagccgatcaagggcagcagaaagccctgtgtgaataaggaggagttggctttgaagaagcccatggcgaaatgtgcctggaagggtcccagagagccacctcaggatgcccgggcagaagccgagagcccaggaggcgcctctgagtcagaccaagatggtggccatgaaagcccaccaaagaagaaggccgtggcctgggtgtctgccaagaaccccgctcccatgaggaagaagaagaaggtgagcttgggccctgtctcctacgtcttggttgactcagaagatggcaggaagaagccggtgatgccaaagaaagggccaggctcaagaagggaggcatcagatcagaaggcccctcggggccagcagcctgccgaggcaacagcctcaacctctaggggtccgaaggccaagccagaaggctctcctcggcgtgccaccaatgaatccagaaaggtttgatctgggggaccacccatactgaggagttgaaagaacaaggaagaagtaccaagtcaaccaagttctctcttgtcactgaataagactttggactctcttagggcccctgttgatagagatctggccctgaggtaaacgataggtgaggtcttgggtgggagggagttggggaagggaggtggatctctatgcccttttctctaccaggcctgccgtttcaccgccttctctactcaccttctcttcggaggcaggagagttggtaagaggattgggaaaattctagaacattcattcccctttatgcatgagcagggtcactgttacactcatccatgttcagcttttctcccccacgccttgctccctcctcggaatggtcagcgacctctgcaggccctggcatttggaagagctgggtggccctgccatattcttcctcccgccttcctctcgtgtaaccagcggggtaagttaagccaggaccttcgctgcaaacctggttttattgctccttcagtctccagcttccatcctccagttatctagccaggaggtcccaagagttagttttagggaaaaagaatgtctgcctagacctcaaagtctttgagttttagagtctgttagtaaaaatggcactttgattcccatttgggatgagccctctcaggaatcctgtggggaaggggggtgattatagggaaggacgcaggcattcctaggtccccagctctaattccatccatctacccaactgtcaccatctttgcaccaaactgtcaccatctttgcagcagaaggtcactactcacattatagtaagaggggaaaaaaatcttttaaaacttggctgttggccgggcacggtggctcacgcctgtaatcccagcactttgggaggctgaggcaggtcgatcacgaggtcaggcgtttaagaccagcttgaccaacatggtgaaaccccatctctacaaaaattagctgggcgtggtggcgcgcgcctgtaatcccagctactcaggaggctgaggcagatgaattgcttgaatccaggaggcagaggttgcaatgagccgagattgtgccacggcactccagcctgggcagcagagtgagactctctctcaaaaaaacaaaacttggctgttaatgtctgccctctgaattcagacacactatattagaccagaccaccatgtgtcattgtgtgtgtgtgtgtgtgtgtttgcgtgcgcatgtgtagaggagagagcagggtccctgagataatggtttccaaactgtatcgtagccgtccacaaagatgtaatccaaatctatttttctcacgtgtttaaaaaactgaaaagtgactactcagatatgttggaagtcacatcgaagactatcagaatattaccttgtgttcataggttaacttgtttttgtacacgtcttagttatttcaggcatctctttgcttaaaattgagtttcttgtaaatgtgactgatgagcgaggttagaagtggaagaaattcctgtgcatgttctataatctgacaccctgaaagcaagtttcctttcgtcattcacatgctcttgttctgccgtgactgttcaggtgtatggtagtaagtaaatgtattaacatggtgaacagtagtaatattctatcatagagtattagcccttgcaagttttcagggcgtcttttccgacttcagtttttgtgataaagaatgtgaacagttgttagatgttctcagtgattcaactttaaaacaaatttctcgtgatgattcatttcaaaatcctgagtgagtctgactgaaaaatacgagagaaaagagagtggtttccgtttgcagctacacagctgtgtgcatcgacgttctcctggggtgtgtgccaagcgaaacccaggggtgaattggattcttgaagagaccaaagcctgtaactgtccagcttctaatttcaaaacgggtccattagggcttcgttgtgttaacaagttgacaccatgactagtaaatgtaaacgtgtatgtataaaataaagtttagcaaattaagtgtc

SEQ ID NO: 5743 - DNA, 869 bp, Homo sapiens
atcgagtctggacgccccgtgacccgcctgggccggagcgggggcggacggcgccttcttggccctttctgcctctagcagcggcgccggggtagccggagccagcgactgggaaacggctgcattccactgcgtctccttggcctggctgggcggtcggaggctgatctgccaagattactgtttggagaccgctgcagcccacgtccacctgatagactatttactacacatagtaggttcagagccgctaaatgtccaagaccatggcgatgaaccttctggaggattggtgcaggggaatggaagtggacatccacaggtccttgttggtcacaggcatcccagaggactgtgggcaggcagaaattgaggagaccttgaatggggtcctctccccactgggcccgtaccgcgtgctcaacaagatttttgtgagggaagagaatgttaaagctgccctcattgaggttggtgaaggtgtgaatctgagcaccatcccccgtgaattcccaggaaggggtggtgtctggagagtggtctgtagagaccctacccaggatgccgagtttttaaaaaatctgaatgaattcctggatgccgaggggcgcacctgggaggatgtggtccgcctgctccagctcaaccaccccaccctgtcccagaaccagcatcagcccccagagaactgggcagaagctctgggggtgcttctgggagcagtggtgcagatcatcttctgcatggatgccgagatccgcagccgcagggaggaaggtgaagaaagaaccggggcttgcagcagaggtgggttctgccttaaaggcagagacccccaacaactggaatgccacggaagaccagcatga

SEQ ID NO: 5744 - DNA, 3489 bp, Homo sapiens
agtgcgcaggcgcgcgctgcgacgccaacctcggcttctcgccgctaacggcatcgagtctggacgccccgtgacccgcctgggccggagcgggggcggacggcgccttcttggccctttctgcctctagcagcggcgccggggtagccggagccagcgactgggaaacggctgcattccactgcgtctccttggcctggctgggcggtcggaggctgatctgccaagattactgtttggagaccgctgcagcccacgtccacctgatagactatttactacacatagtaggttcagagccgctaaatgtccaagaccatggcgatgaaccttctggaggattggtgcaggggaatggaagtggacatccacaggtccttgttggtcacaggcatcccagaggactgtgggcaggcagaaattgaggagaccttgaatggggtcctctccccactgggcccgtaccgcgtgctcaacaagatttttgtgagggaagagaatgttaaagctgccctcattgaggttggtgaaggtgtgaatctgagcaccatcccccgtgaattcccaggaaggggtggtgtctggagagtggtctgtagagaccctacccaggatgccgagtttttaaaaaatctgaatgaattcctggatgccgaggggcgcacctgggaggatgtggtccgcctgctccagctcaaccaccccaccctgtcccagaaccagcatcagcccccagagaactgggcagaagctctgggggtgcttctgggagcagtggtgcagatcatcttctgcatggatgccgagatccgcagccgggaggaagccagggcccaggaggccgctgaattcgaggagatggcagcctgggctttagcagcagggaggaaggtgaagaaagaaccggggcttgcagcagaggtgggttctgccttaaaggcagagacccccaacaactggaatgccacggaagaccagcatgagcctaccaaacctttggttcgcagggctggagctaagtctcgctccaggagaaagaagcagaagaagaactccaggcaggaagcagtgccctggaaaaaacccaaaggcatcaattccaacagcacagctaacttggaggatcctgaggtgggtgatgctgaaagcatggcgatctcagagccgatcaagggcagcagaaagccctgtgtgaataaggaggagttggctttgaagaagcccatggcgaaatgtgcctggaagggtcccagagagccacctcaggatgcccgggcagaagccgagagcccaggaggcgcctctgagtcagaccaagatggtggccatgaaagcccaccaaagaagaaggccgtggcctgggtgtctgccaagaaccccgctcccatgaggaagaagaagaagaatccagaaaggtttgatctgggggaccacccatactgaggagttgaaagaacaaggaagaagtaccaagtcaaccaagttctctcttgtcactgaataagactttggactctcttagggcccctgttgatagagatctggccctgaggtaaacgataggtgaggtcttgggtgggagggagttggggaagggaggtggatctctatgcccttttctctaccaggcctgccgtttcaccgccttctctactcaccttctcttcggaggcaggagagttggtaagaggattgggaaaattctagaacattcattcccctttatgcatgagcagggtcactgttacactcatccatgttcagcttttctcccccacgccttgctccctcctcggaatggtcagcgacctctgcaggccctggcatttggaagagctgggtggccctgccatattcttcctcccgccttcctctcgtgtaaccagcggggtaagttaagccaggaccttcgctgcaaacctggttttattgctccttcagtctccagcttccatcctccagttatctagccaggaggtcccaagagttagttttagggaaaaagaatgtctgcctagacctcaaagtctttgagttttagagtctgttagtaaaaatggcactttgattcccatttgggatgagccctctcaggaatcctgtggggaaggggggtgattatagggaaggacgcaggcattcctaggtccccagctctaattccatccatctacccaactgtcaccatctttgcaccaaactgtcaccatctttgcagcagaaggtcactactcacattatagtaagaggggaaaaaaatcttttaaaacttggctgttggccgggcacggtggctcacgcctgtaatcccagcactttgggaggctgaggcaggtcgatcacgaggtcaggcgtttaagaccagcttgaccaacatggtgaaaccccatctctacaaaaattagctgggcgtggtggcgcgcgcctgtaatcccagctactcaggaggctgaggcagatgaattgcttgaatccaggaggcagaggttgcaatgagccgagattgtgccacggcactccagcctgggcagcagagtgagactctctctcaaaaaaacaaaacttggctgttaatgtctgccctctgaattcagacacactatattagaccagaccaccatgtgtcattgtgtgtgtgtgtgtgtgtgtttgcgtgcgcatgtgtagaggagagagcagggtccctgagataatggtttccaaactgtatcgtagccgtccacaaagatgtaatccaaatctatttttctcacgtgtttaaaaaactgaaaagtgactactcagatatgttggaagtcacatcgaagactatcagaatattaccttgtgttcataggttaacttgtttttgtacacgtcttagttatttcaggcatctctttgcttaaaattgagtttcttgtaaatgtgactgatgagcgaggttagaagtggaagaaattcctgtgcatgttctataatctgacaccctgaaagcaagtttcctttcgtcattcacatgctcttgttctgccgtgactgttcaggtgtatggtagtaagtaaatgtattaacatggtgaacagtagtaatattctatcatagagtattagcccttgcaagttttcagggcgtcttttccgacttcagtttttgtgataaagaatgtgaacagttgttagatgttctcagtgattcaactttaaaacaaatttctcgtgatgattcatttcaaaatcctgagtgagtctgactgaaaaatacgagagaaaagagagtggtttccgtttgcagctacacagctgtgtgcatcgacgttctcctggggtgtgtgccaagcgaaacccaggggtgaattggattcttgaagagaccaaagcctgtaactgtccagcttctaatttcaaaacgggtccattagggcttcgttgtgttaacaagttgacaccatgactagtaaatgtaaacgtgtatgtataaaataaagtttagcaaattaagtgtcctgtt

SEQ ID NO: 5745 - DNA, 1726 bp, Homo sapiens
atggccatgagccttttgcaggactggtgccggagcctggacgtggacgcgcacagggccctgctggtcaccggcatcccggagggcctggagcaggcagacgtcgaagccgtcctgcagccgaccctcctgcccctgggcacgttcaggttgcgacacatgaaggctttgatgaacgagaaggcccaggccgccctggtggagtttgtggaggacgtcaatcacgctgccattcccagggagatcccaggcaaggatggggtctggagggttctgtggaaggaccgtgcgcaggacacgagggtcctgaggcagatgagacgcctgctgctggatgacgggcccacgcaggccgcggaggctgggacccccggggaggcacccacccctcccgcttcggagacgcaggcccaggattctggggaggtaacagggcaggctggctcgcttcttggggcagccaggaacccaaggaggggccgtcggggtcgcagaaacagaaccagacgcaacaggttgacccagaagggcaagaagagaagccgaggaggacggccgtctgctcccgcgaggagtgaggccgaggactcttccgacgagagcctgggcatcgtgatcgaggagatcgaccagggcgacctgagcggagaagaggaccagagcgcgctgtacgccacgctgcaggccgctgccagggagctggttaggcagtgggcgccctgcaactccgagggggggccctgccccacttgtccctgggaaggaataggagggtttgggtgtgacctcacagtccagaccagactgtcccagtcctatgtcagggacacccagatgtagaagctgactgagacctgctgcagggcgtgggtgctcccctctgcttggaggctgtccctggacagtgacccacccactgaggaccaggctgggtgtaccttgagctgggcacagcagcctgtggtgttgcctgtgggtggggagggccccaggtgtgcttctcccgtagcagtcctaggcttctctccctgtgccctgtgtcacctggatcctccagtaaagtgaaattcagcactgtactctctctgtgctctgggcagtggggcaggcggggtgtgggagcgtgggccacagatgtccacggtcttgactgtggtttgcccagaatacctgggaactgtcctgtcactggtttacatacactgtcctttgctgcttcgggatccctgcctggctctccctaccccccagcatcatctcaccccttgcagatctgagccagcttccactcccacccctgatgcctccccacttccagcctcagctccgaagcccctggacacccatggagaccccgcccagccaatccccaccctagcttccacccagatacactctgccaggccacaactgcaggcactctccccccagcctccacccctcacctgtgccctggacctcagactcagctttccatcctacctgagttttctgcctccctccatcctgtgtccccccaccatacatggctgccagagacgtcctcttagaagtcacacctggggtctgattgcgtccctcgcctccccagatcccccaaggtctccttcctgtgccgtcatatctgcagttcttaggactgtctagacatgctttgttcaactaggtaatcacacggggtaaattggatttaaatgtaattaagattaaataaaaatacacatgc

SEQ ID NO: 5746 - DNA, 1486 bp, Homo sapiens
atcgatcacaggctcacaacgcccttccattcatcgctcttattccagtcctggttactaccccacttcctgacatcaaaccagggagaacgcgagtgttagttaacatggcttggtgtgtggccacagctgacccggcgcatacctcccgtcctctctttacagggctggcggtgtctcggggctcggctggccatgcctggagcgcggggtttgactgggccgccgttgttgtagtgaccgggaggcgctgccgctctgggcagacggttccgggagccgcacggtcccctctccttccccatcctctcccctcccctctccgggttcccccacccacaggagccttgggccgaccactcccccgatggcctcagccacggaggaccccgttctggagcgttatttcaaaggccacaaagctgcgatcacctccttggacctcagccccaacggcaagcaacttggaaagggacaggcggatatcaagaattgaccccatcagatcacctaccatggctggaggactgtttgctgtcagcaagaaatattttcagtaccttggaacgtatgacacaggaatggaagtgtggggaggtgaaaaccttgagctgtcttttagggtgtggcagtgtggtggcaaattggagatccacccgtgttcccacgtgggccatgtgttccccaagcgggcaccatatgctcgccccaatttcctacagaatactgctcgggcagcagaagtttggatggatgaatacaaagagcacttctacaatagaaaccctccagcaagaaaagaagcttatggtgatatttctgaaagaaaattactacgagagcggttgagatgcaagagctttgactggtatttgaaaaacgtttttcctaatttacatgttccagaggatagaccaggctggcatggggctattcgcagtagagggatctcgtctgaatgtttagattataattctcctgacaacaaccccacaggtgctaacctttcactgtttggatgccatggtcaaggaggcaatcaattctttgaatatacttcaaacaaagaaataaggtttaattctgtgacagagttatgtgcagaggtacctgagcaaaaaaattatgtgggaatgcaaaattgtcccaaagatgggttccctgtaccagcaaacattatttggcattttaaagaagatggaactatttttcacccacactcaggactgtgtcttagtgcttatcggacaccggagggccgacctgatgtacaaatgagaacttgtgatgctctagataaaaatcaaatttggagttttgagaaatagagcacaacagcactttcgtcatgagctgacagtagtgtcaagaaagtcaaagagccttaagagcctcagtgaagattgtattttattttatcaaaagccacctagcagtcatctgtggagcactggaaagctggggttcattttggtatatcacactg

SEQ ID NO: 5747 - DNA, 5436 bp, Homo sapiens
acttcctgacatcaaaccagggagaacgcgagtgttagttaacatggcttggtgtgtggccacagctgacccggcgcatacctcccgtcctctctttacagggctggcggtgtctcggggctcggctggccatgcctggagcgcggggtttgactgggccgccgttgttgtagtgaccgggaggcgctgccgctctgggcagacggttccgggagccgcacggtcccctctccttccccatcctctcccctcccctctccgggttcccccacccacaggagccttgggccgaccactcccccgatggcctcagccacggaggaccccgttctggagcgttatttcaaaggccacaaagctgcgatcacctccttggacctcagccccaacggcaagcaacttggagccggccgtgccagggagctggggtcaagaaggctctcagacctccagaaaaatacggaggatttgtctcgaccgctttataagaagccccctgcagattcccgtgcacttggggagtgggggaaagccagcaaactccagctcaacgaggatgaactgaagcagcaagaagaactcattgagagatacgccatcaatatttacctcagtgacaggatttccctgcatcgacacatagaggataaaagaatgtatgagtgtaagtcccagaagttcaactataggacacttcctaccacctctgttatcattgctttctataacgaagcctggtcgactttgctccgtaccattcacagtgttttagaaacttctcctgcagttcttttgaaagagatcatcttggtggatgacttgagtgacagagtttatttgaagacacaacttgaaacttacatcagcaatcttgatagagtacgcttgattaggaccaataagcgagaggggctggttagggcccgtctgattggggccactttcgccactggggacgtcctcactttcctggattgtcactgtgagtgtaattccggttggctggaaccgcttttggaaaggattgggagagatgaaacagcagttgtgtgtcctgttatagacacaattgattggaatacttttgaattctatatgcagataggggagcccatgattggtgggtttgactggcgtttaacatttcagtggcattctgtccccaaacaggaaagggacaggcggatatcaagaattgaccccatcagatcacctaccatggctggaggactgtttgctgtcagcaagaaatattttcagtaccttggaacgtatgacacaggaatggaagtgtggggaggtgaaaaccttgagctgtcttttagggtgtggcagtgtggtggcaaattggagatccacccgtgttcccacgtgggccatgtgttccccaagcgggcaccatatgctcgccccaatttcctacagaatactgctcgggcagcagaagtttggatggatgaatacaaagagcacttctacaatagaaaccctccagcaagaaaagaagcttatggtgatatttctgaaagaaaattactacgagagcggttgagatgcaagagctttgactggtatttgaaaaacgtttttcctaatttacatgttccagaggatagaccaggctggcatggggctattcgcagtagagggatctcgtctgaatgtttagattataattctcctgacaacaaccccacaggtgctaacctttcactgtttggatgccatggtcaaggaggcaatcaattctttgaatatacttcaaacaaagaaataaggtttaattctgtgacagagttatgtgcagaggtacctgagcaaaaaaattatgtgggaatgcaaaattgtcccaaagatgggttccctgtaccagcaaacattatttggcattttaaagaagatggaactatttttcacccacactcaggactgtgtcttagtgcttatcggacaccggagggccgacctgatgtacaaatgagaacttgtgatgctctagataaaaatcaaatttggagttttgagaaatagagcacaacagcactttcgtcatgagctgacagtagtgtcaagaaagtcaaagagccttaagagcctcagtgaagattgtattttattttatcaaaagccacctagcagtcatctgtggagcactggaaagctggggttcattttggtatatcacactgaaactgggtacccagagtgctgctgtttaatatttcacaatgccttacttattggttgttttatataagagttttgtcaatatggtctcttcttaaaagaagttgactatgaattgaaacacacaaaacatttaagtgccagacttaatattaaagaatgtaaaggtccaagtaaaatgaggtatgatttatgttgatgtgtaagttcaccgcacatcccactttttaacaaaactcatgaatgtgcagtttgagccattgctattttgattacatagaatttgtatttcttttttagccagcacattaaattttagattttattttttaatctaatttttttctaatcaaaaagaaaattgagcttaaggcaaaaggcctggttttagagatatgtgtaattggaagagggcatttgtttgagtgtgagtttggaggcctttttaacatgcagacatacccatatttaaatgaaatggggagatatttacattccgtactttgtaaacttgagctattggacttcactgatgtatatattaatacctcagattcctctgattttgtaagctgtcttctctgtgaacgtgtttgtgtgtgtagggcattttctgattgcacttccttaagttatgaatgtactagaaagggactcatccagaatactatgcctccctttgttaatgcttaatcatttaaagtaaacacaattgaagcctctctgaagttaaacccaactatgtttattaaaatgtgtgaaactgaaagtgggctaggttctaccaaggctgtggaactctcctacgagttctgctgatcaggaaatttaagaatttatcttaaaaatgcaaggaaaaaagactgccttggcaattgtgaatggtgctttcaatctcctagcaccgagcctggcacttaggcagctttcagtaagtgggtgaatgaatgactgaatgaatgaatgaatggctcagctgaggaatgtaactttggtcaagttattatgatgtgtttgggcttagttttctcattggtaaaatgtgggtgctggattggatcttaaagatcccttccagctctgaaatgctgattgtacagtatattcttcccagattgactcactgtgcaatctttacaatactttttatcttttcacttttgacataggtaatgttgttgagcagttgagcaatgttcagtccagttgtgaagctggagaagagaaatgggttttaaaaattaagtgaggggaggccgggtgcggtggctcacgcatgtaatcccagcactttgggaggccaaggcaggtggatcacgaggtcaggagatccagaccatcctggctaacatggtgaaacctcgtctctactaaaaatacaaaaaattagccagctgtggtggcgggcgcctgtagtcccagctactcaggaggctgaggcaggagaatggcgtgaacctgtgaggcagagcttacagtgagccgagatcgtgccactgcactccagcctgggcgacagagcaagactctgtctcaaaaaaaaaaaataataataaaataagtgagctgaactcacctgaagtggtttacttctgtgggttaagaagttctagtcagtgttcatagtcgtttcgttttgataattgttgaaccaattttgtttttaaaacctttagactctgaaagtaatattttgactaagaatgtaaatatttccaaactaaattactcgggaagtaaacgctttttttaaaagtatttttactggttttataccaatattatatgcagaaatcacaggatgaatttagaattaaatctcaattagttcactttggcctagatttatgaaaaatgcatgcctcgtaaagagtccactgtattcacgagtaaagttgcttttagtgttcacttgatgacttggagagtaggaattttgcaaaatctgaatttaaggaaattctttaggataaccatttcaaaaaataaaattgctatgcaatcttgaatattttctcttttgcctcgtaaaatgaaaatgcattcacagtttctgtaaattatttagcagccttaaagtttatcaaaaaattgtccagattccacgtgcagcatgcttggccctgcatttaatttaagaaggattaataataatgctctgaatttttcgaaagggattctcctaaacccacccacttctcttgcccaggctgctttttaaaaatatttttttattttttacttatttttaaattttctctttttatttatttttggttttcttgttagccacctgttatatgggagaacgaaaattgttatattttgaaagtacttattacattatttttattttagtatcttgatgctcctgtcaaaagggaaatgaggcttttaaaaataaagtaccttaattctttattgactttttgccctaaattgctaggtgtgacccagcaatcttttaggaagagattttacagtggtgctttatttatatcaataatccagtatagttaggctgttcattcctcataatagagtacataacagaaaagtgggactttcacattttcatatttaggcacgttccaatttaattccaaaaatactctgtaattctacatctaaaaaaaccgattccctaattcgaatttattggtaccaaagctctctttggctatagacaattaagagttgaccttttaagttaatgtatatgcttaaaaacagttttaggaaaatatttggtagacaaagagtttcaactttaaatgttcactatgtcatttagtgtccaactttacggataggttgactatctaaataggcatttttagtcattaaaaaaaatctagtcaccaggaggatccctatgactcaaaataacttgtttgtaaaagaaaatttgtttacttacccattagtaagttcctgcatattcattataagatggcaaatcaaacttttctaggatgaagacagcttatttttaagttgtatagtcttagttggtttagggtctcaattttaattaataaaatacttggtttttatttgcttgtccttttgaattcctgttttaataattttaaaatgagcacaaagaacgttgaagttcagattaatctcttctgaatgatgtttttttcctctgtgatgagttgtttctgacttttttccttttgtatttgtaatgttgattaagatgtaaaataaaaagtgtgcctgattatttttgcaaataga

SEQ ID NO: 5748 - DNA, 2357 bp, Homo sapiens
agctccgggccggaccctccctcctcccaccacgtgtcctccccgctccctcccgaggggccgcgcgcacgggaggacggagaggcggaaaggatggcgctgtgacagccgggccggagccctcgcgtccccaccccgcgccctggccgctgggcccggcgagatggagtccacagcctaccctctcaatttgagcctgaaagaagaggaagaggaagaagagattcagagccgggaactagaggacggcccggcagacatgcagaaagtacgaatctgctctgagggcggatggaaaatgaagaatctgacgtaaagcctccagactggccaaacccaatgaatgctacctcccagtttcctcagcctcagcactttgacagctttggcctccgtctgcctcgggatatcacagagctgcccgagtggagtgaggggtaccccttctacatggccatgggcttcccagggtatgacctctcggctgatgacatagctgggaagtttcagttcagccggggcatgcgccgcagttacgacgcagggttcaagctgatggtagtggaatatgctgagagtaccaacaactgccaggctgccaagcagtttggagtattggaaaaaaacgttcgagactggcgcaaagtgaagccacagcttcaaaacgcccacgccatgcggcgggcattccgaggccccaagaatgggaggtttgctctggtggaccagcgtgtggccgaatatgtcagatacatgcaggccaaaggggaccccatcacccgggaggcgatgcagctgaaagctctcgaaatcgcccaggaaatgaacattccagagaaagggttcaaggcaagcttgggttggtgtcgaagaatgatgagaaggtatgacctgtctctgaggcataaagtgcccgtgccccagcacctgccggaagacctgactgagaaactcgtcacttaccagcgcagtgtcctggctctgcgcagggcgcatgactatgaggtagctcagatggggaatgcagatgagacgcccatttgtttagaggtgccatcacgggtaactgttgataaccagggcgaaaagcctgtcttggtcaagacaccaggcagggaaaaactgaaaatcacagcaatgcttggtgtcttggctgatgggaggaagttaccaccgtacatcattttgaggggaacatatatccccccggggaagtttcccagtgggatggaaattcgctgccaccggtatgggtggatgactgaagacttgatgcaggactggttggaagtggtgtggagacggaggacaggagcagtgcccaagcagcgagggatgctgatcttgaatggcttccggggccatgccacagattccgtgaagaactccatggaaagcatgaacactgacatggtgatcatcccagggggtctgacctcacagcttcaggtgctggatgtcgtggtctacaagccactgaatgacagtgtgcgggcccagtactccaactggcttctggctgggaacctggcgctgagcccaaccgggaatgctaagaagccacccctgggcctctttctggagtgggtcatggtcgcgtggaatagcatctcaagtgagtccatcgtccaagggttcaagaagtgccatatctccagcaacttggaggaggaagacgatgtcctgtgggaaatcgagagtgagttgccaggaggaggagaaccaccaaaagattgtgacaccgaaagcatggctgagagcaactgaagggaaagggaaagcaaatggaactctgatttaaacagctggggatgaaattcctcaagatgattattcctgaaagtgtggatgcgctggatgcgcagggaacatcaggaaaaggccacggggctctgaacagccccggtccagacagcagcctgtacatccatcccaggacacagcccagcccctccccacaccatacaaggtatcagaaaagtctaggacctatcatttcatcagagacatgatcagaaaagaaactgcttctgccccatttcttgttttggagattactccatctgtccatcaaaagaaacctgtaaatatgaaagaacaaaggttatttcctggagaaaagacaatttattcaacaccaacgagggactcatcatatgggcacaactctggtgtccttctatggagaaaacctcaagtaaagttttattctgcctttgaaaatgcttccaaaagtagaccctgtccccacacaggtcaagactacagagaaggctttgtagaaatgtgtcacctatgtacacctgctacttacacatttcctcttttggaaaaatgagatacttagaataacaaga

SEQ ID NO: 5749 - DNA, 1933 bp, Homo sapiens
ctcagagcggccccggagcggccgcagcgcggtggtctcggcccggctgcgccagagtccgcgcgatggagccccggccgcggcggcggcgcaggagtcgccccctggtcgccgccttcctgcgagacccgggctcgggccgcgtgtacaggcgcgggaagctgatcggcaagggcgccttcagccgctgctacaagctgacagacatgtccaccagcgccgtgttcgccctcaaggtggtgccgtgtggcggggctggggccgggtggcttcgcccgcagggaaaggtggagcgtgagattgccctgcatagccgcctgcgaccccgcaacatcgtggctttccacggacactttgctgaccgcgaccacgtgtacatggtgctggagtactgcagccgccagtctttggcccacgtgctgagggcgcggcagatcctgacggagccagaagtgcgcgactacctgcggggcctggtcagcggcctgcgctacctgcaccagcggtgcatcctgcaccgcgacctgaagctcagtaacttcttccttaacaagaacatggaggtgaagattggagacctgggactggcggccaaggtggggccagggggccgctgccacagagtactctgtgggacccctaacttcctggaccctgaggttgtctccagaaacggtcactcctgccagtaggacatctgggctctgggctgcatcatgtacacggtgctgactggcaccccacccttcatggcctcacccctgtcggagatgtaccaaaacatccgtgagggccactaccccgaacccgctcacctgtctgccaatgcgcgccgcctcatcgtgcacctcctagcacccaacccggccgagcggcccagcctggaccacctgctgcaggacgacttcttcacacagggtttcactccagaccggctgccggcccactcctgccacagtccccccatcttcgccatacccccgcctctgggcaggatcttccggaaggtgggccagcggctgctcacccagtgccggccaccctgccccttcacgcctaaagaggcctcgggtccaggagaaggtgggccagaccctgactccatggagtgggacggcgagagctccctgtctgcgaaagaggttccctgcctggaaggccccatccacctggtcgcacaagggaccctgcagagtgacctggccgggcccgaggggagccggcggccagaggtggaggcggccctcagacacctgcagctgtgcctggatgtaggccccccggccacacaggaccccctgggagagcagcagcccatcctctgggcccccaaatgggtggattattccagcaaatacggctttggctaccagctcttggacggggggcgcacgggacggcacccacatggccctgcgaccccccggagggaggggaccctccccacacctgtgccacctgctggacccggcctctgcctcctgcgcttcctggcctctgagcacgccctgctgctgctgttcagcaatgggatggtgcaggtgagcttcagtggagtcccggcccaactggtgctgagtggcgagggtgagggtttgcagctcaccctctgggagcaggggtcccctggcacctcctactccctggacgtcccgcggagccacggctgcgcccccaccaccggacagcaccttcaccacgccctccgcatgctgcagagtatctagtgcccctgagggtcagagtggacccctgcatggtagtgccagggacccaggctccatttccattcctgtggctcccccagaggggctgtcctgggggagggctggggggcacacgggaggtgggttcttgccttgtggcatgactgttcaacccagactttgctgggatctcttcctttttcattaaagacaatttgaaatgctgt

SEQ ID NO: 5750 - DNA, 2855 bp, Homo sapiens
gggtgcgcgacctcgcccgccaggcccggcccccgccccttggcctgccgctccgcccccgcggggcgtcccgggccgctcgtcccgtcggctgcggccgcgcgcggcccggggtcgccgtgagtactcgccaggctggcctgtgtggccgccaccacgggcacagggcggtgcggccgggccacgggaagggtgcggggctcgccccgtctccgcaggggtggacgaacaacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggcaggtctcctgtgccctcagcacgtgggcctccctcccccagcacggacctctcctttggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcagctgcatggagcagcctatggcaaaggcatctacctgagccccatctccagtatttcctttggatactcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgga

SEQ ID NO: 5751 - DNA, 4424 bp, Homo sapiens
gggagggggaggaggaaggccttcgtaaaggttgcatctccgtcccttcgctcccggggacccgcgggaaaaaaaaaaatccaacacccaggccccgcggctagccccttcccacaggctctctccgctcgattttgtcaccgttatgtgggaagcgaatccagagatgtttcacaaagcagaagaattattttctaaaacaacaaacaatgaagtggatgacatggacacgtcagatacccagtggggctggttttacttggcagaatgtgggaagtggcacatgtttcagccggataccaacagtcagtgttcagttagcagtgaagatatcgaaaaaagcttcaaaacaaacccttgtggctccatttcttttactacttccaaattcagctacaagatagactttgcagaaatgaagcaaatgaatctcaccactggaaagcagcgcttaataaaaagagcccccttttctatcagtgctttcagttacatctgtgaaaacgaggccatccctatgccaccacactgggagaatgtgaatactcaagtaccatatcagcttattcctctgcacaatcaaacacatgaatataatgaagttgctaatctctttgggaagacgatggatcgcaaccgaattaaaagaattcagagaattcaaaacctagatttgtgggagttcttttgcaggaaaaaggctcagctcaagaaaaaaagaggtgtgcctcagattaatgaacaaatgctgtttcatggtaccagcagtgaatttgtggaagcaatctgcattcataactttgattggagaataaatggtatacatggtgctgtctttggaaaaggaacctattttgctagagatgctgcttattccagtcgtttctgcaaagatgacataaagcatgggaacacattccaaattcatggtgtcagcttgcaacagcggcatctgtttagaacatataaatctatgtttcttgctcgagtgctaattggagattacataaacggagactccaaatacatgcgacctccttccaaagacgggagctatgtgaatttatatgacagctgtgtggatgatacctggaacccaaagatctttgtggtttttgatgccaaccaaatctatcctgagtacttgatagactttcattgatttcacttccaaatctcggtggtcaaggaagctttattcttttttgcaggaaggtttgctcttcagtcatctagccactaaatgttaattatctgatacttttgaaacagatatgaaaaaaagtggcctccatataaaaagacatactgacttcaaggttggtttttgttgttttgtttttgcctgtttcttgtagtcttgtttgttaaaagttgatatcattgatgttttaacacataggggtgaaagataccattcaaaatggaatcagctgagtctcaactaatgtggtcattgagatctttaaagtttacgtgtgtgttatcaggataaatgattttagtttaaatagacttattcgtataaatgttgaaaaaaaatacagacataaatgtgtccctttagaggaattgatcctttgtaaattgaattcaggtagtagtatcatccaccaatccatctgttgctttgttggtcttctgaaggggggatttaaaactctgaaacagtctgagcaccttgagagaaatcagaaacaagacaattatttgcagtgctgtcaaacaagccagaaggagaaaatcaaggtagaatgccccactttccagttgccttaggatagcaggctgcagcctcagacttgatcctgtcattctcctctgtctcccacatctgaattgataattgctgcaaaatgtcattagcctacacttcatccatcagggctcttggattcttacaccacgacttgctgtgcaaggtgtttattgcatcttcaaagtgaaactttaaattattattcaaacatttattttccttttgttttaaaaagagtccctacaatgatcacttctaagatttttttttaccttcccctctgcagcacacacagctattcaacaatgatttctaaaattcatatttcaaatttgtatctctccattttgaaacattatagaaagcatgggatgcttgagacaaatctggtttctcctttgaagtagctgttgacaacctactctcttgaaaagttagatataattcttaatcatgtttagtggaaatttgtttacctgttccatctgttttgctgtttcattgtaaggaagatgagaagtgttggaacagcttccctcccctaaaggtattctagcagaggcgagacagcaacttggcgggcatgttgcataggagttaagtaccagatggggaattgcccatgtgatggtgaagagtctctcacattgattttcttccttttctcctcttctctcctccttctcttctctcctctttctcttctcttctttctcttctcttctgtcttcctcttcctcttctcttcctctcctcttcctctttctctctcttcctttttctcttcctctttctctttctctttctcttctcttctctctctcttccttccttctttctttccttccttccttccttccttccttccttccttccttctttccctccctccctccctccctcctccctttttctttttctttctttttttttggtttggcagagtcttgctctgttgcccaggctgcagtgcagtggtgtgatctcggctcactgcaacctccacctcccgggttcaagcaattctcttgcctcagcttctccagttactgggactacaggtgcataccaccatgcccggctaatttttgtatttttagtagaggcggggttttgtcatgttggccaggctgatctcaaactcctgacctcaggtgatccgcctgcctcagccttccaaagtgctgagattacaggcatgagccgctgtacccggcctgattttctatgattctgcctttaaaagacagcacgtataccaagcctttttcagaaagcttttctcttaactccttctaatgctgaattttctctctattatcctcacccaattttggctgagagttagtgtacacaatttaacttcttagaaaaattccagtgtctatgcttatattgctcacttgaatcatttgaattagaaagggatctacaaataataaaagcaaagagtgcagacagattagggatagtaattcttaaagtgccatctatcccagatttccgttatagaccagcatatgtgtaattgtgcagtgggaggtaagtagtacccaggacattgcatgtacaatactttgaaacaaagtggcaacaaagatttcctggctcaggtatgcaccccagctgctggtttagatgaagtgctgagaatatttagaaaaagcgctttaaaaagcatctagagattatcatgaaaataattggagacaaagtcactaggctgctttgtgagaggcagcataccatggctctaaacccgttcacaaaaaacaatgttagagacattaggaattcaggttttgaaaatctttttttcgatttatttgtaatttacataccaaaaaaccacattaaaatagtcctcccttcaacatggctatcttttttcaagttttatatgcatagctctctcagcacttgaatggaaaaactgttacagcatttgggagttgtttttcttttagactttgcagatcttatctcaaggtgactaggaacccagagctaagtatctgtgaggcaatctctgcgaacgctgaacttacctagttggtttctatgaaatatgtagaatgcactgcagtagccattgtaagaaggtactataccggttttttggggcttgttgttgttgtttggtctgagaatgtactgccaacccctcttttataagagagaactgattttgatacatattttaaaatatgatagtacagagttaatggatgttaaaattttatttctttgttttggtaagtagattaaatcgagaatcatataatcagtacatttgagaattatataaccagtatataataatactggacacaaccatttgccatcttttcctgttatcatcccatagagtgggtggggagaatgaatagacataaacctagaataatgataaatggtttttaaaactctatattgaatacattccagctgataatgacttttctttttcaccttggtgatatcagcctcagggtaaaaaaaaaagtttcataaatcttttagttataaacaggaaagttttatattagtgtgtcatttcatttctagactgttgatggtgatgatgataaagaatttggagccaattttgatatatgaatgtattgcttttacatgtgatgattaaagctctccattagcagtt

SEQ ID NO: 5752 - DNA, 933 bp, Homo sapiens
agatctgactggccaacgtcgggcggaagtcgggaggttgggtggtctgtaaacgctggcttgtgacagggagggggaggaggaaggccttcgtaaaggttgcatctccgtcccttcgctcccggggacccgcgggaaaaaaaaaaatccaacacccaggccccgcggctagccccttcccacaggctctctccgctcgattttgtcaccgttatgtgggaagcgaatccagagatgtttcacaaagcagaagaattattttctaaaacaacaaacaatgaagtggatgacatggacacgtcagatacccagtggggctggttttacttggcagaatgtgggaagtggcacatgtttcagccggataccaacagtcagtgttcagttagcagtgaagatatcgaaaaaagcttcaaaacaaacccttgtggctccatttcttttactacttccaaattcagctacaagatagactttgcagaaatgaagcaaatgaatctcaccactggaaagcagcgcttaataaaaagagcccccttttctatcagtgctttcagttacatctgtgaaaacgaggccatccctatgccaccacactgggagaatgtgaatactcaagtaccatatcagcttattcctctgcacaatcaaacacatgaatataatgaagttgctaatctctttgggaagacgatggatcgcaaccgaattaaaagaattcagagaattcaaaacctagatttgtgggagttcttttgcaggaaaaaggctcagctcaagaaaaaaagaggtgtgcctcagattaatgaacaaatgctgtttcatggtaccagcagtgaatttgtggaagcaatctgcattcataactttgattggagaataaatggtatacatggtgctgtctttggaaaagataacatgtggaagctgtag

SEQ ID NO: 5753 - DNA, 4406 bp, Homo sapiens
ccttcgtaaaggttgcatctccgtcccttcgctcccggggacccgcgggaaaaaaaaaaatccaacacccaggccccgcggctagccccttcccacaggctctctccgctcgattttgtcaccgttatgtgggaagcgaatccatgtatttgcatgcccgagtctttgagccgtgctataccagtttgtccagattgtttatactagcaatgcagtttacggtgaagacctgccttccctctgggaatctggagcttcagtaacaggagatgtttcacaaagcagaagaattattttctaaaacaacaaacaatgaagtggatgacatggacacgtcagatacccagtggggctggttttacttggcagaatgtgggaagtggcacatgtttcagaaatgaagcaaatgaatctcaccactggaaagcagcgcttaataaaaagagcccccttttctatcagtgctttcagttacatctgtgaaaacgaggccatccctatgccaccacactgggagaatgtgaatactcaagtaccatatcagcttattcctctgcacaatcaaacacatgaatataatgaagttgctaatctctttgggaagacgatggatcgcaaccgaattaaaagaattcagagaattcaaaacctagatttgtgggagttcttttgcaggaaaaaggctcagctcaagaaaaaaagaggtgtgcctcagattaatgaacaaatgctgtttcatggtaccagcagtgaatttgtggaagcaatctgcattcataactttgattggagaataaatggtatacatggtgctgtctttggaaaaggaacctattttgctagagatgctgcttattccagtcgtttctgcaaagatgacataaagcatgggaacacattccaaattcatggtgtcagcttgcaacagcggcatctgtttagaacatataaatctatgtttcttgctcgagtgctaattggagattacataaacggagactccaaatacatgcgacctccttccaaagacgggagctatgtgaatttatatgacagctgtgtggatgatacctggaacccaaagatctttgtggtttttgatgccaaccaaatctatcctgagtacttgatagactttcattgatttcacttccaaatctcggtggtcaaggaagctttattcttttttgcaggaaggtttgctcttcagtcatctagccactaaatgttaattatctgatacttttgaaacagatatgaaaaaaagtggcctccatataaaaagacatactgacttcaaggttggtttttgttgttttgtttttgcctgtttcttgtagtcttgtttgttaaaagttgatatcattgatgttttaacacataggggtgaaagataccattcaaaatggaatcagctgagtctcaactaatgtggtcattgagatctttaaagtttacgtgtgtgttatcaggataaatgattttagtttaaatagacttattcgtataaatgttgaaaaaaaatacagacataaatgtgtccctttagaggaattgatcctttgtaaattgaattcaggtagtagtatcatccaccaatccatctgttgctttgttggtcttctgaaggggggatttaaaactctgaaacagtctgagcaccttgagagaaatcagaaacaagacaattatttgcagtgctgtcaaacaagccagaaggagaaaatcaaggtagaatgccccactttccagttgccttaggatagcaggctgcagcctcagacttgatcctgtcattctcctctgtctcccacatctgaattgataattgctgcaaaatgtcattagcctacacttcatccatcagggctcttggattcttacaccacgacttgctgtgcaaggtgtttattgcatcttcaaagtgaaactttaaattattattcaaacatttattttccttttgttttaaaaagagtccctacaatgatcacttctaagatttttttttaccttcccctctgcagcacacacagctattcaacaatgatttctaaaattcatatttcaaatttgtatctctccattttgaaacattatagaaagcatgggatgcttgagacaaatctggtttctcctttgaagtagctgttgacaacctactctcttgaaaagttagatataattcttaatcatgtttagtggaaatttgtttacctgttccatctgttttgctgtttcattgtaaggaagatgagaagtgttggaacagcttccctcccctaaaggtattctagcagaggcgagacagcaacttggcgggcatgttgcataggagttaagtaccagatggggaattgcccatgtgatggtgaagagtctctcacattgattttcttccttttctcctcttctctcctccttctcttctctcctctttctcttctcttctttctcttctcttctgtcttcctcttcctcttctcttcctctcctcttcctctttctctctcttcctttttctcttcctctttctctttctctttctcttctcttctctctctcttccttccttctttctttccttccttccttccttccttccttccttccttccttctttccctccctccctccctccctcctccctttttctttttctttctttttttttggtttggcagagtcttgctctgttgcccaggctgcagtgcagtggtgtgatctcggctcactgcaacctccacctcccgggttcaagcaattctcttgcctcagcttctccagttactgggactacaggtgcataccaccatgcccggctaatttttgtatttttagtagaggcggggttttgtcatgttggccaggctgatctcaaactcctgacctcaggtgatccgcctgcctcagccttccaaagtgctgagattacaggcatgagccgctgtacccggcctgattttctatgattctgcctttaaaagacagcacgtataccaagcctttttcagaaagcttttctcttaactccttctaatgctgaattttctctctattatcctcacccaattttggctgagagttagtgtacacaatttaacttcttagaaaaattccagtgtctatgcttatattgctcacttgaatcatttgaattagaaagggatctacaaataataaaagcaaagagtgcagacagattagggatagtaattcttaaagtgccatctatcccagatttccgttatagaccagcatatgtgtaattgtgcagtgggaggtaagtagtacccaggacattgcatgtacaatactttgaaacaaagtggcaacaaagatttcctggctcaggtatgcaccccagctgctggtttagatgaagtgctgagaatatttagaaaaagcgctttaaaaagcatctagagattatcatgaaaataattggagacaaagtcactaggctgctttgtgagaggcagcataccatggctctaaacccgttcacaaaaaacaatgttagagacattaggaattcaggttttgaaaatctttttttcgatttatttgtaatttacataccaaaaaaccacattaaaatagtcctcccttcaacatggctatcttttttcaagttttatatgcatagctctctcagcacttgaatggaaaaactgttacagcatttgggagttgtttttcttttagactttgcagatcttatctcaaggtgactaggaacccagagctaagtatctgtgaggcaatctctgcgaacgctgaacttacctagttggtttctatgaaatatgtagaatgcactgcagtagccattgtaagaaggtactataccggttttttggggcttgttgttgttgtttggtctgagaatgtactgccaacccctcttttataagagagaactgattttgatacatattttaaaatatgatagtacagagttaatggatgttaaaattttatttctttgttttggtaagtagattaaatcgagaatcatataatcagtacatttgagaattatataaccagtatataataatactggacacaaccatttgccatcttttcctgttatcatcccatagagtgggtggggagaatgaatagacataaacctagaataatgataaatggtttttaaaactctatattgaatacattccagctgataatgacttttctttttcaccttggtgatatcagcctcagggtaaaaaaaaaagtttcataaatcttttagttataaacaggaaagttttatattagtgtgtcatttcatttctagactgttgatggtgatgatgataaagaatttggagccaattttgatatatgaatgtattgcttttacatgtgatgattaaagctctccattagcagtt

SEQ ID NO: 5754 - DNA, 4371 bp, Homo sapiens
agatctgactggccaacgtcgggcggaagtcgggaggttgggtggtctgtaaacgctggcttgtgacagggagggggaggaggaaggccttcgtaaaggttgcatctccgtcccttcgctcccggggacccgcgggaaaaaaaaaaatccaacacccaggccccgcggctagccccttcccacaggctctctccgctcgattttgtcaccgttatgtgggaagcgaatccagagatgtttcacaaagcagaagaattattttctaaaacaacaaacaatgaagtggatgacatggacacgtcagatacccagtggggctggttttacttggcagaatgtgggaagtggcacatgtttcagaaatgaagcaaatgaatctcaccactggaaagcagcgcttaataaaaagagcccccttttctatcagtgctttcagttacatctgtgaaaacgaggccatccctatgccaccacactgggagaatgtgaatactcaagtaccatatcagcttattcctctgcacaatcaaacacatgaatataatgaagttgctaatctctttgggaagacgatggatcgcaaccgaattaaaagaattcagagaattcaaaacctagatttgtgggagttcttttgcaggaaaaaggctcagctcaagaaaaaaagaggtgtgcctcagattaatgaacaaatgctgtttcatggtaccagcagtgaatttgtggaagcaatctgcattcataactttgattggagaataaatggtatacatggtgctgtctttggaaaaggaacctattttgctagagatgctgcttattccagtcgtttctgcaaagatgacataaagcatgggaacacattccaaattcatggtgtcagcttgcaacagcggcatctgtttagaacatataaatctatgtttcttgctcgagtgctaattggagattacataaacggagactccaaatacatgcgacctccttccaaagacgggagctatgtgaatttatatgacagctgtgtggatgatacctggaacccaaagatctttgtggtttttgatgccaaccaaatctatcctgagtacttgatagactttcattgatttcacttccaaatctcggtggtcaaggaagctttattcttttttgcaggaaggtttgctcttcagtcatctagccactaaatgttaattatctgatacttttgaaacagatatgaaaaaaagtggcctccatataaaaagacatactgacttcaaggttggtttttgttgttttgtttttgcctgtttcttgtagtcttgtttgttaaaagttgatatcattgatgttttaacacataggggtgaaagataccattcaaaatggaatcagctgagtctcaactaatgtggtcattgagatctttaaagtttacgtgtgtgttatcaggataaatgattttagtttaaatagacttattcgtataaatgttgaaaaaaaatacagacataaatgtgtccctttagaggaattgatcctttgtaaattgaattcaggtagtagtatcatccaccaatccatctgttgctttgttggtcttctgaaggggggatttaaaactctgaaacagtctgagcaccttgagagaaatcagaaacaagacaattatttgcagtgctgtcaaacaagccagaaggagaaaatcaaggtagaatgccccactttccagttgccttaggatagcaggctgcagcctcagacttgatcctgtcattctcctctgtctcccacatctgaattgataattgctgcaaaatgtcattagcctacacttcatccatcagggctcttggattcttacaccacgacttgctgtgcaaggtgtttattgcatcttcaaagtgaaactttaaattattattcaaacatttattttccttttgttttaaaaagagtccctacaatgatcacttctaagatttttttttaccttcccctctgcagcacacacagctattcaacaatgatttctaaaattcatatttcaaatttgtatctctccattttgaaacattatagaaagcatgggatgcttgagacaaatctggtttctcctttgaagtagctgttgacaacctactctcttgaaaagttagatataattcttaatcatgtttagtggaaatttgtttacctgttccatctgttttgctgtttcattgtaaggaagatgagaagtgttggaacagcttccctcccctaaaggtattctagcagaggcgagacagcaacttggcgggcatgttgcataggagttaagtaccagatggggaattgcccatgtgatggtgaagagtctctcacattgattttcttccttttctcctcttctctcctccttctcttctctcctctttctcttctcttctttctcttctcttctgtcttcctcttcctcttctcttcctctcctcttcctctttctctctcttcctttttctcttcctctttctctttctctttctcttctcttctctctctcttccttccttctttctttccttccttccttccttccttccttccttccttccttctttccctccctccctccctccctcctccctttttctttttctttctttttttttggtttggcagagtcttgctctgttgcccaggctgcagtgcagtggtgtgatctcggctcactgcaacctccacctcccgggttcaagcaattctcttgcctcagcttctccagttactgggactacaggtgcataccaccatgcccggctaatttttgtatttttagtagaggcggggttttgtcatgttggccaggctgatctcaaactcctgacctcaggtgatccgcctgcctcagccttccaaagtgctgagattacaggcatgagccgctgtacccggcctgattttctatgattctgcctttaaaagacagcacgtataccaagcctttttcagaaagcttttctcttaactccttctaatgctgaattttctctctattatcctcacccaattttggctgagagttagtgtacacaatttaacttcttagaaaaattccagtgtctatgcttatattgctcacttgaatcatttgaattagaaagggatctacaaataataaaagcaaagagtgcagacagattagggatagtaattcttaaagtgccatctatcccagatttccgttatagaccagcatatgtgtaattgtgcagtgggaggtaagtagtacccaggacattgcatgtacaatactttgaaacaaagtggcaacaaagatttcctggctcaggtatgcaccccagctgctggtttagatgaagtgctgagaatatttagaaaaagcgctttaaaaagcatctagagattatcatgaaaataattggagacaaagtcactaggctgctttgtgagaggcagcataccatggctctaaacccgttcacaaaaaacaatgttagagacattaggaattcaggttttgaaaatctttttttcgatttatttgtaatttacataccaaaaaaccacattaaaatagtcctcccttcaacatggctatcttttttcaagttttatatgcatagctctctcagcacttgaatggaaaaactgttacagcatttgggagttgtttttcttttagactttgcagatcttatctcaaggtgactaggaacccagagctaagtatctgtgaggcaatctctgcgaacgctgaacttacctagttggtttctatgaaatatgtagaatgcactgcagtagccattgtaagaaggtactataccggttttttggggcttgttgttgttgtttggtctgagaatgtactgccaacccctcttttataagagagaactgattttgatacatattttaaaatatgatagtacagagttaatggatgttaaaattttatttctttgttttggtaagtagattaaatcgagaatcatataatcagtacatttgagaattatataaccagtatataataatactggacacaaccatttgccatcttttcctgttatcatcccatagagtgggtggggagaatgaatagacataaacctagaataatgataaatggtttttaaaactctatattgaatacattccagctgataatgacttttctttttcaccttggtgatatcagcctcagggtaaaaaaaaaagtttcataaatcttttagttataaacaggaaagttttatattagtgtgtcatttcatttctagactgttgatggtgatgatgataaagaatttggagccaattttgatatatgaatgtattgcttttacatgtgatgattaaagctctccattagcagtt

SEQ ID NO: 5755 - DNA, 539 bp, Homo sapiens
agatctgactggccaacgtcgggcggaagtcgggaggttgggtggtctgtaaacgctggcttgtgacagggagggggaggaggaaggccttcgtaaaggttgcatctccgtcccttcgctcccggggacccgcgggaaaaaaaaaaatccaacacccaggccccgcggctagccccttcccacaggctctctccgctcgattttgtcaccgttatgtgggaagcgaatccatgtatttgcatgcccgagtctttgagccgtgctataccagtttgtccagattgtttatactagcaatgcagtttacggtgaagacctgccttccctctgggaatctggagcttcagtaacaggagatgtttcacaaagcagaagaattattttctaaaacaacaaacaatgaagtggatgacatggacacgtcagatacccagtggggctggttttacttggcagaatgtgggaagtggcacatgtttcagccggataccaacagtcagtgttcagttagcagtgaagatatcgaaaaaagcttcaaa

SEQ ID NO: 5756 - DNA, 2555 bp, Homo sapiens
caacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggcaggtctcctgtgccctcagcacgtgggcctccctcccccagcacggacctctcctttggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgg

SEQ ID NO: 5757 - DNA, 2625 bp, Homo sapiens
aacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggcaggtctcctgtgccctcagcacgtgggcctccctcccccagcacggacctctcctttggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcagctgcatggagcagcctatggcaaaggcatctacctgagccccatctccagtatttcctttggatactcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgga

SEQ ID NO: 5758 - DNA, 1626 bp, Homo sapiens
caacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggcaggtctcctgtgccctcagcacgtgggcctccctcccccagcacggacctctcctttggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactgtggccttcatggtagagcttgacccaagaactactccacattcggatggcccagactga

SEQ ID NO: 5759 - DNA, 2750 bp, Homo sapiens
aacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggtgagaactgactgcccacctctccaactgattgttcaaagggtagaggagacaaagtgcagatctcaccctttcttggtattttcccttctacccttttggaagatagagtggctatttgaagttaaaggaaagggaaggggcacagaaacagtattacttggtgtgtttgtgtagtgggttttcttggggagggagaggagagttaagtactttaaaggatagaaagaaaataatgagacaagagagtttaggtgtgcttgggaactgtcttaggtaatgatcctggaagaggccagcttgtactggaacccagatatgcttaggagtcaaccttgacattgaagtcatttgcatttctttcctactggctaccagagcctctcagtcatcatactgagacttcagaaggccaaaattccctagatgttttcctctgtcccactaagagctagtttatggatatgatcatatcaggaagagactgagactctcacaaagggtgacatgaaaggtgtaaagggatcagggcttcagttattctatatttcccaatctttgtgggaatctgttcctcaccatatcatcccacgcctttccatgggataatagggacctaacaaagcatgatatccttatttctcaccactaggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggtgggtcccacattgagaactggcattcgatcctgcgcaatgggctggtcaatgcatcctacaccaaactgcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatggaaggtgctgtggactgg

SEQ ID NO: 5760 - DNA, 2121 bp, Homo sapiens
caacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagctgctcttgaaggacagtgacttgttaccaccgcaacagcagagcctgccatccccaacagatcaccagttgtccctgacatcgtgccctaccttgtctccctttgtggtctcctaaatgcccatctcgttggccttggttcggctagtggtatggaggggtgctgcctagcactgacctgagagtgtgtgtgacccactgacccaatggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggcaggtctcctgtgccctcagcacgtgggcctccctcccccagcacggacctctcctttggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctcatatttggaaatcaagaaacagatggacaagttggatcccctggcccatcctctcctgcagtggatcatctctagcaacaggtcacacattgtcaaactacctctcagcaggcagctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcagctgcatggagcagcctatggcaaaggcatctacctgagccccatctccagtatttcctttggatactcaggaatgggaaaaggacagcacaggatgccctccaaggatgagctggtccagagatacaacaggatgaataccatcccccagcgccgttccttccagatc

SEQ ID NO: 5761 - DNA, 2341 bp, Homo sapiens
aagagctagtttatggatatgatcatatcaggaagagactgagactctcacaaagggtgacatgaaaggtgtaaagggatcagggcttcagttattctatatttcccaatctttgtgggaatctgttcctcaccatatcatcccacgcctttccatgggataatagggacctaacaaagcatgatatccttatttctcaccactaggacatcaaaggccagttctggaatgatgacgactcggagggagataatgaatcagaggaatttctctatggcgttcaggggagctgtgcagctgacctgtatcgacacccacagcttgatgcagacattgaagccgtgaaggagatctacagtgagaactctgtatccatcagagaatatggaactatcgatgacgtggacattgacctccacatcaacatcagcttcctcgatgaggaagtctctacagcctggaaggtcctccggacagaacctattgtgttgaggctgcgattttctctctcccagtacctagatggaccagaaccatccattgaggttttccagccatcaaataaggaaggatttgggctgggtcttcagttgaaaaagatcctgggtatgtttacatcccaacaatggaaacatctgagcaatgatttcttgaagacccagcaggagaagaggcacagttggttcaaggcaagtggtaccatcaagaagttccgagctggcctcagcatcttttcacccatccccaagtctcccagtttccctatcatacaggactccatgctgaaaggcaaactaggtgtaccagagcttcgggttgggcgcctcatgaaccgttccatctcctgtaccatgaagaaccccaaagtggaagtgtttggctaccctcccagcccccaggtcagtggtcactgcaagaacattcccactctggagtatggattcctcgttcagatcatgaagtatgcagaacagaggattccaacattgaatgagtactgtgtggtgtgtgatgagcagcatgtcttccaaaatggatctatgctgaagccagctgtctgtactcgtgaactatgcgttttctccttctacacactgggcgtcatgtctggagctgcagaggaggtggccactggagcagaggtggtggatctgctggtggccatgtgtagggcagctttagagtcccctagaaagagcatcatctttgagccttatccctctgtggtggaccccactgatcccaagactctggcctttaaccctaagaagaagaattatgagcggcttcagaaagctctggatagtgtgatgtctattcgggagatgacccagggctgtaggaattgcataaaatgagggagacccacctgcatgttgttttggctcatatttggaaatcaagaaacagatggacaagttggatcccctggcccatcctctcctgcagtggatcatctctagcaacaggtcacacattgtcaaactacctctcagcaggctgaagttcatgcacacctcacaccagttcctcctgctgagcagccctcctgccaaggaggctcggttccggaccgccaagaagctctatggcagcacctttgccttccatgggtcccacattgagaactggcattcgatcctgcgcaatgggctggtcaatgcatcctacaccaaactgcagctgcatggagcagcctatggcaaaggcatctacctgagccccatctccagtatttcctttggatactcaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactgagggggccccagccctcgtaccacccctgttaccccaggatccatctgccctcataaaagtgttcaggtacagcagctgaggctgccctgaggaatcaaggggccattaccaaggggcaggaaaaggatatgtaagaggtggccttcatggtagagcttgacccaagaactactccacattcggatggcccagactgactccatcccctgactttccctttgacttcaccctgtttgtaaataaaacaataaaatgg

SEQ ID NO: 5762 - DNA, 7177 bp, Homo sapiens
ttctctcacccaggatcacttccgaaaccacttcgccttcagcccctgcctcggccagaggtttcatttttaactgaatatttacgaaagctggaagcgtgcgaggggggtggggtggggtggaaatagcggctgcttcttttccagggatttatttaatggggatgtgttcaaggcaagagcgaattcagaaggatatcgacgtcgtgatccagaagtccagagctgagaaggactgcctgtttgcagatttcagatactctgactccacctttacttttacctacgttggcggccccagaagtgtatcctactcagtacatgtatctgaagattacccagataatacatatgtgtcaagttcagagaatgatgaagatgtgctagttactacagagccaataccagtaatttttcatagaatagcaacagaattaagaaaaacaaatgacattaactgttgcttatccataaaatccaaattacaaaaggaaaatggggaggaatcaagacagaatagtacagtggaggaagattctgaaggtgacaatgattccgaagaattttattacggagggcaggtgaactatgatggggaactgcacaagcacccacaactggaagctgatttgtcagcagttagagagatatatgggccacatgcagtttctctcagggaatatggagccattgatgatgtagatattgatctgcatatcgatgttagctttcttgatgaggagattgctgtggcttgggaagtaattcgaacagaacctataattgttcgactacactgttcacttacacagtatttaaatggcccagtgcccactgttgatgtctttcagatttccacaaaagagcgatttggattgggacatcagctgaaaaaaatcatgcagacatttgttacacagcagtggaaacagagcaaagaaaaatccaattgcctgcacaataaaaagttgtcagagaagaaagtgaagtctcccctgcatttattttctactttgcgcaggtcgccaagttatcctccccctggttgtggcaaaagcaaatccaaactgaaatctgagcaggacggaatctccaaaacgcataagctgctgcggaggacttgttccagcacagtcaagactgatgatgtgtgtgtcacaaagtcacacaggacctttggccgctccttgtccagcgatcccagggcggagcaggctatgacagcaattaaatcgcacaaacttttgaaccgtccttgccctgcagctgttaagtcagaggaatgcctaactctaaagtcgcatagactattgactcgatcttgttctggagatccacgatgtgagcacaacacaaacttgaagccccataaactgttaagcaggtcttactctagtaatctcagaatggaagaattatatggactgaaaaatcacaaattgctcagcaagtcctactccagtgcccccaagtcatccaaaactgagcttttcaaggaacctaacgcagagggcaggaggctctctcttacctcagggcttattggtatcctaacaccatcttcatcttcatcttctcagcttgctccaaatggtgcaaaatgcattccagtacgagaccgtggcttcctggtgcagacaattgagtttgctgaacagcggatccctgtattaaatgaatattgtgtggtttgtgatgagccacatgtgtttcaaaatggccctatgcttaggcctaccgtatgtgaacgggagctgtgtgtgtttgcttttcaaaccctgggagtaatgaatgaagctgctgatgaaatagcaactggagctcaggtggtagatctactagtatccatgtgtaggtctgcgttggaatctcctagaaaagttgtgattttcgagccatatccttctgtggtagatcctaatgatcctcagatgttggccttcaaccccaggaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagtcacagaaaaaaggacagcaatcccaattcctgcaaagccgtaacttaaaatgcatagccttatgtgaagtgatcacctcatctgacctgcacaaacatggagagatatgggttgtccccaatactgaccatgtctgcacacgattctttttcgtctatgaagacggccaagtgggagatgcaaatattaatacacaagaaggaggcattcacaaagagatcctccgagtaattggtaatcaaactgctactggttaaaggaccaccatttaattaacatgattcgaaagccttcctcgggttcaaagctggattttgaactgaagaagattataaaattatttattgttattataaacaaaattaaccctttgaatactgattttttttcttagtatttctaagtatctcattaaatacctaaaatggtataagatttatcaattgtagggttatggaatctagtaataaaatttcaacagcacttaaactgaagtttgggttgctcatacaataaacagattgaaaaaactgttttgtgctgatatttttatactaaactctttaactggatatttggtattatataccgacattttaggttaccaaaatagaattgagaacattttataatggcatctaaatctatcagatactttgcaataagtatactgtttgcacattctgatgtgctatatcattagtagtatgggcattctaatgttttggaaggggtgttccctattctatttttcttcataaaaaaagaagtaggtcttagaagcagtgctttgccaaaaagtatgtaatatacacatctatacattcatgcatcaaaatgtgtggttgtgaatatatttgtgtatattcacacgtatgttttgacaagaaagatggcttagcttcacaattctatcctcgtttaatggaaagaagataatatttagtaagcaataaatttggacataaatcaagatatgagccagatttaccaccattcattcactgaaaatatttgcagacaatttttctgtttgtctgaagaaattcagcccttttaaaatgttatctaaaagtcataatttggggaacatacatggcctggtagaccgaatctatattcaaatgattatgtatttaaaagaaagacctcagaatttaaagaaaccatatatattttttatttactacaaaaaaattatacaattttatttatgccacaccagcatttttatatttgttcatctaatatctctgcttatttttttcatattgagaaagaacacaaacttgatgcttcttttatattaaaagaccacaaataagtttatagagaacagtaacaccagctctcagcatttccttttcaagagtcataatttcatcaaaatcatttcttattctttgagtcctagagttcttattcatcaagttttaattgacagtgtttattttcccacatgttgtctttggaataaggccattcatgaaagcagtttaattagtgagtctgccactctattcaaaccctgaatcaaggctctatctgattttaatttatgtaaaaaaaaataaaaatgtatagtcatttgcaagtataatgtgataactgctgtgtttatttcctttgtctggcataaaaggtgagaaaaaggtcatacatgttgttaagggtagcagtttaggaagtgttttctaataatttgttttgttatattgcaaataattgatatgccacttatttctgcaagaaaaataggcttgaagtggttgggatattaatcattttgatagtatctacttaaagcattgatctgttttgacttgtggctctgaaccctgggctaggctgagggataatagtagtggagtagggcaaagatataatatcctatccagtgttttgtgaccacttatttgaagattagtgtgggacatgaggaccttgctacttttttgccaagatgctgcaagtctcccaaatcacttcaactgtgtttttaaaacatgtttaagcaacagaattatttttttgaaattagtctatacgttagacagtctatacatgacaaacatgaagatctaatatcaagatttgggagacgggatcttggaactccacctgtttgaccactaggaccactgaggcacctccaataagctctgtagagtgcctccagcataattcaaaatccactgacctaatccattatggctttacttaacattggagtgatccgtaaagaatatagtattggagtctgaactggaacggtaactcgtaagactcaagaaagaccgtttaaggaaaattggcataatacaaactgttcctgttgacttaagaataacagtaggttcacctatctgaggaaattaagtagttgatagtttaatgctaggcatcttttatgataataaagtaagatgtcttcttatgacagttaattgagttgtatcatgatacagaatgacagattttgtttcaaacaattgcgtcagaacctttgtaagcaaatattctaaggagaatcaatcttattttttaattgaactttttgaaattagggatactataataactgataaagatgaatttctgtgtttctaaagaatctaatttcaattactaccattaacatataaatgtgcttccaaaatccaagcaggtccatacaatttagagatttgaacactgttatcatgctttaattcagtcattcattaaaatattatctattcacttatttgatgattccaaacatttgatattgtattgtgtttttataattatttgaaatctgttcaccaatgctttgtaatggttttattaattgtgtagccattgctacttagatagtaacccactgagcaaaggcagtcatttattttcatccttgaagtaggggaagaaaattattaatttattagttctactttttcctgcattgcttattttgtaaacattttactatgaataatctgttctctttcactgtattaaaaggagaagaaaatgaacatttgagaatggaaaaaagtaataatatacaaataatctagtgctataaaatgcattatagtaagacacttttggtgtcttcgagtgcactatgttggaataaattttatacttgttgcttagtaaatctcagtcatacgtttggtttgaagctgtttttttttttaatttgaagtttaattttaaaagtgccacattgtaaaagttaccgttaaatactatgtagtataaaaaaccaacccaagctattgttaatgctctgaatgtttttctttgaaaatttaagtttagagaagaaattccttcatttttctcccctttgctaaaagaaagaaaatctataatatgtaagtctatgaatctttaaataactgaaggaattttagcagtactttgtataataaaaatattttttaaactataacttgccttagagcatggggtttcagaaagttttgacgaaaaactcatcttcattaaagagtctggataacttcatcagatggtaatttaatatgtcatgaaggggacactcaacattgggtcatctaccgtctaaataaatacggatttcatggtggcatttgaagcacattttgcaaacattatgatgttctattgtcttgctgaattctttattataacactacctcaagacaaatgatagactgttggtaaggtaaattgggttttcaatgtcaggaacaaataaaattttgcaaatagaagtcatcaaataattcaacaggaagaccatactggacacagatgttgtcagttacttctggacaatgtggtaacatggatatttcagtcactggtaacaatgtcagggttaacacccaatgaattatttgaaacaatttgggttgcaaaatttgaaattaattagtctattttgagattgattttctacgtgggccaattttatgtccattacctaaagccacaatctcccgctctaaggagttaaaggatgaaaacacccaactgctacactggaatggcagactggatattcaagcattttggcatttaatgcctgctaaatttttgtccgattatatatagatttgatgtatattattacccagtaaattcttcttgggaattttgtatacattatggaatattaggataagtttttgtaggtcagaagaatttcaagtagtttttagacaaaacatatccatgagtgtgaaaaaagctgtgttgacgaatagattacatttcacatttaccagcaagtcagtaaaaaatagtgcttatttacatagtcaatataatttaatgttctaaaaataatatcttcgatctgcccaatatttaatgtatcatttgagatttttaaaaatgcatccgctccattatgtaaacattaagatatgcctatgtttctttaactatacagcctctttacaataaatttcttgatttttgtgcacaggatagtattgcaacctgctatttagcctttggtgccttagaattattataaatatttaacaatatgtacataatgtaaatactgccaagagatcagtaaggccaaatattttctctattcactttttattgctcttgctttctattgctactaaagcctcttttatccagctttgtaatagttccaacattgtagcgaatgtaaatgtttactttcaataaatctgaacttgttcaacaagta

SEQ ID NO: 5763 - DNA, 2809 bp, Homo sapiens
agtcgggggcgcgccgcatcccctcggacgcggcgcagagggacctcgccgccctctagcccttgccttctgcccggccaggcctcccctgacaccaccgaatgtggggctcaagtcctgatcggggttaaaacaaatccactccaggggtagcttttgacgggactttctgtttcagatttcagatactctgactccacctttacttttacctacgttggcggccccagaagtgtatcctactcagtacatgtatctgaagattacccagataatacatatgtgtcaagttcagagaatgatgaagatgtgctagttactacagagccaataccagtaatttttcatagaatagcaacaggaatcaagacagaatagtacagtggaggaagattctgaaggtgacaatgattccgaagaattttattacggagggcaggtgaactatgatggggaactgcacaagcacccacaactggaagctgatttgtcagcagttagagagatatatgggccacatgcagtttctctcagggaatatggagccattgatgatgtagatattgatctgcatatcgatgttagctttcttgatgaggagattgctgtggcttgggaagtaattcgaacagaacctataattgttcgactacactgttcacttacacagtatttaaatggcccagtgcccactgttgatgtctttcagatttccacaaaagagcgatttggattgggacatcagctgaaaaaaatcatgcagacatttgttacacagcagtggaaacagagcaaagaaaaatccaattgcctgcacaataaaaagttgtcagagaagaaagtgaagtctcccctgcatttattttctactttgcgcaggtcgccaagttatcctccccctggttgtggcaaaagcaaatccaaactgaaatctgagcaggacggaatctccaaaacgcataagctgctgcggaggacttgttccagcacagtcaagactgatgatgtgtgtgtcacaaagtcacacaggacctttggccgctccttgtccagcgatcccagggcggagcaggctatgacagcaattaaatcgcacaaacttttgaaccgtccttgccctgcagctgttaagtcagaggaatgcctaactctaaagtcgcatagactattgactcgatcttgttctggagatccacgatgtgagcacaacacaaacttgaagccccataaactgttaagcaggtcttactctagtaatctcagaatggaagaattatatggactgaaaaatcacaaattgctcagcaagtcctactccagtgcccccaagtcatccaaaactgagcttttcaaggaacctaacgcagagggcaggaggctctctcttacctcagggcttattggtatcctaacaccatcttcatcttcatcttctcagcttgctccaaatggtgcaaaatgcattccagtacgagaccgtggcttcctggtgcagacaattgagtttgctgaacagcggatccctgtattaaatgaatattgtgtggtttgtgatgagccacatgtgtttcaaaatggccctatgcttaggcctaccgtatgtgaacgggagctgtgtgtgtttgcttttcaaaccctgggagtaatgaatgaagctgctgatgaaatagcaactggagctcagaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagtcacagaaaaggacagcaatcccaattcctgcaaagccgtaacttaaaatgcatagccttatgtgaagatttcaacgagaagagatatattaagtcggaatggactaggattcctttagaataaagtggttctttaattttattttccacttaacagtgatcacctcatctgacctgcacaaacatggagagatatgggttgtccccaatactgaccatgtctgcacacgattctttttcgtctatgaagacggccaagtgggagatgcaaatattaatacacaagaaggaggcattcacaaagagatcctccgagtaattggtaatcaaactgctactggttaaaggaccaccatttaattaacatgattcgaaagccttcctcgggttcaaagctggattttgaactgaagaagattataaaattatttattgttattataaacaaaattaaccctttgaatactgattttttttcttagtatttctaagtatctcattaaatacctaaaatggtataagatttatcaattgtagggttatggaatctagtaataaaatttcaacagcacttaaactgaagtttgggttgctcatacaataaacagattg

SEQ ID NO: 5764 - DNA, 572 bp, Homo sapiens
acttcgccttcagcccctgcctcggccagaggtttcatttttaactgaatatttacgaaagctggaagcgtgcgaggggggtggggtggggtggaaatagcggctgcttcttttccagggatttatttaatggggatgtgttcaaggcaagagcgaattcagaaggatatcgacgtcgtgatccagaagtccagagctgagaaggactgcctgtttgcagatttcagatactctgactccacctttacttttacctacgttggcggccccagaaggaattcagagcttgctccagggatgtgaggacaaaagatgagtatgacttttaaaaggaattcagaacttgctctagattttgctttcttctcatgtccaccttctttcactttcacttatgcttcttgacaatattttctgcctgctacatggcatttattatgtacagcacatactaacagtactctgcaatctacttaagctttgttctttccacgtttttttggtactactcattagatccttgagccaatcatccatgtctgtttgtactagattgtttcccttagaactct

SEQ ID NO: 5765 - DNA, 7075 bp, Homo sapiens
agagcagtatctcatttctgaacacctggattgtagctttcccttgactgtcaaaggaggtggttttaaaaatcaagccaaacaggtttccatcttttaggaagaccctggaacgtgccagttgattctgaccatttctcatgaacagaaacacctaggaagggagaactgggatttatttaatggggatgtgttcaaggcaagagcgaattcagaaggatatcgacgtcgtgatccagaagtccagagctgagaaggactgcctgtttgcagatttcagatactctgactccacctttacttttacctacgttggcggccccagaagtgtatcctactcagtacatgtatctgaagattacccagataatacatatgtgtcaagttcagagaatgatgaagatgtgctagttactacagagccaataccagtaatttttcatagaatagcaacagaattaagaaaaacaaatgacattaactgttgcttatccataaaatccaaattacaaaaggaaaatggggaggaatcaagacagaatagtacagtggaggaagattctgaaggtgacaatgattccgaagaattttattacggagggcaggtgaactatgatggggaactgcacaagcacccacaactggaagctgatttgtcagcagttagagagatatatgggccacatgcagtttctctcagggaatatggagccattgatgatgtagatattgatctgcatatcgatgttagctttcttgatgaggagattgctgtggcttgggaagtaattcgaacagaacctataattgttcgactacactgttcacttacacagtatttaaatggcccagtgcccactgttgatgtctttcagatttccacaaaagagcgatttggattgggacatcagctgaaaaaaatcatgcagacatttgttacacagcagtggaaacagagcaaagaaaaatccaattgcctgcacaataaaaagttgtcagagaagaaagtgaagtctcccctgcatttattttctactttgcgcaggtcgccaagttatcctccccctggttgtggcaaaagcaaatccaaactgaaatctgagcaggacggaatctccaaaacgcataagctgctgcggaggacttgttccagcacagtcaagactgatgatgtgtgtgtcacaaagtcacacaggacctttggccgctccttgtccagcgatcccagggcggagcaggctatgacagcaattaaatcgcacaaacttttgaaccgtccttgccctgcagctgttaagtcagaggaatgcctaactctaaagtcgcatagactattgactcgatcttgttctggagatccacgatgtgagcacaacacaaacttgaagccccataaactgttaagcaggtcttactctagtaatctcagaatggaagaattatatggactgaaaaatcacaaattgctcagcaagtcctactccagtgcccccaagtcatccaaaactgagcttttcaaggaacctaacgcagagggcaggaggctctctcttacctcagggcttattggtatcctaacaccatcttcatcttcatcttctcagcttgctccaaatggtgcaaaatgcattccagtacgagaccgtggcttcctggtgcagacaattgagtttgctgaacagcggatccctgtattaaatgaatattgtgtggtttgtgatgagccacatgtgtttcaaaatggccctatgcttaggcctaccgtatgtgaacgggagctgtgtgtgtttgcttttcaaaccctgggagtaatgaatgaagctgctgatgaaatagcaactggagctcagaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagtcacagaaaaaaggacagcaatcccaattcctgcaaagccgtaacttaaaatgcatagccttatgtgaagtgatcacctcatctgacctgcacaaacatggagagatatgggttgtccccaatactgaccatgtctgcacacgattctttttcgtctatgaagacggccaagtgggagatgcaaatattaatacacaagaaggaggcattcacaaagagatcctccgagtaattggtaatcaaactgctactggttaaaggaccaccatttaattaacatgattcgaaagccttcctcgggttcaaagctggattttgaactgaagaagattataaaattatttattgttattataaacaaaattaaccctttgaatactgattttttttcttagtatttctaagtatctcattaaatacctaaaatggtataagatttatcaattgtagggttatggaatctagtaataaaatttcaacagcacttaaactgaagtttgggttgctcatacaataaacagattgaaaaaactgttttgtgctgatatttttatactaaactctttaactggatatttggtattatataccgacattttaggttaccaaaatagaattgagaacattttataatggcatctaaatctatcagatactttgcaataagtatactgtttgcacattctgatgtgctatatcattagtagtatgggcattctaatgttttggaaggggtgttccctattctatttttcttcataaaaaaagaagtaggtcttagaagcagtgctttgccaaaaagtatgtaatatacacatctatacattcatgcatcaaaatgtgtggttgtgaatatatttgtgtatattcacacgtatgttttgacaagaaagatggcttagcttcacaattctatcctcgtttaatggaaagaagataatatttagtaagcaataaatttggacataaatcaagatatgagccagatttaccaccattcattcactgaaaatatttgcagacaatttttctgtttgtctgaagaaattcagcccttttaaaatgttatctaaaagtcataatttggggaacatacatggcctggtagaccgaatctatattcaaatgattatgtatttaaaagaaagacctcagaatttaaagaaaccatatatattttttatttactacaaaaaaattatacaattttatttatgccacaccagcatttttatatttgttcatctaatatctctgcttatttttttcatattgagaaagaacacaaacttgatgcttcttttatattaaaagaccacaaataagtttatagagaacagtaacaccagctctcagcatttccttttcaagagtcataatttcatcaaaatcatttcttattctttgagtcctagagttcttattcatcaagttttaattgacagtgtttattttcccacatgttgtctttggaataaggccattcatgaaagcagtttaattagtgagtctgccactctattcaaaccctgaatcaaggctctatctgattttaatttatgtaaaaaaaaataaaaatgtatagtcatttgcaagtataatgtgataactgctgtgtttatttcctttgtctggcataaaaggtgagaaaaaggtcatacatgttgttaagggtagcagtttaggaagtgttttctaataatttgttttgttatattgcaaataattgatatgccacttatttctgcaagaaaaataggcttgaagtggttgggatattaatcattttgatagtatctacttaaagcattgatctgttttgacttgtggctctgaaccctgggctaggctgagggataatagtagtggagtagggcaaagatataatatcctatccagtgttttgtgaccacttatttgaagattagtgtgggacatgaggaccttgctacttttttgccaagatgctgcaagtctcccaaatcacttcaactgtgtttttaaaacatgtttaagcaacagaattatttttttgaaattagtctatacgttagacagtctatacatgacaaacatgaagatctaatatcaagatttgggagacgggatcttggaactccacctgtttgaccactaggaccactgaggcacctccaataagctctgtagagtgcctccagcataattcaaaatccactgacctaatccattatggctttacttaacattggagtgatccgtaaagaatatagtattggagtctgaactggaacggtaactcgtaagactcaagaaagaccgtttaaggaaaattggcataatacaaactgttcctgttgacttaagaataacagtaggttcacctatctgaggaaattaagtagttgatagtttaatgctaggcatcttttatgataataaagtaagatgtcttcttatgacagttaattgagttgtatcatgatacagaatgacagattttgtttcaaacaattgcgtcagaacctttgtaagcaaatattctaaggagaatcaatcttattttttaattgaactttttgaaattagggatactataataactgataaagatgaatttctgtgtttctaaagaatctaatttcaattactaccattaacatataaatgtgcttccaaaatccaagcaggtccatacaatttagagatttgaacactgttatcatgctttaattcagtcattcattaaaatattatctattcacttatttgatgattccaaacatttgatattgtattgtgtttttataattatttgaaatctgttcaccaatgctttgtaatggttttattaattgtgtagccattgctacttagatagtaacccactgagcaaaggcagtcatttattttcatccttgaagtaggggaagaaaattattaatttattagttctactttttcctgcattgcttattttgtaaacattttactatgaataatctgttctctttcactgtattaaaaggagaagaaaatgaacatttgagaatggaaaaaagtaataatatacaaataatctagtgctataaaatgcattatagtaagacacttttggtgtcttcgagtgcactatgttggaataaattttatacttgttgcttagtaaatctcagtcatacgtttggtttgaagctgtttttttttttaatttgaagtttaattttaaaagtgccacattgtaaaagttaccgttaaatactatgtagtataaaaaaccaacccaagctattgttaatgctctgaatgtttttctttgaaaatttaagtttagagaagaaattccttcatttttctcccctttgctaaaagaaagaaaatctataatatgtaagtctatgaatctttaaataactgaaggaattttagcagtactttgtataataaaaatattttttaaactataacttgccttagagcatggggtttcagaaagttttgacgaaaaactcatcttcattaaagagtctggataacttcatcagatggtaatttaatatgtcatgaaggggacactcaacattgggtcatctaccgtctaaataaatacggatttcatggtggcatttgaagcacattttgcaaacattatgatgttctattgtcttgctgaattctttattataacactacctcaagacaaatgatagactgttggtaaggtaaattgggttttcaatgtcaggaacaaataaaattttgcaaatagaagtcatcaaataattcaacaggaagaccatactggacacagatgttgtcagttacttctggacaatgtggtaacatggatatttcagtcactggtaacaatgtcagggttaacacccaatgaattatttgaaacaatttgggttgcaaaatttgaaattaattagtctattttgagattgattttctacgtgggccaattttatgtccattacctaaagccacaatctcccgctctaaggagttaaaggatgaaaacacccaactgctacactggaatggcagactggatattcaagcattttggcatttaatgcctgctaaatttttgtccgattatatatagatttgatgtatattattacccagtaaattcttcttgggaattttgtatacattatggaatattaggataagtttttgtaggtcagaagaatttcaagtagtttttagacaaaacatatccatgagtgtgaaaaaagctgtgttgacgaatagattacatttcacatttaccagcaagtcagtaaaaaatagtgcttatttacatagtcaatataatttaatgttctaaaaataatatcttcgatctgcccaatatttaatgtatcatttgagatttttaaaaatgcatccgctccattatgtaaacattaagatatgcctatgtttctttaactatacagcctctttacaataaatttcttgatttttgtgcacaggatagtattgcaacctgctatttagcctttggtgccttagaattattataaatatttaacaatatgtacataatgtaaatactgccaagagatcagtaaggccaaatattttctctattcactttttattgctcttgctttctattgctactaaagcctcttttatccagctttgtaatagttccaacattgtagcgaatgtaaatgtttactttcaataaatctgaacttgttcaacaagta

SEQ ID NO: 5766 - DNA, 3825 bp, Homo sapiens
agcggcggcggccgggaatggagcctgctgcgctgcgctgcgcttatttcagatactctgactccacctttacttttacctacgttggcggccccagaagtgtatcctactcagtacatgtatctgaagattacccagataatacatatgtgtcaagttcagagaatgatgaagatgtgctagttactacagagccaataccagtaatttttcatagaatagcaacagaattaagaaaaacaaatgacattaactgttgcttatccataaaatccaaattacaaaaggaaaatggggaggaatcaagacagaatagtacagtggaggaagattctgaaggtgacaatgattccgaagaattttattacggagggcaggtgaactatgatggggaactgcacaagcacccacaactggaagctgatttgtcagcagttagagagatatatgggccacatgcagtttctctcagggaatatggagccattgatgatgtagatattgatctgcatatcgatgttagctttcttgatgaggagattgctgtggcttgggaagtaattcgaacagaacctataattgttcgactacactgttcacttacacagtatttaaatggcccagtgcccactgttgatgtctttcagatttccacaaaagagcgatttggattgggacatcagctgaaaaaaatcatgcagacatttgttacacagcagtggaaacagagcaaagaaaaatccaattgcctgcacaataaaaagttgtcagagaagaaagtgaagtctcccctgcatttattttctactttgcgcaggtcgccaagttatcctccccctggttgtggcaaaagcaaatccaaactgaaatctgagcaggacggaatctccaaaacgcataagctgctgcggaggacttgttccagcacagtcaagactgatgatgtgtgtgtcacaaagtcacacaggacctttggccgctccttgtccagcgatcccagggcggagcaggctatgacagcaattaaatcgcacaaacttttgaaccgtccttgccctgcagctgttaagtcagaggaatgcctaactctaaagtcgcatagactattgactcgatcttgttctggagatccacgatgtgagcacaacacaaacttgaagccccataaactgttaagcaggtcttactctagtaatctcagaatggaagaattatatggactgaaaaatcacaaattgctcagcaagtcctactccagtgcccccaagtcatccaaaactgagcttttcaaggaacctaacgcagagggcaggaggctctctcttacctcagggcttattggtatcctaacaccatcttcatcttcatcttctcagcttgctccaaatggtgcaaaatgcattccagtacgagaccgtggcttcctggtgcagacaattgagtttgctgaacagcggatccctgtattaaatgaatattgtgtggtttgtgatgagccacatgtgtttcaaaatggccctatgcttaggcctaccgtatgtgaacgggagctgtgtgtgtttgcttttcaaaccctgggagtaatgaatgaagctgctgatgaaatagcaactggagctcaggtggtagatctactagtatccatgtgtaggtctgcgttggaatctcctagaaaagttgtgattttcgagccatatccttctgtggtagatcctaatgatcctcagatgttggccttcaaccccaggaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagtcacagaaaaaaggacagcaatcccaattcctgcaaagccgtaacttaaaatgcatagccttatgtgaagtgatcacctcatctgacctgcacaaacatggagagatatgggttgtccccaatactgaccatgtctgcacacgattctttttcgtctatgaagacggccaagtgggagatgcaaatattaatacacaagaaggaggcattcacaaagagatcctccgagtaattggtaatcaaactgctactggttaaaggaccaccatttaattaacatgattcgaaagccttcctcgggttcaaagctggattttgaactgaagaagattataaaattatttattgttattataaacaaaattaaccctttgaatactgattttttttcttagtatttctaagtatctcattaaatacctaaaatggtataagatttatcaattgtagggttatggaatctagtaataaaatttcaacagcacttaaactgaagtttgggttgctcatacaataaacagattgaaaaaactgttttgtgctgatatttttatactaaactctttaactggatatttggtattatataccgacattttaggttaccaaaatagaattgagaacattttataatggcatctaaatctatcagatactttgcaataagtatactgtttgcacattctgatgtgctatatcattagtagtatgggcattctaatgttttggaaggggtgttccctattctatttttcttcataaaaaaagaagtaggtcttagaagcagtgctttgccaaaaagtatgtaatatacacatctatacattcatgcatcaaaatgtgtggttgtgaatatatttgtgtatattcacacgtatgttttgacaagaaagatggcttagcttcacaattctatcctcgtttaatggaaagaagataatatttagtaagcaataaatttggacataaatcaagatatgagccagatttaccaccattcattcactgaaaatatttgcagacaatttttctgtttgtctgaagaaattcagcccttttaaaatgttatctaaaagtcataatttggggaacatacatggcctggtagaccgaatctatattcaaatgattatgtatttaaaagaaagacctcagaatttaaagaaaccatatatattttttatttactacaaaaaaattatacaattttatttatgccacaccagcatttttatatttgttcatctaatatctctgcttatttttttcatattgagaaagaacacaaacttgatgcttcttttatattaaaagaccacaaataagtttatagagaacagtaacaccagctctcagcatttccttttcaagagtcataatttcatcaaaatcatttcttattctttgagtcctagagttcttattcatcaagttttaattgacagtgtttattttcccacatgttgtctttggaataaggccattcatgaaagcagtttaattagtgagtctgccactctattcaaaccctgaatcaaggctctatctgattttaatttatgta

SEQ ID NO: 5767 - DNA, 2747 bp, Homo sapiens
agagcagtatctcatttctgaacacctggattgtagctttcccttgactgtcaaaggaggtggttttaaaaatcaagccaaacaggtttccatcttttaggaagaccctggaacgtgccagttgattctgaccatttctcatgaacagaaacacctaggaagggagaactgggatttatttaatggggatgtgttcaaggcaagagcgaattcagaaggatatcgacgtcgtgatccagaagtccagagctgagaaggactgcctgtttgcagatttcagatactctgactccacctttacttttacctacgttggcggccccagaagtgtatcctactcagtacatgtatctgaagattacccagataatacatatgtgtcaagttcagagaatgatgaagatgtgctagttactacagagccaataccagtaatttttcatagaatagcaacagaattaagaaaaacaaatgacattaactgttgcttatccataaaatccaaattacaaaaggaaaatggggaggaatcaagacagaatagtacagtggaggaagattctgaaggtgacaatgattccgaagaattttattacggagggcaggtgaactatgatggggaactgcacaagcacccacaactggaagctgatttgtcagcagttagagagatatatgggccacatgcagtttctctcagggaatatggagccattgatgatgtagatattgatctgcatatcgatgttagctttcttgatgaggagattgctgtggcttgggaagtaattcgaacagaacctataattgttcgactacactgttcacttacacagtatttaaatggcccagtgcccactgttgatgtctttcagatttccacaaaagagcgatttggattgggacatcagctgaaaaaaatcatgcagacatttgttacacagcagtggaaacagagcaaagaaaaatccaattgcctgcacaataaaaagttgtcagagaagaaagtgaagtctcccctgcatttattttctactttgcgcaggtcgccaagttatcctccccctggttgtggcaaaagcaaatccaaactgaaatctgagcaggacggaatctccaaaacgcataagctgctgcggaggacttgttccagcacagtcaagactgatgatgtgtgtgtcacaaagtcacacaggacctttggccgctccttgtccagcgatcccagggcggagcaggctatgacagcaattaaatcgcacaaacttttgaaccgtccttgccctgcagctgttaagtcagaggaatgcctaactctaaagtcgcatagactattgactcgatcttgttctggagatccacgatgtgagcacaacacaaacttgaagccccataaactgttaagcaggtcttactctagtaatctcagaatggaagaattatatggactgaaaaatcacaaattgctcagcaagtcctactccagtgcccccaagtcatccaaaactgagcttttcaaggaacctaacgcagagggcaggaggctctctcttacctcagggcttattggtatcctaacaccatcttcatcttcatcttctcagcttgctccaaatggtgcaaaatgcattccagtacgagaccgtggcttcctggtgcagacaattgagtttgctgaacagcggatccctgtattaaatgaatattgtgtggtttgtgatgagccacatgtgtttcaaaatggccctatgcttaggcctaccgtatgtgaacgggagctgtgtgtgtttgcttttcaaaccctgggagtaatgaatgaagctgctgatgaaatagcaactggagctcaggtggtagatctactagtatccatgtgtaggtctgcgttggaatctcctagaaaagttgtgattttcgagccatatccttctgtggtagatcctaatgatcctcagatgttggccttcaaccccaggaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagtcacagaaaaaaggacagcaatcccaattcctgcaaagccgtaacttaaaatgcatagccttatgtgaagtgatcacctcatctgacctgcacaaacatggagagatatgggttgtccccaatactgaccatgtctgcacacgattctttttcgtctatgaagacggccaagtgggagatgcaaatattaatacacaagaaggaggcattcacaaagagatcctccgagtaattggtaatcaaactgctactggttaa

SEQ ID NO: 5768 - DNA, 2829 bp, Homo sapiens
gcccctgcctcggccagaggtttcatttttaactgaatatttacgaaagctggaagcgtgcgaggggggtggggtggggtggaaatagcggctgcttcttttccagggatttatttaatggggatgtgttcaaggcaagagcgaattcagaaggatatcgacgtcgtgatccagaagtccagagctgagaaggactgcctgtttgcagatttcagatactctgactccacctttacttttacctacgttggcggccccagaagtgtatcctactcagtacatgtatctgaagattacccagataatacatatgtgtcaagttcagagaatgatgaagatgtgctagttactacagagccaataccagtaatttttcatagaatagcaacagaattaagaaaaacaaatgacattaactgttgcttatccataaaatccaaattacaaaaggaaaatggggaggaatcaagacagaatagtacagtggaggaagattctgaaggtgacaatgattccgaagaattttattacggagggcaggtgaactatgatggggaactgcacaagcacccacaactggaagctgatttgtcagcagttagagagatatatgggccacatgcagtttctctcagggaatatggagccattgatgatgtagatattgatctgcatatcgatgttagctttcttgatgaggagattgctgtggcttgggaagtaattcgaacagaacctataattgttcgactacactgttcacttacacagtatttaaatggcccagtgcccactgttgatgtctttcagatttccacaaaagagcgatttggattgggacatcagctgaaaaaaatcatgcagacatttgttacacagcagtggaaacagagcaaagaaaaatccaattgcctgcacaataaaaagttgtcagagaagaaagtgaagtctcccctgcatttattttctactttgcgcaggtcgccaagttatcctccccctggttgtggcaaaagcaaatccaaactgaaatctgagcaggacggaatctccaaaacgcataagctgctgcggaggacttgttccagcacagtcaagactgatgatgtgtgtgtcacaaagtcacacaggacctttggccgctccttgtccagcgatcccagggcggagcaggctatgacagcaattaaatcgcacaaacttttgaaccgtccttgccctgcagctgttaagtcagaggaatgcctaactctaaagtcgcatagactattgactcgatcttgttctggagatccacgatgtgagcacaacacaaacttgaagccccataaactgttaagcaggtcttactctagtaatctcagaatggaagaattatatggactgaaaaatcacaaattgctcagcaagtcctactccagtgcccccaagtcatccaaaactgagcttttcaaggaacctaacgcagagggcaggaggctctctcttacctcagggcttattggtatcctaacaccatcttcatcttcatcttctcagcttgctccaaatggtgcaaaatgcattccagtacgagaccgtggcttcctggtgcagacaattgagtttgctgaacagcggatccctgtattaaatgaatattgtgtggtttgtgatgagccacatgtgtttcaaaatggccctatgcttaggcctaccgtatgtgaacgggagctgtgtgtgtttgcttttcaaaccctgggagtaatgaatgaagctgctgatgaaatagcaactggagctcagaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagtcacagaaaaaaggacagcaatcccaattcctgcaaagccgtaacttaaaatgcatagccttatgtgaagtgatcacctcatctgacctgcacaaacatggagagatatgggttgtccccaatactgaccatgtctgcacacgattctttttcgtctatgaagacggccaagtgggagatgcaaatattaatacacaagaaggaggcattcacaaagagatcctccgagtaattggtaatcaaactgctactggttaaaggaccaccatttaattaacatgattcgaaagccttcctcgggttcaaagctggattttgaactgaagaagattataaaattatttattgttattataaacaaaattaaccctttgaatactgattttttttcttagtatttctaagtatctcattaaatacctaaaatggtataagatttatcaattgtagggttatggaatctagtaataaaatttcaacagcacttaaactgaagtttgggttgctcatacaataaacagattgaaaaaa

SEQ ID NO: 5769 - DNA, 2408 bp, Homo sapiens
agagcagtatctcatttctgaacacctggattgtagctttcccttgactgtcaaaggaggtggttttaaaaatcaagccaaacaggtttccatcttttaggaagaccctggaacgtgccagttgattctgaccatttctcatgaacagaaacacctaggaagggagaactgggatttatttaatggggatgtgttcaaggcaagagcgaattcagaaggatatcgacgtcgtgatccagaagtccagagctgagaaggactgcctgtttgcagatttcagatactctgactccacctttacttttacctacgttggcggccccagaagtgtatcctactcagtacatgtatctgaagattacccagataatacatatgtgtcaagttcagagaatgatgaagatgtgctagttactacagagccaataccagtaatttttcatagaatagcaacagaattaagaaaaacaaatgacattaactgttgcttatccataaaatccaaattacaaaaggaaaatggggaggaatcaagacagaatagtacagtggaggaagattctgaaggtgacaatgattccgaagaattttattacggagggcaggtgaactatgatggggaactgcacaagcacccacaactggaagctgatttgtcagcagttagagagatatatgggccacatgcagtttctctcagggaatatggagccattgatgatgtagatattgatctgcatatcgatgttagctttcttgatgaggagattgctgtggcttgggaagtaattcgaacagaacctataattgttcgactacactgttcacttacacagtatttaaatggcccagtgcccactgttgatgtctttcagatttccacaaaagagcgatttggattgggacatcagctgaaaaaaatcatgcagacatttgttacacagcagtggaaacagagcaaagaaaaatccaattgcctgcacaataaaaagttgtcagagaagaaagtgaagtctcccctgcatttattttctactttgcgcaggtcgccaagttatcctccccctggttgtggcaaaagcaaatccaaactgaaatctgagcaggacggaatctccaaaacgcataagctgctgcggaggacttgttccagcacagtcaagactgatgatgtgtgtgtcacaaagtcacacaggacctttggccgctccttgtccagcgatcccagggcggagcaggctatgacagcaattaaatcgcacaaacttttgaaccgtccttgccctgcagctgttaagtcagaggaatgcctaactctaaagtcgcatagactattgactcgatcttgttctggagatccacgatgtgagcacaacacaaacttgaagccccataaactgttaagcaggtcttactctagtaatctcagaatggaagaattatatggactgaaaaatcacaaattgctcagcaagtcctactccagtgcccccaagtcatccaaaactgagcttttcaaggaacctaacgcagagggcaggaggctctctcttacctcagggcttattggtatcctaacaccatcttcatcttcatcttctcagcttgctccaaatggtgcaaaatgcattccagtacgagaccgtggcttcctggtgcagacaattgagtttgctgaacagcggatccctgtattaaatgaatattgtgtggtttgtgatgagccacatgtgtttcaaaatggccctatgcttaggcctaccgtatgtgaacgggagctgtgtgtgtttgcttttcaaaccctgggagtaatgaatgaagctgctgatgaaatagcaactggagctcagaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagaaaacaaaaaaaaggacagcaatcccaattcctgcaaagccgtaa

SEQ ID NO: 5770 - DNA, 2237 bp, Homo sapiens
gcggatgcggatgcggatgcgaaggtggcggccgaggtggcggccgaggtggcggctgcggcggccgccgcggatgcagatgcggatgagaccctcggtgactgtgaggggaacccagattttcagatggcctccctgtacgtgggcgacctgcaccctgaggtgaccgaggcaatgctgtacgagaagttcagtccagctgggcccatcctctccatccgcatctgcagggacaagatcacccgccgctcattgggctacgcgtatgtcaactaccagcaaccggtggacgccaagcgggccctggagaccctgaactttgatgtcataaagggcaggccagtgcgcatcatgtggtcccagagggacccgtcgctccgcaagagcggggtgggcaacgtcttcatcaagaacctgggcaagaccatcgacaacaaggcgctgtacaacatcttctcggcgttcggcaacatcctctcctgcaaagtggcctgtgacgaaaaggggcccaagggctacgggttcgtgcacttccaaaagcaggaatctgcggagcgggccatcgatgtgatgaatggcatgttcctgaactaccgcaaaattttcgtcgggagattcaagtcgcataaagaacgagaggccgaaaggggagcctgggccaggcagtccactagtgctgacgtcaaggatttcgaggaagacaccgacgaggaggccaccttgcgatgaagacatcccaggagctagccagccagcagagccaaaccttggctcacacccggtttacaaccccccacccccagccctcccccgccaacccaccagcagtgtatttattgtattgagagtgcaggtctctctctctctctctctccccttctctctccccgcttcctattttctccctccacctctcctctccttcccttcctctcccccgcccacccccaccaagggcgttgtgaataatcttactaatctgtgccatttgtaggttaaaggctgcctcttctccctgtggtttgatttaaaaagcattttcattctctctttgtttactgcacaggtggtacaatttcatggtagaatcatcagaaaggagaaggatatcagatgagggaagaaacaagagagtaattgctcccctggtcctactccccagagagaaccacttttacctttttggtgtgctgcttttccaggctctcttctctccctctctctcctttgctcacccccaccccgccttcccttttaacacaccgttatagaatggttcatgtatgtggtgtttcttaacctgctttttcagcaactaaaaccaaacaaaaatcaacccattgaacttctttccatgttatcaacaggcttatgaaacgtcatcttcagtgcctgcagagtgctccagtgtatccgtggaccttaacatttctgtaatcattcccgcattgttggacattcaggtggtgcctagttctttccctgtgtttaagaccaacattgcgtgctctgtgctttgatgagtgaatccttccttgtcaagccaaatctttgctagcatcccggtggtctccttaactgcggacttgcaagatccacatatagacattttaaagacttttcctgtgtgttgccaaaaggcccccttcataagcattgtaccgatttgcactcgtgccggccagcgcagctagtaaagagtatgcccgtttcccctgcatagtctcctggtcactgtaattgatcgtgtgtgtgcgtgcgtgtgtgtgtgtgtgtgtgtgtgtgtgtgtcttggccagcttggcgggctacaaagggtgtttcgctgtcctcggtagttttgctggaaacaaacactgcttatgaccccattcccctgtgccctcttcctgtccttttccctgttgtcagaaaagtaattcagcgtcattgcaagaaaaaaaaatcacaaagcagacaagttaccagaagaaaattaaagtcaccagtaatcatttctgatgattacacacacattccagaaacattttcatgcacacctctctgatattttctagaactacctgaaacatttttgtctgtaggtctagtttttttcttatgcatatatcatatatgtatattatgatgtacagactgtttttatatctgcttttcacacatacatgtgtgtgtatatttatacacacacatattcttgaacttcatttcatgtcattaaagatacttttaaaata

SEQ ID NO: 5771 - DNA, 2200 bp, Homo sapiens
ggatgcggatgcggatgcgaatgcgaaggtggcggccgaggtggcggccgaggtggcggctgcggcggccgccgcggatgcagatgcggatgagaccctcggtgactgtgaggggaacccagattttcagatggcctccctgtacgtgggcgacctgcaccctgaggtgaccgaggcaatgctgtacgagaagttcagtccagctgggcccatcctctccatccgcatctgcagggacaagatcacccgccgctcattgggctacgcgtatgtcaactaccagcaaccggtggacgccaagcgggccctggagaccctgaactttgatgtcataaagggcaggccagtgcgcatcatgtggtcccagagggacccgtcgctccgcaagagcggggtgggcaacgtcttcatcaagaacctgggcaagaccatcgacaacaaggcgctgtacaacatcttctcggcgttcggcaacatcctctcctgcaaagtggcctgtgacgaaaaggggcccaagggctacgggttcgtgcacttccaaaagcaggaatctgcggagcgggccatcgatgtgatgaatggcatgttcctgaactaccgcaaaattttcgtcgggagattcaagtcgcataaagaacgagaggccgaaaggggagcctgggccaggcagtccactagtgctgacgtcaaggatttcgaggaagacaccgacgaggaggccaccttgcgatgaagacatcccaggagctagccagccagcagagccaaaccttggctcacacccggtttacaaccccccacccccagccctcccccgccaacccaccagcagtgtatttattgtattgagagtgcaggtctctctctctctctctctccccttctctctccccgcttcctattttctccctccacctctcctctccttcccttcctctcccccgcccacccccaccaagggcgttgtgaataatcttactaatctgtgccatttgtaggttaaaggctgcctcttctccctgtggtttggtttaaaaagcattttcattctctctttgtttactgcacaggtggtacaatttcatggtagaatcatcagaaaggagaaggatatcagatgagggaagaaacaagagagtaattgctcccctggtcctactccccagagagaaccacttttacctttttggtgtgctgcttttccaggctctcttctctccctctctctcctttgctcacccccaccccgccttcccttttaacacaccgttatagaatggttcatgtatgtggtgtttcttaacctgctttttcagcaactaaaaccaaacaaaaatcaacccattgaacttctttccatgttatcaacaggcttatgaaatgtcatcttcagtgcctgcagagtgctccagtgtatccgtggaccttaacatttctgtaatcattcccgcattgttggacattcaggtggtgcctagttctttccctgtgtttaagaccaacattgcgtgctctgtgctttgatgagtgaatccttccttgtcaagccaaatctttgctagcatcccggtggtctccttaactgcggacttgcaagatccacatatagacattttaaagacttttcctgtgtgttgccaaaaggcccccttcataagcattgtaccgatttgcactcgtgccggccagcgcagctagtaaagagtatgcccgtttcccctgcatagcctcctggtcactgtaattgatcgtgtgtgtgcgtgcgtgcgtgtgtgcatgcgtgtgtgtgtctttgtgtgtgtgtcttggccagcttggcgggctgcaaagggtgtttccctgtcctcagtggttttgctgcaatcaaacactgtttattacccccttcccctgtgcccacttcctgtccttttccctgttgtcagaaaaataattcagcgtcattgcaggaaaaaaataatcacgaagcagacaagttaacagaagaaaattaatgtcaccagtaatcatttctgatgattacttatacattcctgaaacattttcatctgtatctgccctgtatttttcatgtgatatatatgtgaaattattgtatatactgtttcaatatctgctttttcacacagaaatatatattatagacatagatttatagatattcttgaactttcatgtcattaaatattcttctaaaata

SEQ ID NO: 5772 - DNA, 4944 bp, Homo sapiens
gggcttcccgcccgcccgcagacgaccgccgttctgttgccgcgtcctaggagggccagattggtggctgtggggacttttggatgagggtgttgcctgagctgggggagtcgtgtctgaactccattgcttggcctttgtgtggtgatcccgaggcctccacacttgaaccgggccaaagctgtgacctagtatccccccacagggattgctcaaagaactccaggggacaaactcacagtggcaaggacaaggagatgaatgtagcagccaagtaccgcatggcctccctgtatgtgggtgacttacatgcagatgtcaccgaggacctgctgttcaggaagttcagcactgtggggcctgtgctgtccatccgcatttgcagggaccaggtcacccgccgctctctgggctatgcctacgtgaacttcttgcagctggctgatgcccagaaggcgctggacacaatgaactttgacatcataaaaggcaaatccatccgtctcatgtggtctcagcgcgatgcctacttgaggagatctggaattgggaacgtattcatcaagaatctggacaaatctatcgataacaaaaccctttatgaacatttttcagcttttggaaagatcctttcctccaaggtgatgagtgatgatcaaggctccaagggctatgcatttgtgcactttcagaaccagagtgctgcagacagggccattgaggagatgaatggaaaactactcaagggctgcaaggtgtttgttggcagattcaaaaaccgaaaagatcgtgaagctgaactcagaagcaaagccagtgaattcaccaatgtttacataaaaaactttggaggtgacatggatgatgagagattgaaggacgttttcagcaaatatggcaaaactctgagtgttaaggtgatgacagattccagtgggaaatccaaaggctttggctttgtgagttttgatagccatgaggctgccaagaaagctgttgaagaaatgaatggaagggacataaatgggcagctgatttttgtaggccgggctcaaaagaaagtcgagcgacaggctgagttaaagcaaatgtttgagcagctgaaaagggaacgaattcgtgggtgccagggggtaaaactctatattaagaaccttgatgacaccatcgatgatgaaaaactacgaaacgaattttcttcatttggatcaattagcagagttaaggtaatgcaggaagaggggcagagcaaagggtttggcttgatctgcttctcctctcctgaggatgctactaaagcaatgactgagatgaatggccgcatcttgggctccaaacctcttagcattgccttggcccagagacactaggaaagaaaaacgtacctttccagctagtatctgcagcaggtgggagaatgatagtgatctctgcctgaattgacctcagtaaatttcatattccacatgatgggtgcttagtttagtaaactttatgataaaacgttttttatacaaagccattttttttcttttgtggaaaaatagatggagcttagttcattttacagaggcacattttctaattttaatattgcacatttttcttattttgatatgttcatagcaataagtataaatagatatatttttacatttgaaccaaatgaaatgaggtaattatttgaatttattgcatatttattattttagtaatattgctagctttaatttcttctatgaaaatatgctcaaaatagttcttacaactaaagattccaaagtatttttaccaacagaaattttctaatttttcatccaagttttgagaaatcaaacttttagaaatttatagtacgaatttaaagacctaatttcattttgaattaatgcttaaaatagtcagatatagttgaatttcttttaaatttatatcctgacatgcttgtttttcggatggtttaaattaagatgatggaagtttttaatgttgcctaaaaactggctttatgtgttttgttctttccattagttgactataattcaggtacttactagttaatctaaattgtaacttgcactgtaaaaccttaacttctacattccttaagttataaatctgttatcaactcaggtgatccaaagttggcctggtcttaaatctcttcatacctatatggcttaatatattatcttaaatttttaccagatgctaatattatgaaaatcatacatacagattatagaaattctgtttaaaaacttttaaaatctcttttatattgttttgtgtagtgattttctcttagggttcagaaaagtaagttcctctatttttatgtactcacatctccttttattagaatgtggcagctatggaacccattaaggttcacttttagccttcattgatcagaaacactgattgattttctgatgaattgaagttacatcacttattctgttttctagcataatttttagtttagaaccattcccctattttccttgctctcctgcctttcatctatattcctcagctttttaaaatactttctaaaggatttttttatgttggcttttaatatgtgctgcttcaaatccatttggaaatcgaggcaagagttatttaattacatttaaataattgctttacaaattctgattcataccaaaggtatctagcaagcaagtgcttttgtttttactgttttcatatttttacttggcttagttttttctcataactattattcacattctctatttcatatattactaatataaaagaaatagtaaaatattttttggcaatacctcagcttatgaatgagaaaaatttgttgccttttatttttatagaaattatatgtatattctttgcacattttctaaaatgaaaatcttttagtccataaaaaattatggacaatgaaaaaattaaaagaatttgcatataattgtattatgcaaaccaattccctattataatttgttacatatttttctatttttttctctctctacatatatacacctaggtaatttaagaaaaataggataatattacaaatgttgtttgaaattgctttcttaaacaatatgctatggtcaacttttatgctcacaataattatttgtcttataatctgagtgacttttatgttttgttcaatgactgtaccaaaatataactaatttcttattgataaacttcttgttgctagataatttcttccttttttcttcttcctctgtcataaataacttggagattaacatccttgcgaacttatatatgcaaatatatctattttcttaagaaaatgtttagaagtagaattaatggttaaaaaagaatcaattttaaaaagtaattttgataaatattgcttaaatgctgtccagaatacttgtggcacttacatttccattgtcattgtaggagaatgcctatttccatatgctccaagaaacaagggttttttttaagctgttggtcaattcaacatgatatgtaaaacaaaccatttcatcattgctttatttcacttttgtaaattacaaaagttaaacagtatttgtgtactcactgaccatttgtattttcatacttataagttaatgtctcatgatcataatttattttcctgttggggtgttttttatttacatggatttttagatttctttgcatattatgactacattttagacttttccccctgatatttcactgtctttatagttttgaaggttattccaaaattgaatgttaagctggaaagttttagtattctactgaaatggctttgatgtcatgcttcaaaatattttgaacactttaaatacatatattcacacaaatatatatacacccacacaatttatctgtattgtgtttatgactttcagattttcatattctcaatgcttctaactaaaattttggttcataaaaagtatcttatataaaacctatagtaaatattttaaaaatgtgcttttccatttttaataacatgtattttggtaaatacttgattcagagagccaatgaattagagttggcatatgagtttcacatagattcttatactaggtaagtatttaccaaaacatgtatcagaagcagaaagttgttaaaaaggtttaccagacaacaagactggaaagtgtattaagtgtgcctggccttgacatcttgttctggataatctagtctacatcttaatttaggaaagctaatctgtaaaactgttcaaatatttgaacaatatttgataatgcttacataatctttcaagataatatcaggaaacagagttctttcatgtatgtaagtagttaataggacataacatcagatgtctagatgaattatagctatggcttaattacacaataatctgccttcttagtagaaattgcttatttccagcatttgctgtaaaaaaaaaaaagacagtcagtttacaaaaatatacaatcctatggatttaatttatttaaattttgttcattctaattttttttggtgcgtgataatagcaagttatcttagttgaaaatagagattcattcattaaagaatattaaatcttttgtgcccaagtgccttaataaataagtagaatcttaacttttctgataagcattccagtaaaagctaatgtacatagatatgccttgagccactgtttctactttcacccttctctccacacatattgccacgtctgctgtgtagttacctgcttacatgtacagccatttcaataaatgtattcttttaacattttatcttttaaatttcaaataggaatttatagttggtaaaaataaaaattttaaagtgatttaatattgtcattttcatgttctcaatattgttatagatccactgagaaaatgtcaaataaaatctaatatttcaaaggtgaaa

SEQ ID NO: 5773 - DNA, 4944 bp, Homo sapiens; identical to SEQ ID NO: 5772

SEQ ID NO: 5774 - DNA, 1851 bp, Homo sapiens
atgaacgccagcggttctggctacccgcttgcctcgctttacgtgggcgatctgcaccccgacgtgaccgaggccatgctctatgagaagttctctcccgccggccccatcctgtccatccgcgtgtgccgcgatgtagccacccggcgctcgctgggctacgcctacatcaacttccagcagcccgcggacgcggagcgggcactggacacaatgaactttgagatgctcaaaggccagcctattcgcatcatgtggtcccagcgagacccaggacttcgcaagtcaggtgtgggcaacatcttcatcaagaacctggaggactccattgacaacaaggctttatatgataccttctccacctttgggaacatcctctcttgcaaggtggcgtgtgacgagcatggctcccggggtttcggctttgtccattttgagacccatgaggccgcacagcaggccatcaacaccatgaatgggatgctgctgaatgaccgcaaagtctttgtgggtcacttcaagtctcgacgggagcgggaggcggagctgggggcgcgggccctggagttcaccaacatctacgtgaagaacctcccggtggatgtggacgagcaaggcctgcaggacctcttctcccagtttgggaaaatgctgagtgtgaaggtgatgagggacaacagcggccactcgcggtgctttggctttgtcaactttgagaagcatgaggaagcccagaaggccgtggtccatatgaacgggaaggaggtgagcgggcggctgctgtacgcgggccgggcccaaaagcgcgtggagcggcagaatgaactgaagcgcaggtttgagcagatgaagcaggaccggctgaggcgttaccagggtgtgaacttgtatgtgaagaatctggacgactccattgatgacgacaaactgaggaaagagttctctccctatggagtaattaccagtgcgaaggtgatgacagagggtggccacagcaaggggtttggctttgtgtgtttttcctccccagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccagcctccagcccaggctgcatactatggctgtggcccagtgacacccacccagcctgcccccaggtggacatcccagccacctagaccttcctgtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagatagacgaggcagtggccgtgctgcaggcacaccaggctatggagcagccgaaggcgtacatgcactgaaaccag

SEQ ID NO: 5775 - DNA, 1263 bp, Homo sapiens
ggagggcttccgcccgggtgagcgcggggctgctgggtgacccggctcctgcttgccccgcagccccggccccctgcccaccatgaacgccagcggttctggctacccgcttgcctcgctttacgtgggcgatctgcaccccgacgtgaccgaggccatgctctatgagaagttctctcccgccggccccatcctgtccatccgcgtgtgccgcgatgtagccacccggcgctcgctgggctacgcctacatcaacttccagcagcccgcggacgcggagcgggcactggacacaatgaactttgagatgctcaaaggccagcctattcgcatcatgtggtcccagcgagacccaggacttcgcaagtcaggtgtgggcaacatcttcatcaagaacctggaggactccattgacaacaaggctttatatgataccttctccacctttgggaacatcctctcttgcaaggtggcgtgtgacgagcatggctcccggggtttcggctttgtccattttgagacccatgaggccgcacagcaggccatcaacaccatgaatgggatgctgctgaatgaccgcaaagtctttgtgggtcacttcaagtctcgacgggagcgggaggcggagctgggggcgcgggccctggagttcaccaacatctacgtgaagaacctcccggtggatgtggacgagcaaggcctgcaggacctcttctcccagtttgggaaaatgctgagtgtgaaggtgatgagggacaacagcggccactcgcggtgctttggctttgtcaactttgagaagcatgaggaagcccagaaggccgtggtccatatgaacgggaaggaggtgagcgggcggctgctgtacgcgggccgggcccaaaagcgcgtggagcggcagaatgaactgaagcgcaggtttgagcagatgaagcaggaccggctgaggcgttaccagggtgtgaacttgtatgtgaagaatctggacgactccattgatgacgacaaactgaggaaagagttctctccctatggagtaattaccagtgcgaagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccag

SEQ ID NO: 5776 - DNA, 670 bp, Homo sapiens
gtgactctgaaaattcttgcaaagctgagaaggtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctgc

SEQ ID NO: 5777 - DNA, 2129 bp, Homo sapiens
ggagggcttccgcccgggtgagcgcggggctgctgggtgacccggctcctgcttgccccgcagccccggccccctgcccaccatgaacgccagcggttctggctacccgcttgcctcgctttacgtgggcgatctgcaccccgacgtgaccgaggccatgctctatgagaagttctctcccgccggccccatcctgtccatccgcgtgtgccgcgatgtagccacccggcgctcgctgggctacgcctacatcaacttccagcagcccgcggacgcggagcgggcactggacacaatgaactttgagatgctcaaaggccagcctattcgcatcatgtggtcccagcgagacccaggacttcgcaagtcaggtgtgggcaacatcttcatcaagaacctggaggactccattgacaacaaggctttatatgataccttctccacctttgggaacatcctctcttgcaaggtggcgtgtgacgagcatggctcccggggtttcggctttgtccattttgagacccatgaggccgcacagcaggccatcaacaccatgaatgggatgctgctgaatgaccgcaaagtctttgtgggtcacttcaagtctcgacgggagcgggaggcggagctgggggcgcgggccctggagttcaccaacatctacgtgaagaacctcccggtggatgtggacgagcaaggcctgcaggacctcttctcccagtttgggaaaatgctgagtgtgaaggtgatgagggacaacagcggccactcgcggtgctttggctttgtcaactttgagaagcatgaggaagcccagaaggccgtggtccatatgaacgggaaggaggtgagcgggcggctgctgtacgcgggccgggcccaaaagcgcgtggagcggcagaatgaactgaagcgcaggtttgagcagatgaagcaggaccggctgaggcgttaccagggtgtgaacttgtatgtgaagaatctggacgactccattgatgacgacaaactgaggaaagagttctctccctatggagtaattaccagtgcgaaggtgatgacagagggtggccacagcaaggggtttggctttgtgtgtttttcctccccagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccagcctccagcccaggctgcatactatggctgtggcccagtgacacccacccagcctgcccccaggtggacatcccagccacctagaccttcctgtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagatagacgaggcagtggccgtgctgcaggcacaccaggctatggagcagccgaaggcgtacatgcactgaaaccagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctgccttg

SEQ ID NO: 5778 - DNA, 2100 bp, Homo sapiens
cctgagatgggaggaaggagctttcattacagccttgtgggtcttgactcaccagtccctgcaggagccagtggagttcctgccatggtgtccctgaggaggtgtagcttctcacctaccctgccgccaagcccctcagtctgggtcttcttttcccatgcagcctccagcccaggctgcatactatggctgtggcccagtgacacccacccagcctgcccccaggtggacatcccagccacctagaccttcctgtgagtgacccagccccttccactctcagactggcctattggtgtgggccccgtgaggcagtcataacacagggatgaaacctggctctgccacttcccaaggtgggtgacttcacttctctgagcctcagtttcctcttctgagcatgggcctgaatgagacgtgtgtaaagtaccaagcacagtggtgagccaatggaagacacgcagctagccaccagcagtcatcaccaaagatgcctctgatttgtgactctgaaaattcttgcaaagctgagaaggtgaaattcctctggctatattgttgaccaaaggccctcctctgtaagagtgaattgcacgctcacttgaaactatcttgagggactaaggtgtacaatcctggtgcttatgcagtttggggctctaggtagacacgagctggctttgaaattgtagattcctacactccccctttctggagttctgggtctaagtgaattgactcctatttctgttgtgaatgttgtagtttcccttcccattctcttggtggccctggaagcttctaggcacagtgtgccaccctgattattcccaccactccatccaacttttctctctctgtggtgtctgcaccacaagctgcctaccctccaggtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagatttcagcttaaaatgccacccagagaccaagttcattctgtcaactgatctccagcacctggcccagagacggaaagtacaaagactagtaaaatacatccttgcccttaaggagctaagtacccaaaacctgtaatccatcttgagtcaccagagtacggttgctcagaaacagcagtggtgcggtggaaagggcatcaaccctgcgatccggacaagtcactccatccctctgatcatgcgtgcccacctaccacatgaggatatcacttcatagacttgctggaagggttcattgtgttagcctgttccctgagctctcttcgtgatcaagaagactgatcagataaatcaagagacttgcccaaaattacctaggaaatctgtagcagcagcagaaccaaactccggtccttgctaaatctagataccaggctagcttttctatggacccagaattaacccatacaaatgtacaagcttttccagaccagctggggtgagatgaatgaaaatggcagcaacatcaatacctcagcttcttcagcaacttcatcaagtaaggctgccatgaggaagtgggcctaaaggagagttttctagaacaaagaagggggcaaaggagtggcttgaaactgcaaaaagtgcagacaaaaaaaaaaaaaaaaagaatgaaatctggagaggatgtgaggagaggtctagcaaaatgattaaaaatttggacttagcatcaaagtcaaacagatccatattcaaa

SEQ ID NO: 5779 - DNA, 2137 bp, Homo sapiens
ggagggcttccgcccgggtgagcgcggggctgctgggtgacccggctcctgcttgccccgcagccccggccccctgcccaccatgaacgccagcggttctggctacccgcttgcctcgctttacgtgggcgatctgcaccccgacgtgaccgaggccatgctctatgagaagttctctcccgccggccccatcctgtccatccgcgtgtgccgcgatgtagccacccggcgctcgctgggctacgcctacatcaacttccagcagcccgcggacgcggagcgggcactggacacaatgaactttgagatgctcaaaggccagcctattcgcatcatgtggtcccagcgagacccaggacttcgcaagtcaggtgtgggcaacatcttcatcaagaacctggaggactccattgacaacaaggctttatatgataccttctccacctttgggaacatcctctcttgcaaggtggcgtgtgacgagcatggctcccggggtttcggctttgtccattttgagacccatgaggccgcacagcaggccatcaacaccatgaatgggatgctgctgaatgaccgcaaagtctttgtgggtcacttcaagtctcgacgggagcgggaggcggagctgggggcgcgggccctggagttcaccaacatctacgtgaagaacctcccggtggatgtggacgagcaaggcctgcaggacctcttctcccagtttgggaaaatgctgagtgtgaaggtgatgagggacaacagcggccactcgcggtgctttggctttgtcaactttgagaagcatgaggaagcccagaaggccgtggtccatatgaacgggaaggaggtgagcgggcggctgctgtacgcgggccgggcccaaaagcgcgtggagcggcagaatgaactgaagcgcaggtttgagcagatgaagcaggaccggctgaggcgttaccagggtgtgaacttgtatgtgaagaatctggacgactccattgatgacgacaaactgaggaaagagttctctccctatggagtaattaccagtgcgaaggtgatgacagagggtggccacagcaaggggtttggctttgtgtgtttttcctccccagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccagcctccagcccaggctgcatactatggctgtggcccagtgacacccacccagcctgcccccaggtggacatcccagccacctagaccttcctgtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggcacctgttatcttgtcttaaaacgctggtcagactggatggtcctgagctttcttccactgctgctgtcctgtgactttgaggggagcgtctctacccccttatccatgatgtccacacccagctggctggcaagatcacgggcatgctgctggagattgacaactcagagctgttgctcatgctggagtctccagaatccctccatgccaagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctgccttg

SEQ ID NO: 5780 - DNA, 536 bp, Homo sapiens
tgcaaatgttcctcagcagcacatagcacctatcgggtccaggagccggctgtgcacatcccaggacaggagcccctgaccgcgtccatgctggctgcggcgcccctgcatgagcaaaagcagatgattggcacctgttatcttgtcttaaaacgctggtcagactggatggtcctgagctttcttccactgctgctgtcctgtgactttgaggggagcgtctctacccccttatccatgatgtccacacccagctggctggcaagatcacgggcatgctgctggagattgacaactcagagctgttgctcatgctggagtctccagaatccctccatgccaagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctgc

SEQ ID NO: 5781 - DNA, 2223 bp, Homo sapiens
ttggctcgctgcaaactcttcctcctgggttcaagtgattcttgtgcctcagcctcccgggtagctgggattacaggtgcgtgccaccacactcagctaattttttgtatttttagtagagacggggtttcaccatgttggccaggctggtcttgaactcctgacctcaagtgatgtgccctccttgacctcctaaagtgctgggattacaggcatgagccaccatgatcggccctaaatttctttactatctacactattctaccctaagatgccaatgtctactgagactctccaaaacaggcacagattatccagcatttccccagcttagatggtcatttttttgtgggatgcctgttaacatctcccctggatgttaatgttctgaggagcatggtttgggaaaggacctcgtgggacttacaggaagtagaaagatgtcacccattaaaggccaccacggtaagaacattcctctccttttagcagttgcttaagctgcacaagttggagtaagatgtcaccctttttatccaggtcattgggttagctgacagggagccaagattgaaatctaagatctttgccctgcaggattcagggctaatggacatcctgagatgggaggaaggagctttcattacagccttgtgggtcttgactcaccagtccctgcaggagccagtggagttcctgccatggtgtccctgaggaggtgtagcttctcacctaccctgccgccaagcccctcagtctgggtcttcttttcccatgcagcctccagcccaggctgcatactatggctgtggcccagtgacacccacccagcctgcccccaggtggacatcccagccacctagaccttcctgtgagtgacccagccccttccactctcagactggcctattggtgtgggccccgtgaggcagtcataacacagggatgaaacctggctctgccacttcccaaggtgggtgacttcacttctctgagcctcagtttcctcttctgagcatgggcctgaatgagacgtgtgtaaagtaccaagcacagtggtgagccaatggaagacacgcagctagccaccagcagtcatcaccaaagatgcctctgatttgtgactctgaaaattcttgcaaagctgagaaggtgaaattcctctggctatattgttgaccaaaggccctcctctgtaagagtgaattgcacgctcacttgaaactatcttgagggactaaggtgtacaatcctggtgcttatgcagtttggggctctaggtagacacgagctggctttgaaattgtagattcctacactccccctttctggagttctgggtctaagtgaattgactcctatttctgttgtgaatgttgtagtttcccttcccattctcttggtggccctggaagcttctaggcacagtgtgccaccctgattattcccaccactccatccaacttttctctctctgtggtgtctgcaccacaagctgcctaccctccaggtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagatagacgaggcagtggccgtgctgcaggcacaccaggctatggagcagccgaaggcgtacatgcactgaaaccagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaatctgc

SEQ ID NO: 5782 - DNA, 854 bp, Homo sapiens
ggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaaggcccagagacggaaagtacaaagactagtaaaatacatccttgcccttaaggagctaagtacccaaaacctgtaatccatcttgagtcaccagagtacggttgctcagaaacagcagtggtgcggtggaaagggcatcaaccctgcgatccggacaagtcactccatccctctgatcatgcgtgcccacctaccacatgaggatatcacttcatagacttgctggaagggttcattgtgttagcctgttccctgagctctcttcgtgatcaagaagactgatcagataaatcaagagacttgcccaaaattacctaggaaatctgtagcagcagcagaaccaaactccggtccttgctaaatctagataccaggctagcttttctatggacccagaattaacccatacaaatgtacaagcttttccagaccagctggggtgagatgaatgaaaatggcagcaacatcaata

SEQ ID NO: 5783 - DNA, 1933 bp, Homo sapiens
ggagggcttccgcccgggtgagcgcggggctgctgggtgacccggctcctgcttgccccgcagccccggccccctgcccaccatgaacgccagcggttctggctacccgcttgcctcgctttacgtgggcgatctgcaccccgacgtgaccgaggccatgctctatgagaagttctctcccgccggccccatcctgtccatccgcgtgtgccgcgatgtagccacccggcgctcgctgggctacgcctacatcaacttccagcagcccgcggacgcggagcgggcactggacacaatgaactttgagatgctcaaaggccagcctattcgcatcatgtggtcccagcgagacccaggacttcgcaagtcaggtgtgggcaacatcttcatcaagaacctggaggactccattgacaacaaggctttatatgataccttctccacctttgggaacatcctctcttgcaaggtggcgtgtgacgagcatggctcccggggtttcggctttgtccattttgagacccatgaggccgcacagcaggccatcaacaccatgaatgggatgctgctgaatgaccgcaaagtctttgtgggtcacttcaagtctcgacgggagcgggaggcggagctgggggcgcgggccctggagttcaccaacatctacgtgaagaacctcccggtggatgtggacgagcaaggcctgcaggacctcttctcccagtttgggaaaatgctgagtgtgaaggtgatgagggacaacagcggccactcgcggtgctttggctttgtcaactttgagaagcatgaggaagcccagaaggccgtggtccatatgaacgggaaggaggtgagcgggcggctgctgtacgcgggccgggcccaaaagcgcgtggagcggcagaatgaactgaagcgcaggtttgagcagatgaagcaggaccggctgaggcgttaccagggtgtgaacttgtatgtgaagaatctggacgactccattgatgacgacaaactgaggaaagagttctctccctatggagtaattaccagtgcgaaggtgatgacagagggtggccacagcaaggggtttggctttgtgtgtttttcctccccagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccagcctccagcccaggctgcatactatggctgtggcccagtgacacccacccagcctgcccccaggtggacatcccagccacctagaccttcctgtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaaggcccagagacggaaagtacaaagactagtaaaatacatccttgcccttaaggagctaagtacccaaaacctgtaa

SEQ ID NO: 5784 - DNA, 1910 bp, Homo sapiens
gccccggccccctgcccaccatgaacgccagcggttctggctacccgcttgcctcgctttacgtgggcgatctgcaccccgacgtgaccgaggccatgctctatgagaagttctctcccgccggccccatcctgtccatccgcgtgtgccgcgatgtagccacccggcgctcgctgggctacgcctacatcaacttccagcagcccgcggacgcggagcgggcactggacacaatgaactttgagatgctcaaaggccagcctattcgcatcatgtggtcccagcgagacccaggacttcgcaagtcaggtgtgggcaacatcttcatcaagaacctggaggactccattgacaacaaggctttatatgataccttctccacctttgggaacatcctctcttgcaaggtggcgtgtgacgagcatggctcccggggtttcggctttgtccattttgagacccatgaggccgcacagcaggccatcaacaccatgaatgggatgctgctgaatgaccgcaaagtctttgtgggtcacttcaagtctcgacgggagcgggaggcggagctgggggcgcgggccctggagttcaccaacatctacgtgaagaacctcccggtggatgtggacgagcaaggcctgcaggacctcttctcccagtttgggaaaatgctgagtgtgaaggtgatgagggacaacagcggccactcgcggtgctttggctttgtcaactttgagaagcatgaggaagcccagaaggccgtggtccatatgaacgggaaggaggtgagcgggcggctgctgtacgcgggccgggcccaaaagcgcgtggagcggcagaatgaactgaagcgcaggtttgagcagatgaagcaggaccggctgaggcgttaccagggtgtgaacttgtatgtgaagaatctggacgactccattgatgacgacaaactgaggaaagagttctctccctatggagtaattaccagtgcgaagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccaggtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagatagacgaggcagtggccgtgctgcaggcacaccaggctatggagcagccgaaggcgtacatgcactgaaaccagaaaaggaaatcctcgcttccatggctgccaaaaggacagtgtttctggctctcagccctaaggccctgcaaactctaacttatttcccaattagtctgtatctatacttgggctctgtatgtgaatgaaggttggtcacccatccagcctattaccttttgctttgtgtattaaaagtgctgcaaaat

SEQ ID NO: 5785 - DNA, 2237 bp, Homo sapiens; identical to SEQ ID NO: 5770

SEQ ID NO: 5786 - DNA, 1076 bp, Homo sapiens
ctcggtgactgtgaggggaacccagattttcagatggcctccctgtacgtgggcgacctgcaccctgaggtgaccgaggcaatgctgtacgagaagttcagtccagctgggcccatcctctccatccgcatctgcagggacaagatcacccgccgctcattgggctacgcgtatgtcaactaccagcaaccggtggacgccaagcgggccctggagaccctgaactttgatgtcataaagggcaggccagtgcgcatcatgtggtcccagagggacccgtcgctccgcaagagcggggtgggcaacgtcttcatcaagaacctgggcaagaccatcgacaacaaggcgctgtacaacatcttctcggcgttcggcaacatcctctcctgcaaagtggcctgtgacgaaaaggggcccaagggctacgggttcgtgcacttccaaaagcaggaatctgcggagcgggccatcgatgtgatgaatggcatgttcctgaactaccgcaaaattttcgtcgggagattcaagtcgcataaagaacgagaggccgaaaggggagcctgggccaggcagtccactagtgctgacgtcaaggatttcgaggaagacaccgacgaggaggccaccttgcgatgaagacatcccaggagctaacccaccagcagtgtatttattgtattgagagtgcaggtctctctctctctctctctccccttctctctccccgcttcctattttctccctccacctctcctctccttcccttcctctcccccgcccacccccaccaagggcgttgtgaataatcttactaatctgtgccatttgtaggttaaaggctgcctcttctccctgtggtttgatttaaaaagcattttcattctctctttgtttactgcacaggtggtacaatttcatggtagaatcatcagaaaggagaaggatatcagatgagggaagaaacaagagagtaattgctcccctggtcctactccccagagagaaccacttttacctttttggtgtgctgcttttccaggctctcttctctccctctctctcctttgctcaccccc

SEQ ID NO: 5787 - DNA, 2200 bp, Homo sapiens; identical to SEQ ID NO: 5771

SEQ ID NO: 5788 - DNA, 1076 bp, Homo sapiens
ctcggtgactgtgaggggaacccagattttcagatggcctccctgtacgtgggcgacctgcaccctgaggtgaccgaggcaatgctgtacgagaagttcagtccagctgggcccatcctctccatccgcatctgcagggacaagatcacccgccgctcattgggctacgcgtatgtcaactaccagcaaccggtggacgccaagcgggccctggagaccctgaactttgatgtcataaagggcaggccagtgcgcatcatgtggtcccagagggacccgtcgctccgcaagagcggggtgggcaacgtcttcatcaagaacctgggcaagaccatcgacaacaaggcgctgtacaacatcttctcggcgttcggcaacatcctctcctgcaaagtggcctgtgacgaaaaggggcccaagggctacgggttcgtgcacttccaaaagcaggaatctgcggagcgggccatcgatgtgatgaatggcatgttcctgaactaccgcaaaattttcgtcgggagattcaagtcgcataaagaacgagaggccgaaaggggagcctgggccaggcagtccactagtgctgacgtcaaggatttcgaggaagacaccgacgaggaggccaccttgcgatgaagacatcccaggagctaacccaccagcagtgtatttattgtattgagagtgcaggtctctctctctctctctctccccttctctctccccgcttcctattttctccctccacctctcctctccttcccttcctctcccccgcccacccccaccaagggcgttgtgaataatcttactaatctgtgccatttgtaggttaaaggctgcctcttctccctgtggtttggtttaaaaagcattttcattctctctttgtttactgcacaggtggtacaatttcatggtagaatcatcagaaaggagaaggatatcagatgagggaagaaacaagagagtaattgctcccctggtcctactccccagagagaaccacttttacctttttggtgtgctgcttttccaggctctcttctctccctctctctcctttgctcaccccc

SEQ ID NO: 5789 - DNA, 1323 bp, Homo sapiens
aacccctcattgttcgcagctgatgtcactcgcagttgtgagcggccgcctctcccggggacaatgtgggactgagcggcccagccgccgtgccgccgccgccgccgccgcaggacagccccagcgagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccccacagctccccctggcctgctgggcacaccctatgccatctccctctccaacttcatcggcccaagcccatgcccttcttggctttaccacctgcttccccagggccgccgccgggctt

SEQ ID NO: 5790 - DNA, 2087 bp, Homo sapiens
ctcattgttcgcagctgatgtcactcgcagttgtgagcggccgcctctcccggggacaatgtgggactgagcggcccagccgccgtgccgccgccgccgccgccgcaggacagccccagcgaggccatttccagcacatagaagagagattggaaaccaacgtgcagaactgccagtcccctgacacgctgtgccccacccactgcagcccagtgctgaatgaaccctgcccagaggtgtctgtagtgagcttctgccctagtgacttttggtaggtgggagtgtgcctcaattcccccctcaacccctgcctcaagcctttaccaggcagtggcaagacctgaccacacccgaggcctccctgccttcaaggcttcccatggctgctccagcttcctccccagctgctcttctgtgctccatccaccatctggctgctggacgaaagtgcctctcatatggaagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgacc

SEQ ID NO: 5791 - DNA, 1876 bp, Homo sapiens
atgccccgctgcccggcgctcattctatatctgcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagaggtgaggggcgagatataccacccacagggaatccggggcaagggagcagttgtaagaggggtgttgggcttatggcgtcctccccacctagagagctctgagcctgggcagcccttttctgggttatgggagcagccagaagtggcccctgttctctgtttgcagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgac

SEQ ID NO: 5792 - DNA, 1876 bp, Homo sapiens
aacccctcattgttcgcagctgatgtcactcgcagttgtgagcggccgcctctcccggggacaatgtgggactgagcggcccagccgccgtgccgccgccgccgccgccgcaggacagccccagcgagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgac

SEQ ID NO: 5793 - DNA, 562 bp, Homo sapiens
aaacccctcattgttcgcagctgatgtcactcgcagttgtgagcggccgcctctcccggggacaatgtgggactgagcggcccagccgccgtgccgccgccgccgccgccgcaggacagccccagcgagcctctggagtccctgtggcagaactcaaatggaaggaggagcagctgcacccaggggagcagggtgtcacctccgttggataggccatttccagcacatagaagagagattggaaaccaacgtgcagaactgccagtcccctgacacgctgtgccccacccactgcagcccagtgctgaatgaaccctgcccagaggtgtctgtagtgagcttctgccctagtgacttttgagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcag

SEQ ID NO: 5794 - DNA, 837 bp, Homo sapiens
agtaaaagactcaacggagcccgttccttgcgaccctatccccaaaaggaattccggggctgatgtcactcgcagttgtgagcggccgcctctcccggggacaatgtgggactgagcggcccagccgccgtgccgccgccgccgccgccgcaggacagccccagcgagcctctggagtccctgtggcagaactcaaatggaaggaggagcagctgcacccaggggagcagggtgtcacctccgttggataggccatttccagcacatagaagagagattggaaaccaacgtgcagaactgccagtcccctgacacgctgtgccccacccactgcagcccagtgctgaatgaaccctgcccagaggtgtctgtagtgagcttctgccctagtgacttttgagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaa

SEQ ID NO: 5795 - DNA, 704 bp, Homo sapiens
caccaggccagatggagaggaagggagattggattcccctccccacccacacatacccagctgatgtcactcgcagttgtgagcggccgcctctcccggggacaatgtgggactgagcggcccagccgccgtgccgccgccgccgccgccgcaggacagccccagcgaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctg

SEQ ID NO: 5796 - DNA, 563 bp, Homo sapiens
aaacccctcattgttcgcagctgatgtcactcgcagttgtgagcggccgcctctcccggggacaatgtgggactgagcggcccagccgccgtgccgccgccgccgccgccgcaggacagccccagcgagcctttaccaggcagtggcaagacctgaccacacccgaggcctccctgccttcaaggcttcccatggctgctccagcttcctccccagctgctcttctgtgctccatccaccatctggctgctggacgaaagtgcctctcatatggaagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgc

SEQ ID NO: 5797 - DNA, 2009 bp, Homo sapiens
ctttgtccaccaggccagatggagaggaagggagattggattcccctccccacccacacatacccagctgatgtcactcgcagttgtgagcggccgcctctcccggggacaatgtgggactgagcggcccagccgccgtgccgccgccgccgccgccgcaggacagccccagcgagcctctggagtccctgtggcagaactcaaatggaaggaggagcagctgcacccaggggagcagggtgtcacctccgttggatagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgacca

SEQ ID NO: 5798 - DNA, 539 bp, Homo sapiens
accgccagcacgcgcctgcttcccgtctgcgcgagtccacgcagctccccaggccatttccagcacatagaagagagattggaaaccaacgtgcagaactgccagtcccctgacacgctgtgccccacccactgcagcccagtgctgaatgaaccctgcccagaggtgtctgtagtgagcttctgccctagtgacttttgagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgc

SEQ ID NO: 5799 - DNA, 510 bp, Homo sapiens
gaggaagggagattggattcccctccccacccacacatacccaggtgccaagagactcagctgtggggggaggtggagctgatgtcactcgcagttgtgagcggccgcctctcccggggacaatgtgggactgagcggcccagccgccgtgccgccgccgccgccgccgcaggacagccccagcgagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggtcc

SEQ ID NO: 5800 - DNA, 559 bp, Homo sapiens
tttgtccaccaggccagatggagaggaagggagattggattcccctccccacccacacatacccagctgatgtcactcgcagttgtgagcggccgcctctcccggggacaatgtgggactgagcggcccagccgccgtgccgccgccgccgccgccgcaggacagccccagcgagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgt

SEQ ID NO: 5801 - DNA, 3527 bp, Homo sapiens
atttccatgatgcacctctgtgcatgaagacttcagagggtactcaatgcaggaaatcagaattcagctccataaaacattccagattccacatatcaccaacattctttcttcctcttggcttatattagggataggggatgtggtttgttacaaaggatgagtattttgatagcttctcattccttgaactattctgcaggtttataacaaagctcagaaaatactaaaggttaaaggagaattgagagctgccaaggaaatgaaagatgaggcgggggagagagacagagaagtgagcagcctgaacagcaagctgttaagcctgcaacttgacatcaagaatctgcacgatgtctgcaagagacagaggaagaccttgcaggacaatcagctctgcatggaggaggcaatgaacagcagccacgacaagaagcaagcacaggcattagcattcgaggagtcagaggtggaatttgggtccagtaaacagtgtcatctgagacaactccagcaactgaagaaaaaattgctggtccttcaacaagaactggagtttcacacagaggagttgcagacttcttactattctctccgccagtatcagtccatcctagagaagcagacttccgacctggttcttctgcaccatcactgcaaactgaaagaagatgaggtgattctctatgaggaggaaatgggaaatcacaacgagaacacaggggagaagctccatttggcgcaggagcaactcgccttggccggggacaagatcgcctctctagagaggagcttaaacctctacagggataaataccagtcttccctgagcaacatcgagttactagaatgccaagtgaagatgttgcagggggaactcggcgggatcatgggtcaggagcctgagaacaagggtgatcattcaaaggtacggatatacacttctccttgcatgattcaagagcatcaggagactcagaaacgactgtctgaagtctggcaaaaggtctctcaacaggatgatctcattcaagaacttcgaaataagctggcctgcagtaacgctttggttctggagcgtgaaaaggctttgataaaactacaagccgattttgcttcctgtacagccacccacagataccctcctagctcctcagaagagtgtgaagacatcaaaaagatactgaagcacttgcaggagcagaaagacagccagtgcctgcatgtggaggagtaccagaacctggtgaaggatctgcgcgtggaactagaggccgtgtcggaacagaagagaaacatcatgaaggacatgatgaagctggagctggacctgcacggactgcgggaggagacatctgcccacattgagaggaaggataaggacatcaccatcctgcagtgccggctgcaggagctgcagctggagttcaccgagacccaaaagctcactttgaagaaagacaagttcctccaagagaaagatgagatgctgcaagagctggagaagaaactgacacaggttcagaacagcctcctgaaaaaggagaaggagctggagaagcagcagtgcatggccacagaacttgaaatgacagtcaaggaggctaagcaggacaagtccaaggaggcggagtgcaaggccctgcaggctgaggtccagaagctgaagaacagtctcgaagaggccaagcagcaggagaggctggctgctcagcaagcagcccagtgcaaagaagaggctgcactggcaggctgtcacctggaggacacccagaggaaactgcagaagggtctcctcctggacaagcagaaggcagacaccatccaggaactacagagagaacttcagatgctgcagaaggagtcctcgatggctgagaaggaacaaacctccaacagaaaacgggtggaggagctgtcattagaactctctgaagccctgaggaagcttgaaaattcagacaaggaaaagaggcagcttcagaagacagtggctgagcaggatatgaaaatgaatgacatgcttgatcgtatcaagcaccagcacagggagcaaggctccatcaaatgcaagttagaagaagatcttcaggaggccacaaagcttctggaggacaaacgggagcagttgaagaagagcaaagagcatgagaagctgatggagggagaacttgaagctttgcggcaggaatttaaaaagaaagacaagacgttgaaagagaattccagaaagttggaggaagaaaatgagaatctccgagcagagctacagtgttgttctacacaactggaatcctctctcaacaaatacaacaccagccagcaagtcatccaagacttgaataaagagatagcccttcagaaggagtccttaatgagcctgcaggcccagctggacaaagctctgcagaaggagaagcactatctccagactaccatcaccaaagaagcctatgatgcattatcccggaagtcagccgcctgccaggatgacctgacacaagccctcgagaagctcaatcacgtgacctcagagacaaagagcctgcagcaaagcttgacacagacccaagagaagaaagctcagctggaagaggaaatcattgcttatgaggaaaggatgaaaaagctcaatacggaattaagaaaactgcggggcttccaccaggagagtgagctggaggtgcacgcctttgacaagaagctagaggagatgagctgccaggtgctgcagtggcagaagcaacaccagaatgacctcaagatgctggcagccaaagaggagcagctcagggagttccaggaggagatggccgccttaaaagagaacctccttgaggacgataaggagccctgctgcctgccccagtggtctgtgcccaaagacacctgtaggctctaccgagggaatgatcagattatgaccaacttggagcaatgggcaaaacagcagaaggtcgccaatgagaaactaggaaaccagctccgagagcaggtgaaatacattgccaagctgagtggcgaaaaggaccacctccacagtgtaatggtccacttgcagcaggaaaacaagaagctgaagaaggagatagaagagaagaagatgaaagccgagaacacaaggctatgcaccaaagccctaggcccgagcagaacggagtccacacagagggagaaagtgtgcggcaccttgggctggaaggggttgccccaggatatgggtcaaagaatggacctcaccaagtacatcgggatgccccactgcccgggttcctcatactgctagaatccacatctagccctgagcagcatttccacgggtgtttcttcagaggacagtgagttcccagccctccctctctcttgacctggatcagctcttacaggagtatatcacggtcccagcctattttgcaagacactaacttttgttgagttttgtccacttcctgccatggagtgagctttagaaccatactaccatctccaggcccaaactctgaaataaagacatgagcatgagcaca

SEQ ID NO: 5802 - DNA, 3501 bp, Homo sapiens
caggtttataacaaagctcagaaaatactaaaggttaaaggagaattgagagctgccaaggaaatgaaagatgaggcgggggagagagacagagaagtgagcagcctgaacagcaagctgttaagcctgcaacttgacatcaagaatctgcacgatgtctgcaagagacagaggaagaccttgcaggacaatcagctctgcatggaggaggcaatgaacagcagccacctcattgccctgaaaatatcagatcatagtgatacaaggggagcagcgtctgctatggatctcagacaaacttctaagtcaaccatgaaaataaaaaccatcacacctgctctaaggacaagaagcaagcacaggcattagcattcgaggagtcagaggtggaatttgggtccagtaaacagtgtcatctgagacaactccagcaactgaagaaaaaattgctggtccttcaacaagaactggagtttcacacagaggagttgcagacttcttactattctctccgccagtatcagtccatcctagagaagcagacttccgacctggttcttctgcaccatcactgcaaactgaaagaagatgaggtgattctctatgaggaggaaatgggaaatcacaacgagaacacaggggagaagctccatttggcgcaggagcaactcgccttggccggggacaagatcgcctctctagagaggagcttaaacctctacagggataaataccagtcttccctgagcaacatcgagttactagaatgccaagtgaagatgttgcagggggaactcggcgggatcatgggtcaggagcctgagaacaagggtgatcattcaaaggtacggatatacacttctccttgcatgattcaagagcatcaggagactcagaaacgactgtctgaagtctggcaaaaggtctctcaacaggatgatctcattcaagaacttcgaaataagctggcctgcagtaacgctttggttctggagcgtgaaaaggctttgataaaactacaagccgattttgcttcctgtacagccacccacagataccctcctagctcctcagaagagtgtgaagacatcaaaaagatactgaagcacttgcaggagcagaaagacagccagtgcctgcatgtggaggagtaccagaacctggtgaaggatctgcgcgtggaactagaggccgtgtcggaacagaagagaaacatcatgaaggacatgatgaagctggagctggacctgcacggactgcgggaggagacatctgcccacattgagaggaaggataaggacatcaccatcctgcagtgccggctgcaggagctgcagctggagttcaccgagacccaaaagctcactttgaagaaagacaagttcctccaagagaaagatgagatgctgcaagagctggagaagaaactgacacaggttcagaacagcctcctgaaaaaggagaaggagctggagaagcagcagtgcatggccacagaacttgaaatgacagtcaaggaggctaagcaggacaagtccaaggaggcggagtgcaaggccctgcaggctgaggtccagaagctgaagaacagtctcgaagaggccaagcagcaggagaggctggctgctcagcaagcagcccagtgcaaagaagaggctgcactggcaggctgtcacctggaggacacccagaggaaactgcagaagggtctcctcctggacaagcagaaggcagacaccatccaggaactacagagagaacttcagatgctgcagaaggagtcctcgatggctgagaaggaacaaacctccaacagaaaacgggtggaggagctgtcattagaactctctgaagccctgaggaagcttgaaaattcagacaaggaaaagaggcagcttcagaagacagtggctgagcaggatatgaaaatgaatgacatgcttgatcgtatcaagcaccagcacagggagcaaggctccatcaaatgcaagttagaagaagatcttcaggaggccacaaagcttctggaggacaaacgggagcagttgaagaagagcaaagagcatgagaagctgatggagggagaacttgaagctttgcggcaggaatttaaaaagaaagacaagacgttgaaagagaattccagaaagttggaggaagaaaatgagaatctccgagcagagctacagtgttgttctacacaactggaatcctctctcaacaaatacaacaccagccagcaagtcatccaagacttgaataaagagatagcccttcagaaggagtccttaatgagcctgcaggcccagctggacaaagctctgcagaaggagaagcactatctccagactaccatcaccaaagaagcctatgatgcattatcccggaagtcagccgcctgccaggatgacctgacacaagccctcgagaagctcaatcacgtgacctcagagacaaagagcctgcagcaaagcttgacacagacccaagagaagaaagctcagctggaagaggaaatcattgcttatgaggaaaggatgaaaaagctcaatacggaattaagaaaactgcggggcttccaccaggagagtgagctggaggtgcacgcctttgacaagaagctagaggagatgagctgccaggtgctgcagtggcagaagcaacaccagaatgacctcaagatgctggcagccaaagaggagcagctcagggagttccaggaggagatggccgccttaaaagagaacctccttgaggacgataaggagccctgctgcctgccccagtggtctgtgcccaaagacacctgtaggctctaccgagggaatgatcagattatgaccaacttggagcaatgggcaaaacagcagaaggtcgccaatgagaaactaggaaaccagctccgagagcaggtgaaatacattgccaagctgagtggcgaaaaggacagggaaccaaccagagccagcagccccaacacaacccgtccttcctctccttcccacagccacctccacagtgtaatggtccacttgcagcaggaaaacaagaagctgaagaaggagatagaagagaagaagatgaaagccgagaacacaaggctatgcaccaaagccctaggcccgagcagaacggagtccacacagagggagaaagtgtgcggcaccttgggctggaaggggttgccccaggatatgggtcaaagaatggacctcaccaagtacatcgggatgccccactgcccgggttcctcatactgctagaatccacatctagccctgagcagcatttccacgggtgtttcttcagaggacagtgagttcccagccctccctctctcttgacctggatcagctcttacaggagtatatcacggtcccagcctattttgcaagacactaacttttgttgagttttgtccacttcctgccatggagtgagctttagaaccatactaccatctccaggcccaaactctgaaataaagacatgagcatgagc

SEQ ID NO: 5803 - DNA, 559 bp, Homo sapiens
aacacccttttaaaaacacaaacagatgggtttataacaaagctcagaaaatactaaaggttaaaggagaattgagagctgccaaggaaatgaaagatgaggcgggggagagagacagagaagtgagcagcctgaacagcaagctgttaagcctgcaacttgacatcaagaatctgcacgatgtctgcaagagacagaggaagaccttgcaggacaatcagctctgcatggaggaggcaatgaacagcagccacgacaagaagcaagcacaggcattagcattcgaggagtcagaggtggaatttgggtccagtaaacagtgtcatctgagacaactccagcaactgaagaaaaaattgctggtccttcaacaagaactggagtttcacacagaggagttgcagacttcttactattctctccgccagtatcagtccatcctagagaagcagacttccgacctggttcttctgcaccatcactgcaaactgaaagaagatgaggtgattctctatgaggaggaaatgggaaatcacaacgagaacacaggggagaagct

SEQ ID NO: 5804 - DNA, 458 bp, Homo sapiens
caacaggcaacatactagataatagaagttcaccagctgaggactacgaggatattgaggacaatgtggagcagagccccagctgactcataaaggacatgtagcatgagtaaaaaataaaccttcacggtcgtaagccactgagacttgggggttgtttgttactacaccatcacctagcctgtccccaccaggtttataacaaagctcagaaaatactaaaggttaaaggagaattgagagctgccaaggaaatgaaagatgaggcgggggagagagacagagaagtgagcagcctgaacagcaagctgttaagcctgcaacttgacatcaagaatctgcacgatgtctgcaagagacagaggaagaccttgcaggacaatcagctctgcatggaggaggcaatgaacagcagccacgacaagaagcaagcacaggcattagcattcgaggagtca

SEQ ID NO: 5805 - DNA, 3935 bp, Homo sapiens
attctttcttcctcttggcttatattagggataggggatgtggtttgttacaaaggatgagtattttgatagcttctcattccttgaactattctgcaggtttataacaaagctcagaaaatactaaaggttaaaggagaattgagagctgccaaggaaatgaaagatgaggcgggggagagagacagagaagtgagcagcctgaacagcaagctgttaagcctgcaacttgacatcaagaatctgcacgatgtctgcaagagacagaggaagaccttgcaggacaatcagctctgcatggaggaggcaatgaacagcagccacgacaagaagcaagcacaggcattagcattcgaggagtcagaggtggaatttgggtccagtaaacagtgtcatctgagacaactccagcaactgaagaaaaaattgctggtccttcaacaagaactggagtttcacacagaggagttgcagacttcttactattctctccgccagtatcagtccatcctagagaagcagacttccgacctggttcttctgcaccatcactgcaaactgaaagaagatgaggtgattctctatgaggaggaaatgggaaatcacaacgagaacacaggggagaagctccatttggcgcaggagcaactcgccttggccggggacaagatcgcctctctagagaggagcttaaacctctacagggataaataccagtcttccctgagcaacatcgagttactagaatgccaagtgaagatgttgcagggggaactcggcgggatcatgggtcaggagcctgagaacaagggtgatcattcaaaggtacggatatacacttctccttgcatgattcaagagcatcaggagactcagaaacgactgtctgaagtctggcaaaaggtctctcaacaggatgatctcattcaagaacttcgaaataagctggcctgcagtaacgctttggttctggagcgtgaaaaggctttgataaaactacaagccgattttgcttcctgtacagccacccacagataccctcctagctcctcagaagagtgtgaagacatcaaaaagatactgaagcacttgcaggagcagaaagacagccagtgcctgcatgtggaggagtaccagaacctggtgaaggatctgcgcgtggaactagaggccgtgtcggaacagaagagaaacatcatgaaggacatgatgaagctggagctggacctgcacggactgcgggaggagacatctgcccacattgagaggaaggataaggacatcaccatcctgcagtgccggctgcaggagctgcagctggagttcaccgagacccaaaagctcactttgaagaaagacaagttcctccaagagaaagatgagatgctgcaagagctggagaagaaactgacacaggttcagaacagcctcctgaaaaaggagaaggagctggagaagcagcagtgcatggccacagaacttgaaatgacagtcaaggaggctaagcaggacaagtccaaggaggcggagtgcaaggccctgcaggctgaggtccagaagctgaagaacagtctcgaagaggccaagcagcaggagaggctggctggtgaggcccctgcagctcagcaagcagcccagtgcaaagaagaggctgcactggcaggctgtcacctggaggacacccagaggaaactgcagaagggtctcctcctggacaagcagaaggcagacaccatccaggaactacagagagaacttcagatgctgcagaaggagtcctcgatggctgagaaggaacaaacctccaacagaaaacgggtggaggagctgtcattagaactctctgaagccctgaggaagcttgaaaattcagacaaggaaaagaggcagcttcagaagacagtggctgagcaggatatgaaaatgaatgacatgcttgatcgtatcaagcaccagcacagggagcaaggctccatcaaatgcaagttagaagaagatcttcaggaggccacaaagcttctggaggacaaacgggagcagttgaagaagagcaaagagcatgagaagctgatggagggagaacttgaagctttgcggcaggaatttaaaaagaaagacaagacgttgaaagagaattccagaaagttggaggaagaaaatgagaatctccgagcagagctacagtgttgttctacacaactggaatcctctctcaacaaatacaacaccagccagcaagtcatccaagacttgaataaagagatagcccttcagaaggagtccttaatgagcctgcaggcccagctggacaaagctctgcagaaggagaagcactatctccagactaccatcaccaaagaagcctatgatgcattatcccggaagtcagccgcctgccaggatgacctgacacaagccctcgagaagctcaatcacgtgacctcagagacaaagagcctgcagcaaagcttgacacagacccaagagaagaaagctcagctggaagaggaaatcattgcttatgaggaaaggatgaaaaagctcaatacggaattaagaaaactgcggggcttccaccaggagagtgagctggaggtgcacgcctttgacaagaagctagaggagatgagctgccaggtgctgcagtggcagaagcaacaccagaatgacctcaagatgctggcagccaaagaggagcagctcagggagttccaggaggagatggccgccttaaaagagaacctccttgaggacgataaggagccctgctgcctgccccagtggtctgtgcccaaagacacctgtaggctctaccgagggaatgatcagattatgaccaacttggagcaatgggcaaaacagcagaaggtcgccaatgagaaactaggaaaccagctccgagagcaggtgaaatacattgccaagctgagtggcgaaaaggaccacctccacagtgtaatggtccacttgcagcaggaaaacaagaagctgaagaaggagatagaagagaagaagatgaaagccgagaacacaaggctatgcaccaaagccctaggcccgagcagaacggagtccacacagagggagaaagtgtgcggcaccttgggctggaaggggttgccccaggatatgggtcaaagaatggacctcaccaagtacatcgggatgccccactgcccgggtacgtctgccatttgtcaaaaaaataagtgtgatttttttctttaaatcactggattgagaattcaagtaggaagaagaaaataggccttttgtggcctcaagtcattttcttagcgactttggaccaaagatcgttgttttcacatctgtaaagggaggaggcaaattaagaccccttctgatctaagaacatctgaagcatacccaagtgcctcacatctcagacctgccccctcccctgacccagacccattttagggaacaggtagaagaggcatcttccttctacgtctggaaaccccgtaagagcaccccagccacctacccagcctgggtccacagccgcctttcctgccacctgtaaactccatgttaccccagaggcaagaagtcaccctgcagcagagctgcctggccatgcggccagcccttgaggaatcacctcgttaatttctcctcgaatcaaaactctcatttcctccctgttccctcaggttcctcatactgctagaatccacatctagccctgagcagcatttccacgggtgtttcttcagaggacagtgagttcccagccctccctctctcttgacctggatcagctcttacaggagtatatcacggtcccagcctattttgcaagacactaacttttgttgagttttgtccacttcctgccatggagtgagctttagaaccatactaccatctccaggcccaaactctgaaataaagacatgagcatgagcaca

SEQ ID NO: 5806 - DNA, 556 bp, Homo sapiens
agctagataagtctcagcacttcacatgtttcctaactttatgagcatcaacattatggcaagctgatgcttcaaaaacaccatatcatcagatatttcatatgaatagttacaaaattaatggaagctcctcatagagtagtaagagagcctctgtgaccctgggtttataacaaagctcagaaaatactaaaggttaaaggagaattgagagctgccaaggaaatgaaagatgaggcgggggagagagacagagaagtgagcagcctgaacagcaagctgttaagcctgcaacttgacatcaagaatctgcacgatgtctgcaagagacagaggaagaccttgcaggacaatcagctctgcatggaggaggcaatgaacagcagccacgacaagaagcaagcacaggcattagcattcgaggagtcagaggtggaatttgggtccagtaaacagtgtcatctgagacaactccagcaactgaagaaaaaattgctggtccttcaacaagaactggagtttcacacagaggagttgcagacttcttactattctc

SEQ ID NO: 5807 - DNA, 407 bp, Homo sapiens
tgaaacaggggttccaaaatgtagagtataagcaactagtggaggtgctagaaacggcacagctgtcaccaagagaagtcctactttgaaaagcagatggcaggagttttgaatacaaaaaaggagttgcctgggcagatggcagtagacaaggcatgaagaaatgaaggtctcaacagagacgcaagaggcagaacagaatatgtttataacaaagctcagaaaatactaaaggttaaaggagaattgagagctgccaaggaaatgaaagatgaggcgggggagagagacagagaagtgagcagcctgaacagcaagctgttaagcctgcaacttgacatcaagaatctgcacgatgtctgcaagagacagaggaagaccttgcaggacaatcagctctgcatgga

SEQ ID NO: 5808 - DNA, 1858 bp, Homo sapiens
ccccctcgctccgcctccggcctcctccgagagctccagacctcccggctactcagaagccctcggactgcccggaccgcgcgatggagtcgaccggcagcgtcggggaggccccgggcggaccccgggtgctggtggtgggcggcggcatcgcggggctgggcgcggcgcagaggctctgcggccactccgccttcccgcacctgcgggtcctggaggccacggcccgcgccgggggccgcatccgctcggagcgctgcttcggtggcgtggtggaggtgggcgcgcactggatccatgggccctcccggggtaaccccgtcttccagctggctgctgagtacgggctgctgggggagaaggagctgtcccaggagaaccagctggtggagaccgggggtcacgtgggcctgccctccgtgagctacgccagctccggggccagcgtgagcctccagctggtggcggagatggcgactctgttctacggcctgatagaccagacccgggagttcctgcacgctgcagagaccccggtgcccagcgtcggggagtacctcaagaaggagattggccagcacgtggccggctggacagaggatgaggagaccaggaagctgaagctggccgtcctgaactccttcttcaacctggaatgctgtgtgagcggcacccacagcatggacctggtggccctggcaccctttggggagtataccgtgctgccggggctggactgcaccttttctaagggctatcaaggactcacaaactgcatgatggccgccctgccggaggacactgtagtttttgagaagcctgtgaagaccatccactggaacgggtccttccaggaggcagcctttcccggggagacctttccagtgtcggtagagtgtgaggatggagaccggttcccggcgcaccatgtcatcgtcaccgtgcccttaggttttcttagggaacatttggacaccttctttgaccctcccctgccggctgagaaggcagaagcaatcaggaagataggctttgggaccaacaacaaaatcttcctggagtttgaggagcccttctgggagccagactgccagctgatccagctggtgtgggaggacacgtcgcccctggaggatgctgcccctgagctacaggacgcctggttccggaagctcattggctttgtggtcctgcctgcctttgcgtctgtccacgttctctgtgggttcattgccggacttgagtctgagttcatggagactctgtcggatgaagaagtacttctgtgtctcacccaagtgctccggagagtgacaggaaacccacggctccccgcgcccaagagcgtcctgcggtctcgctggcacagcgccccgtacactagggggtcctacagctacgtggccgtgggcagtactgggggcgacctggacctgctggctcagcccctccctgcagacggcgccggcgcccagctccagatcctgtttgcgggggaagccacacatcgcacgttttactccacgacgcacggggctctgctgtcgggatggagggaggccgaccgcctcctcagtctgtgggccccgcaggtgcagcagcccaggcccaggctctagctgggcccagcctactctgttccacccgtgtcgggggtaggctgggaccctcatttcttctgacagatttcagtctggcttgaaatttggggatgttaatgagggtcctctggtttttggtaaccagggccaccttctcagttcttgtgtctgttattggagtctggccagggttgacttgagctgagacaccagatgctcacggagatgctggacacataaagcaagttacagccaca

SEQ ID NO: 5809 - DNA, 1633 bp, Homo sapiens
cgagagctccagacctcccggctactcagaagccctcggactgcccggaccgcgcgatggagtcgaccggcagcgtcggggaggccccgggcggaccccgggtgctggtggtgggcggcggcatcgcggggctgggcgcggcgcagaggctctgcggccactccgccttcccgcacctgcgggtcctggaggccacggcccgcgccgggggccgcatccgctcggagcgctgcttcggtggcgtggtggaggtgggcgcgcactggatccatgggccctcccggggtaaccccgtcttccagctggctgctgagtacgggctgctgggggagaaggagctgtcccaggagaaccagctggtggagaccgggggtcacgtgggcctgccctccgtgagctacgccagctccggggccagcgtgagcctccagctggtggcggagatggcgactctgttctacggcctgatagaccagacccgggagttcctgcacgctgcagagaccccggtgcccagcgtcggggagtacctcaagaaggagattggccagcacgtggccggctggacagaggatgaggagaccaggaagctgaagctggccgtcctgaactccttcttcaacctggaatgctgtgtgagcggcacccacagcatggacctggtggccctggcaccctttggggagtataccgtgctgccggggctggactgcaccttttctaagggctatcaaggactcacaaactgcatgatggccgccctgccggaggacactgtagtttttgagaagcctgtgaagaccatccactggaacgggtccttccaggaggcagcctttcccggggagacctttccagtgtcggtagagtgtgaggatggagaccggttcccggcgcaccatgtcatcgtcaccgtgcccttaggttttcttagggaacatttggacaccttctttgaccctcccctgccggctgagaaggcagaagcaatcaggaagataggctttgggaccaacaacaaaatcttcctggagtttgaggagcccttctgggagccagactgccagctgatccagctggtgtgggaggacacgtcgcccctggaggatgctgcccctgagctacaggacgcctggttccggaagctcattggctttgtggtcctgcctgcctttgcgtctgtccacgttctctgtgggttcattgccggacttgagtctgagttcatggagactctgtcggatgaagaagtacttctgtgtctcacccaagtgctccggagagtgacagctccagatcctgtttgcgggggaagccacacatcgcacgttttactccacgacgcacggggctctgctgtcgggatggagggaggccgaccgcctcctcagtctgtgggccccgcaggtgcagcagcccaggcccaggctctagctgggcccagcctactctgttccacccgtgtcgggggtaggctgggaccctcatttcttctgacagatttcagtctggcttgaaatttggggatgttaatgagggtcctctggtttttggtaaccagggccaccttctcagttcttgtgtctgttattggagtctggccagggttgacttgagctgagacaccagatgc

SEQ ID NO: 5810 - DNA, 483 bp, Homo sapiens
ctggctgctgagtacgggctgctgggggagaaggagctgtcccaggagaaccagctggtggagaccgggggtcacgtgggcctgccctccgtgagctacgccagctccggggccagcgtgagcctccagctggtggcggagatggcgactctgttctacggcctgatagaccagacccgggagttcctgcacgctgcagagaccccggtgcccagcgtcggggagtacctcaagaaggagattggccagcacgtggccggctggacagaggatgaggagaccaggaagctgaagctggccgtcctgaactccttcttcaacctggaatgctgtgtgagcggcacccacagacgcacggggctctgctgtcgggatggagggaggccgaccgcctcctcagtctgtgggccccgcaggtgcagcagcccaggcccaggctctagctgggcccagcctactctgttccacccgtgtcgggggtag

SEQ ID NO: 5811 - DNA, 1061 bp, Homo sapiens
ccgcgcctccccgcccctccccgcccctcccagcgcctccccgccccctcgctccgcctccggcctcctccgagagctccagacctcccggctactcagaagccctcggactgcccggaccgcgcgatggagtcgaccggcagcgtcggggaggccccgggcggaccccgggtgctggtggtgggcggcggcatcgcggggctgggcgcggcgcagaggctctgcggccactccgccttcccgcacctgcgggtcctggaggccacggcccgcgccgggggccgcatccgctcggagcgctgcttcggtggcgtggtggaggtgggcgcgcactggatccatgctgcccctgagctacaggacgcctggttccggaagctcattggctttgtggtcctgcctgcctttgcgtctgtccacgttctctgtgggttcattgccggacttgagtctgagttcatggagactctgtcggatgaagaagtacttctgtgtctcacccaagtgctccggagagtgacaggaaacccacggctccccgcgcccaagagcgtcctgcggtctcgctggcacagcgccccgtacactagggggtcctacagctacgtggccgtgggcagtactgggggcgacctggacctgctggctcagcccctccctgcagacggcgccggcgcccagctccagatcctgtttgcgggggaagccacacatcgcacgttttactccacgacgcacggggctctgctgtcgggatggagggaggccgaccgcctcctcagtctgtgggccccgcaggtgcagcagcccaggcccaggctctagctgggcccagcctactctgttccacccgtgtcgggggtaggctgggaccctcatttcttctgacagatttcagtctggcttgaaatttggggatgttaatgagggtcctctggtttttggtaaccagggccaccttctcagttcttgtgtctgttattggagtctggccagggttgacttgagctgagacaccagatgctcacggagatgctggacacataaagcaagttacagcc

SEQ ID NO: 5812 - DNA, 1411 bp, Homo sapiens
ccgcgcctccccgcccctccccgcccctcccagcgcctccccgccccctcgctccgcctccggcctcctccgagagctccagacctcccggctactcagaagccctcggactgcccggaccgcgcgatggagtcgaccggcagcgtcggggaggccccgggcggaccccgggtgctggtggtgggcggcggcatcgcggggctgggcgcggcgcagaggctctgcggccactccgccttcccgcacctgcgggtcctggaggccacggcccgcgccgggggccgcatccgctcggagcgctgcttcggggctatcaaggactcacaaactgcatgatggccgccctgccggaggacactgtagtttttgagaagcctgtgaagaccatccactggaacgggtccttccaggaggcagcctttcccggggagacctttccagtgtcggtagagtgtgaggatggagaccggttcccggcgcaccatgtcatcgtcaccgtgcccttaggttttcttagggaacatttggacaccttctttgaccctcccctgccggctgagaaggcagaagcaatcaggaagataggctttgggaccaacaacaaaatcttcctggagtttgaggagcccttctgggagccagactgccagctgatccagctggtgtgggaggacacgtcgcccctggaggatgctgcccctgagctacaggacgcctggttccggaagctcattggctttgtggtcctgcctgcctttgcgtctgtccacgttctctgtgggttcattgccggacttgagtctgagttcatggagactctgtcggatgaagaagtacttctgtgtctcacccaagtgctccggagagtgacaggaaacccacggctccccgcgcccaagagcgtcctgcggtctcgctggcacagcgccccgtacactagggggtcctacagctacgtggccgtgggcagtactgggggcgacctggacctgctggctcagcccctccctgcagacggcgccggcgcccagctccagatcctgtttgcgggggaagccacacatcgcacgttttactccacgacgcacggggctctgctgtcgggatggagggaggccgaccgcctcctcagtctgtgggccccgcaggtgcagcagcccaggcccaggctctagctgggcccagcctactctgttccacccgtgtcgggggtaggctgggaccctcatttcttctgacagatttcagtctggcttgaaatttggggatgttaatgagggtcctctggtttttggtaaccagggccaccttctcagttcttgtgtctgttattggagtctggccagggttgacttgagctgagacaccagatgctcacggagatgctggacacataaagcaagttacagcc

SEQ ID NO: 5813 - DNA, 1754 bp, Homo sapiens
ccgcgcctccccgcccctccccgcccctcccagcgcctccccgccccctcgctccgcctccggcctcctccgagagctccagacctcccggctactcagaagccctcggactgcccggaccgcgcgatggagtcgaccggcagcgtcggggaggccccgggcggaccccgggtgctggtggtgggcggcggcatcgcggggctgggcgcggcgcagaggctctgcggccactccgccttcccgcacctgcgggtcctggaggccacggcccgcgccgggggccgcatccgctcggagcgctgcttcggtggcgtggtggaggtgggcgcgcactggatccatgggccctcccggggtaaccccgtcttccagctggctgctgagtacgggctgctgggggagaaggagctgtcccaggagaaccagctggtggagaccgggggtcacgtgggcctgccctccgtgagctacgccagctccggggccagcgtgagcctccagctggtggcggagatggcgactctgttctacggcctgatagaccagacccgggagttcctgcacgctgcagagaccccggtgcccagcgtcggggagtacctcaagaaggagattggccagcacgtggccggctggacagaggatgaggagaccaggaagctgaagctggccgtcctgaactccttcttcaacctggaatgctgtgtgagcggcacccacagcatggacctggtggccctggcaccctttggggagtataccgtgctgccggggctggactgcaccttttctaagggctatcaaggactcacaaactgcatgatggccgccctgccggaggacactgtagtttttgagaagcctgtgaagaccatccactggaacgggtccttccaggaggcagcctttcccggggagacctttccagtgtcggtagagtgtgaggatggagaccggttcccggcgcaccatgtcatcgtcaccgtgcccttaggttttcttagggaacatttggacacgtcgcccctggaggatgctgcccctgagctacaggacgcctggttccggaagctcattggctttgtggtcctgcctgcctttgcgtctgtccacgttctctgtgggttcattgccggacttgagtctgagttcatggagactctgtcggatgaagaagtacttctgtgtctcacccaagtgctccggagagtgacaggaaacccacggctccccgcgcccaagagcgtcctgcggtctcgctggcacagcgccccgtacactagggggtcctacagctacgtggccgtgggcagtactgggggcgacctggacctgctggctcagcccctccctgcagacggcgccggcgcccagctccagatcctgtttgcgggggaagccacacatcgcacgttttactccacgacgcacggggctctgctgtcgggatggagggaggccgaccgcctcctcagtctgtgggccccgcaggtgcagcagcccaggcccaggctctagctgggcccagcctactctgttccacccgtgtcgggggtaggctgggaccctcatttcttctgacagatttcagtctggcttgaaatttggggatgttaatgagggtcctctggtttttggtaaccagggccaccttctcagttcttgtgtctgttattggagtctggccagggttgacttgagctgagacaccagatgctcacggagatgctggacacataaagcaagttacagcc

SEQ ID NO: 5814 - DNA, 448 bp, Homo sapiens
atggagtcgaccggcagcgtcggggaggccccgggcggaccccgggtgctggtggtgggcggcggcatctccagatcctgtttgcgggggaagccacacatcgcacgttttactccacgacgcacggggctctgctgtcgggatggagggaggccgaccgcctcctcagtctgtgggccccgcaggtgcagcagcccaggcccaggctctagctgggcccagcctactctgttccacccgtgtcgggggtaggctgggaccctcatttcttctgacagatttcagtctggcttgaaatttggggatgttaatgagggtcctctggtttttggtaaccagggccaccttctcagttcttgtgtctgttattggagtctggccagggttgacttgagctgagacaccagatgctcacggagatgctggacacataaagcaagttacagcc

SEQ ID NO: 5815 - DNA, 1324 bp, Homo sapiens
cagaagccctcggactgcccggaccgcgcgatggagtcgaccggcagcgtcggggaggccccgggcggaccccgggtgctggtggtgggcggcggcatcgcggggctgggcgcggcgcagaggctctgcggccactccgccttcccgcacctgcgggtcctggaggccacggcccgcgccgggggccgcatccgctcggagcgctgcttcggtggcgtggtggaggtgggcgcgcactggatccatgggccctcccggggtaaccccgtcttccagctggctgctgagtacgggctgctgggggagaaggagctgtcccaggagaaccagctggtggagaccgggggtcacgtgggcctgccctccgtgagctacgccagctccggggccagcgtgagcctccagctggtggcggagatggcgactctgttctacggcctgatagaccagacccgggagttcctgcacgctgcagagaccccggtgcccagcgtcggggagtacctcaagaaggagattggccagcacgtggccggctggacagaggatgaggagaccaggaagctgaagctggccgtcctgaactccttcttcaacctggaatgctgtgtgagcggcacccacagcatggacctggtggccctggcaccctttggggagtataccgtgctgccggggctggactgcaccttttctaagggctatcaaggactcacaaactgcatgatggccgccctgccggaggacactgtagtttttgagaagcctgtgaagaccatccactggaacgggtccttccaggaggcagcctttcccggggagacctttccagtgtcggtagagtgtgaggatggagaccggttcccggcgcaccatgtcatcgtcaccgtgcccttaggtctgtccacgttctctgtgggttcattgccggacttgagtctgagttcatggagactctgtcggatgaagaagtacttctgtgtctcacccaagtgctccggagagtgacagctccagatcctgtttgcgggggaagccacacatcgcacgttttactccacgacgcacggggctctgctgtcgggatggagggaggccgaccgcctcctcagtctgtgggccccgcaggtgcagcagcccaggcccaggctctagctgggcccagcctactctgttccacccgtgtcgggggtaggctgggaccctcatttcttctgacagatttcagtctggcttgaaatttggggatgttaatgagggtcctctggtttttggtaaccagggccaccttctcagttcttgtgtctgttattggagtctggcc

SEQ ID NO: 5816 - DNA, 773 bp, Homo sapiens
atggagtcgaccggcagcgtcggggaggccccgggcggacgccacggcccgcgccgggggccgcatccgctcggagcgctgcttcggtggcgtggtggaggtgggcgcgcactggatccatgctgcccctgagctacaggacgcctggttccggaagctcattggctttgtggtcctgcctgcctttgcgtctgtccacgttctctgtgggttcattgccggacttgagtctgagttcatggagactctgtcggatgaagaagtacttctgtgtctcacccaagtgctccggagagtgacaggaaacccacggctccccgcgcccaagagcgtcctgcggtctcgctggcacagcgccccgtacactagggggtcctacagctacgtggccgtgggcagtactgggggcgacctggacctgctggctcagcccctccctgcagacggcgccggcgcccagctccagatcctgtttgcgggggaagccacacatcgcacgttttactccacgacgcacggggctctgctgtcgggatggagggaggccgaccgcctcctcagtctgtgggccccgcaggtgcagcagcccaggcccaggctctagctgggcccagcctactctgttccacccgtgtcgggggtaggctgggaccctcatttcttctgacagatttcagtctggcttgaaatttggggatgttaatgagggtcctctggtttttggtaaccagggccaccttctcagttcttgtgtctgttattggagtctggcc

SEQ ID NO: 5817 - DNA, 3427 bp, Homo sapiens
atgagtgcagtgggcttggtactcctggtgcttgctctgaggcttagggccaccactgttaagccagaggaaggcagcttttgctctaacagccaggtggccttcagagatgcttgctatgaatttgtgccactcggacgcaccttccgtgatgcccagagctggtgcgaggggcaaggaggccatttggtcttcattcaggacgaaggcacccagtggtttctgcagaagcacatctcccaggacagggaatggtggattggactcacgtggaacttggcacggaatggaaccacggaggggccggggacttggttggacacctccaatgtgacctacagcaactggcatggagggcaggccgccgctgcccctgacacctgcggccacatcgggagaggcccttcctctgagtgggtgacctcggactgcgcccagaccttcgccttcatgtgcgagttccgggttggccagagcctggcctgcgagggactcaatgccaccgtgcactgtggcttggggcaggtcatccaggtccaggatgccgtctacgggcgccagaatccccatttctgcacccaggatgccgggcgtccttcagatctggagcagggatgcagctgggccaacgtcaaggaggaggtggcaggccagtgccaggagctacagtcatgccaggtggcagcagatgagacctactttggaaacctgtgtccgactcagggcagttacctgtgggtgcagtaccagtgccgggaagccctgcagctgatggtgtccagtgagagtttcatctttgacaatgtcaccatctccctgacgtggctcctctcaccctacataggaaacctgtcctgtataattagtacaggagacagccacacttttgatccctacaacccgccgagtgtgtccagcaatgtgacccaccagttcacatctcctggggaattcaccgtgtttgctgaatgcacaaccagtgagtggcatgtgacagctcagaggcaggtgaccgtgcgagacaagatggagacgctcagtgtgactgcatgctccggcctgtcccagtcaggagccggccctctctgccaggctgtctttggggatcctctgtggattcaggtggagcttgatggaggaacaggagtgacttacactgtgcttttgggtgacataaccctggccgagtccaccacccaaaagggctcgctaccgtacaatctgatcctggacagagaaacccagaaactgatgggccctgggaggcaccgcctggagatccaagccaccggcaacaccaccacctctacaatctccagaaacattacagtccacttggtggagctgctgtcagggctgcaggcctcctgggcttctgaccatttggagcttggacaggacctattgatcaccatctcattggctcagggcaccccggaagagctgacctttgaggtggctggactcaatgcaaccttctcccacgagcaagtgagctttggagagccatttgggatttgccgcctggctgttccggttgaaggcacctttctggtcaccatgctggtgaggaatgccttctccaacctgagtttggaaatcgggaacatcactatcacagccccttccggtctccaagaaccatctgggatgaatgctgaaggaaagagtaaagataaaggcgatatggaggtgtacatccaacctggtccatatgtggatcctttcacgacagtgaccctgggctggccagacaatgacaaggagttacgcttccaatggtcatgtgggtcttgctgggctctgtggagcagctgtgttgagaggcagctgcttcgcacagaccagagggagctggtggttccagcatcctgcctgccgccgcctgactctgctgtcaccctgcgcctggctgttctgagaggccaagagctggagaacagggcagagcagtgcctctacgtgtctgcgccctgggaactcaggcctcgagtcagctgtgagaggaactgcaggccagttaatgccagcaaagacattctgctcagggtcaccatgggggaggactctccagtggctatgttcagctggtatttggacaacaccccaacagagcaggctgagcccctcctggatgcctgcagactcagaggattttggccaaggtccttaaccctcctccagagcaacacctccacgttgctgttgaacagctcgtttctgcagtcccggggagaggtcatccgaatcagagccacagcactgaccaggcatgcctatggggaggacacctatgtgatcagcactgtgcctccccgtgaggtgcctgcctgcactattgccccagaggagggcaccgttctgacgagctttgccatcttctgcaacgcctccacagccctgggacccctggagttctgcttctgtctggaatcaggttcctgcctacactgtggccctgaacctgccctcccatcagtgtatctgccacttggagaggagaacaatgactttgtgctgacagtagttatttctgccaccaatcgtgcaggggacacgcagcagacccaggccatggctaaggtggcactcggagacacatgtgttgaggatgtagcattccaggctgccgtgtcagagaaaatccccacagctctgcaaggcgagggtggccccgagcagctcctccagctggccaaggctgtgtcctccatgctgaaccaagagcatgaaagccagggctcaggacagtcactgagcatagacgtcagacagaaggtcagagagcatgtgctgggatcactgtctgcagtcaccaccggcttggaggacgtgcagagggtgcaggagctggccgaggtgctgagagaggtgacctgccggagtaaggaactcacaccctcggcccaggggtcctgcatgggcgattcatgggaaggtgcccctcctgctgcccatgtatctcacgctaggtgagagggcctgtttgcccagactctcactcctgcatctgctggtgagcaagttgagggagtaactgaatctcattaatatttgggtggccaaatgtgagtccagacactgctactgactgcccatgttctcaacttcagtacatgccagcctgacatctggctgccagctcctgtgcttccttatccttctgggggtcttctctgaccctcagagcctactgtacctgcccatatggctgtgaattcatgcagtgttcagtgactaatgaagctggcttataaacaccccagctacctcacccctcttgatggataatcccaagcaggagtgaatcccaggtaatgggcttgatcacactcctgtactggcttccacccttccctgtctcacaccccctactccccacaagtgtttcttgggatcatgtccaaataaatgacttgctctcaaa

SEQ ID NO: 5818 - DNA, 2006 bp, Homo sapiens
attggctcagggcaccccggaagagctgacctttgaggtggctggactcaatgcaaccttctcccacgagcaagtgagctttggagagccatttgggatttgccgcctggctgttccggttgaaggcacctttctggtcaccatgctggtgaggaatgccttctccaacctgagtttggaaatcgggaacatcactatcacagccccttccggtctccaagaaccatctgggatgaatgctgaaggaaagagtaaagataaaggcgatatggaggtgtacatccaacctggtccatatgtggatcctttcacgacagtgaccctgggctggccagacaatgacaaggagttacgcttccaatggtcatgtgggtcttgctgggctctgtggagcagctgtgttgagaggcagctgcttcgcacagaccagagggagctggtggttccagcatcctgcctgccgccgcctgactctgctgtcaccctgcgcctggctgttctgagaggccaagagctggagaacagggcagagcagtgcctctacgtgtctgcgccctgggaactcaggcctcgagtcagctgtgagaggaactgcaggccagttaatgccagcaaagacattctgctcagggtcaccatgggggaggactctccagtggctatgttcagctggtatttggacaacaccccaacagagcaggctgagcccctcctggatgcctgcagactcagaggattttggccaaggtccttaaccctcctccagagcaacacctccacgttgctgttgaacagctcgtttctgcagtcccggggagaggtcatccgaatcagagccacagcactgaccaggcatgcctatggggaggacacctatgtgatcagcactgtgcctccccgtgaggtgcctgcctgcactattgccccagaggagggcaccgttctgacgagctttgccatcttctgcaacgcctccacagccctgggacccctggagttctgcttctgtctggaatcaggttcctgcctacactgtggccctgaacctgccctcccatcagtgtatctgccacttggagaggagaacaatgactttgtgctgacagtagttatttctgccaccaatcgtgcaggggacacgcagcagacccaggccatggctaaggtggcactcggagacacatgtgttgaggatgtagcattccaggctgccgtgtcagagaaaatccccacagctctgcaaggcgagggtggccccgagcagctcctccagctggccaaggctgtgtcctccatgctgaaccaagagcatgaaagccagggctcaggacagtcactgagcatagacgtcagacagaaggtcagagagcatgtgctgggatcactgtctgcagtcaccaccggcttggaggacgtgcagagggtgcaggagctggccgaggtgctgagagaggtgacctgccggagtaaggaactcacaccctcggcccaggggtcctgcatgggcgattcatgggaaggtgcccctcctgctgcccatgtatctcacgctaggtgagagggcctgtttgcccagactctcactcctgcatctgctggtgagcaagttgagggagtaactgaatctcattaatatttgggtggccaaatgtgagtccagacactgctactgactgcccatgttctcaacttcagtacatgccagcctgacatctggctgccagctcctgtgcttccttatccttctgggggtcttctctgaccctcagagcctactgtacctgcccatatggctgtgaattcatgcagtgttcagtgactaatgaagctggcttataaacaccccagctacctcacccctcttgatggataatcccaagcaggagtgaatcccaggtaatgggcttgatcacactcctgtactggcttccacccttccctgtctcacaccccctactccccacaagtgtttcttgggatcatgtccaaataaatgacttgctctc

SEQ ID NO: 5819 - DNA, 965 bp, Homo sapiens
agaggaacagggccctggagcacctggtttcggggacagtagggttggtgggagttgcgatgatattgccacctacctcttacatcttttagtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaaggcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccacc

SEQ ID NO: 5820 - DNA, 1110 bp, Homo sapiens
agaggaacagggccctggagcacctggtttcggggacagtagggttggtgggagttgcgatgatattgccacctacctcttacatcttttagtgcgtatgttctgtccacccagctactggttcatttgagtagatcggagtcagatgagtacatgtttacgggaggcgcttggttacgggatccagataggaatctttatctgagctgcttgtcagtttgttcgtctgtccctaggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaaggcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccacc

SEQ ID NO: 5821 - DNA, 1056 bp, Homo sapiens
tgcctcctgagcgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtaacgttggggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaaggcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccacc

SEQ ID NO: 5822 - DNA, 760 bp, Homo sapiens
tgcctcctgagcgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccacc

SEQ ID NO: 5823 - DNA, 2229 bp, Homo sapiens
ctctaaccctctccccttccgtctcggtacctcagctgtcctctcgccctccgttgggcttctccccagcggggccgggacccctctagtctccaccactcccctgggctctgtcagggctcccctgtccgtctttctgtcactacctcccagccagattgggacatcccactcacccgctccccagagctgtgtccaggaccctgctgaccccctcacccaccaggtctcccgcctcccccatttccctctcttcactgggcaggggttccttctgtcactttaggtatgtaccaggcctctgctgtcagcctccttccgcgagacattccctcctgtcacagcccctccccagggttctcccacctccctacctcctcttctcagctggccccggatctcctccagttccctttgggtcaggacccgagcttccttgccatccccattctgacactccctcccagtgacagtctagtcccaccgtacattgtgtggtacattgtgtggccttctgctctcatctcattcttgggctgcactcttacagtccagttctccaacgggaagctacagagtccaggcaacatgcgctttaccttgtatgagaacaaagattccaccaaccccaggaagaggaatcaacggatcctggcagctgaaacagataggctctcctatgtgggaaacaattttgggactggagccctcaaatgcaacactttgtgcaggcactttgtgggaattttgaacaagacctctggccaaatggaagtatatgatgctgaattgttcaacatgcagccactattttcagatgtatcagttgagagtgaactggcgctagagagtcagaccaaaacttacagagaaaagatggattcttgtattgaagcctttggtaccaccaaacagaagcgagctctgaacaccaggagaatgaacagagttggcaatgaatctttgaatcgtgcagtggctaaagctgcagagactatcattgatacgaagggtgtgactgctctggtcagcgatgctatccacaatgacttgcaagatgactccctctaccttcctccctgctatgatgatgcagccaagcctgaagacgtgtataaatttgaagatcttctttcccctgcggagtatgaagctcttcagagcccatctgaagctttcaggaacgtcacgtcagaagaaatactgaagatgattgaggagaacagccattgcacctttgtcatagaagcgttgaagtctttgccatcagatgtggagagccgagaccgccaggcccgatgcatatggtttctggataccctcatcaaatttcgagctcatagggtagttaagcggaaaagtgctctgggacctggagttccccacatcatcaacaccaaactgctgaagcactttacttgcttgacctacaacaatggcagattacggaacttaatttcggattctatgaaggcgaagattactgcatatgtgatcatacttgccttgcacatacatgacttccaaattgacctgacagtgttacagagggacttgaagctcagtgagaaaaggatgatggagatagccaaagccatgaggctgaagatctccaaaagaagggtgtctgtggccgccggcagtgaagaagatcacaagctgggcaccctgtccctcccgctgcctccagcccagacctcagaccgcctggcaaagcggaggaagattacctagacgcatgctttccagacagggcgttttggctgcatcacagccactggctggtcctattcatttccatttttatgtatgttttgaaaagaaaaggtccggggatggtggctcacacctgaaatcccagcactttgggaggccgaggcaggaagatcattgagctcaggagtttgaaaccagtctggacaacatagggagaccccatctctaccggaggaaaaaaaaaagagtcaggcctggtggtgtgcgcctgtaatcccagctactcgggaggctgaggcaggacgattacttgagcttgggaaatcaaggttgcagtgagctatgattgtgtggccacactccatcctgggtcacagagtgagaccttgtctcaaaaaagtaacataaggaaaaaagaagccttgctttagcacaggtatgaagccagaagccagcatctcaactgtgcttgtcttatgcagaaatataaagcgatggccaggttggacttca

SEQ ID NO: 5824 - DNA, 1868 bp, Homo sapiens
ggcggggccacgccttttccggcccgcagcgcggcctgggctcccgcgtgtttaaaagtgcgcttgtggctgctgctgtcttaactcctgtgcttggcggacagacaggcgagatggcggcggaggtgttgccgagtgcgaggtggcagtattgtggggcgcccgacgggagccagagagctgtactggtccagttctccaacgggaagctacagagtccaggcaacatgcgctttaccttgtatgagaacaaagattccaccaaccccaggaagaggaatcaacggatcctggcagctgaaacagataggctctcctatgtgggaaacaattttgggactggagccctcaaatgcaacactttgtgcaggcactttgtgggaattttgaacaagacctctggccaaatggaagtatatgatgctgaattgttcaacatgcagccactattttcagatgtatcagttgagagtgaactggcgctagagagtcagaccaaaacttacagagaaaagatggattcttgtattgaagcctttggtaccaccaaacagaagcgagctctgaacaccaggagaatgaacagagttggcaatgaatctttgaatcgtgcagtggctaaagctgcagagactatcattgatacgaagggtgtgactgctctggtcagcgatgctatccacaatgacttgcaagatgactccctctaccttcctccctgctatgatgatgcagccaagcctgaagacgtgtataaatttgaagatcttctttcccctgcggagtatgaagctcttcagagcccatctgaagctttcaggaacgtcacgtcagaagaaatactgaagatgattgaggagaacagccattgcacctttgtcatagaagcgttgaagtctttgccatcagatgtggagagccgagaccgccaggcccgatgcatatggtttctggataccctcatcaaatttcgagctcatagggtagttaagcggaaaagtgctctgggacctggagttccccacatcatcaacaccaaactgctgaagcactttacttgcttgacctacaacaatggcagattacggaacttaatttcggattctatgaaggcgaagattactgcatatgtgatcatacttgccttgcacatacatgacttccaaattgacctgacagtgttacagagggacttgaagctcagtgagaaaaggatgatggagatagccaaagccatgaggctgaagatctccaaaagaagggtgtctgtggccgccggcagtgaagaagatcacaagctgggcaccctgtccctcccgctgcctccagcccagacctcagaccgcctggcaaagcggaggaagattacctagacgcatgctttccagacagggcgttttggctgcatcacagccactggctggtcctattcatttccatttttatgtatgttttgaaaagaaaaggtccggggatggtggctcacacctgaaatcccagcactttgggaggccgaggcaggaagatcattgagctcaggagtttgaaaccagtctggacaacatagggagaccccatctctaccggaggaaaaaaaaaagagtcaggcctggtggtgtgcgcctgtaatcccagctactcgggaggctgaggcaggacgattacttgagcttgggaaatcaaggttgcagtgagctatgattgtgtggccacactccatcctgggtcacagagtgagaccttgtctcaaaaaagtaacataaggaaaaaagaagccttgctttagcacaggtatgaagccagaagccagcatctcaactgtgcttgtcttatgcagaaatataaagcgatggccaggttggacttca

SEQ ID NO: 5825 - DNA, 1343 bp, Homo sapiens
ccggcccgcagcgcggcctgggctcccgcgtgtttaaaagtgcgcttgtggctgctgctgtcttaactcctgtgcttggcggacagacaggcgagatggcggcggaggtgttgccgagtgcgaggtggcagtattgtggggcgcccgacgggagccagagagctgtactggtccagttctccaacgggaagctacagagtccaggcaacatgcgctttaccttgtatgagaacaaagattccaccaaccccaggaagaggaatcaacggatcctggcagctgaaacagataggctctcctatgtgggaaacaattttgggactggagccctcaaatgcaacactttgtgcaggcactttgtgggaattttgaacaagacctctggccaaatggaagtatatgatgctgaattgttcaacatgcagccactattttcagatgtatcagttgagagtgaactggcgctagagagtcagaccaaaacttacagagaaaagatgactccctctaccttcctccctgctatgatgatgcagccaagcctgaagacgtgtataaatttgaagatcttctttcccctgtggagagccgagaccgccaggcccgatgcatatggtttctggataccctcatcaaatttcgagctcatagggtagttaagcggaaaagtgctctgggacctggagttccccacatcatcaacaccaaactgctgaagcactttacttgcttgacctacaacaatggcagattacggaacttaatttcggattctatgaaggcgaagattactgcatatgtgatcatacttgccttgcacatacatgacttccaaattgacctgacagtgttacagagggacttgaagctcagtgagaaaaggatgatggagatagccaaagccatgaggctgaagatctccaaaagaagggtgtctgtggccgccggcagtgaagaagatcacaagctgggcaccctgtccctcccgctgcctccagcccagacctcagaccgcctggcaaagcggaggaagattacctagacgcatgctttccagacagggcgttttggctgcatcacagccactggctggtcctattcatttccatttttatgtatgttttgaaaagaaaaggtccggggatggtggctcacacctgaaatcccagcactttgggaggccgaggcaggaagatcattgagctcaggagtttgaaaccagtctggacaacatagggagaccccatctctaccggaggaaaaaaaaaagagtcaggcctggtggtgtgcgcctgtaatcccagctactcgggaggctgaggcaggacgattacttgagcttg

SEQ ID NO: 5826 - DNA, 1805 bp, Homo sapiens
cttttccggcccgcagcgcggcctgggctcccgcgtgtttaaaagtgcgcttgtggctgctgctgtcttaactcctgtgcttggcggacagacaggcgagatggcggcggaggtgttgccgagtgcgaggtggcagtattgtggggcgcccgacgggagccagagagctgtactggtccagttctccaacgggaagctacagagtccaggcaacatgcgctttaccttgtatgagaacaaagattccaccaaccccaggaagaggaatcaacggatcctggcagctgaaacagataggctctcctatgtgggaaacaattttgggactggagccctcaaatgcaacactttgtgcaggcactttgtgggaattttgaacaagacctctggccaaatggaagtatatgatgctgaattgttcaacatgcagccactattttcaggtctttcaccaagaaagcaaaattattttctggaaagagccaaggacttgttttctaatcctgtctctgccactacctggtgaactgacctgggatgtatcagttgagagtgaactggcgctagagagtcagaccaaaacttacagagaaaagatggattcttgtattgaagcctttggtaccaccaaacagaagcgagctctgaacaccaggagaatgaacagagttggcaatgaatctttgaatcgtgcagtggctaaagctgcagagactatcattgatacgaagggtgtgactgctctggtcagcgatgctatccacaatgacttgcaagatgactccctctaccttcctccctgctatgatgatgcagccaagcctgaagacgtgtataaatttgaagatcttctttcccctgcggagtatgaagctcttcagagcccatctgaagctttcaggaacgtcacgtcagaagaaatactgaagatgattgaggagaacagccattgcacctttgtcatagaagcgttgaagtctttgccatcagatgtggagagccgagaccgccaggcccgatgcatatggtttctggataccctcatcaaatttcgagctcatagggtagttaagcggaaaagtgctctgggacctggagttccccacatcatcaacaccaaactgctgaagcactttacttgcttgacctacaacaatggcagattacggaacttaatttcggattctatgaaggcgaagattactgcatatgtgatcatacttgccttgcacatacatgacttccaaattgacctgacagtgttacagagggacttgaagctcagtgagaaaaggatgatggagatagccaaagccatgaggctgaagatctccaaaagaagggtgtctgtggccgccggcagtgaagaagatcacaagctgggcaccctgtccctcccgctgcctccagcccagacctcagaccgcctggcaaagcggaggaagattacctagacgcatgctttccagacagggcgttttggctgcatcacagccactggctggtcctattcatttccatttttatgtatgttttgaaaagaaaaggtccggggatggtggctcacacctgaaatcccagcactttgggaggccgaggcaggaagatcattgagctcaggagtttgaaaccagtctggacaacatagggagaccccatctctaccggaggaaaaaaaaaagagtcaggcctggtggtgtgcgcctgtaatcccagctactcgggaggctgaggcaggacgattacttgagcttgggaaatcaaggttgcagtgagctatgattgtgtggccacactccatcctg

SEQ ID NO: 5827 - DNA, 818 bp, Homo sapiens
cttgaggaagcccagtacatttcaagttggtcgcggcttgggctccgctttggggaggggcagcaggtttattcactggatctctgaatacccaggccccctccaccatggccagccggggtgggggccggggtcgtggccggggccagttgaccttcaacgtggaggccgtgggcattgggaaaggggatgctttgcccccacccaccctgcagccttctccactcttccctcccttggagttccgcccagtacctttgccctcaggcgaggaaggggaatatgtcctggcactgaagcaagagctacgaggagccatgaggcagctcccctacttcatccggccagctgtccccaagagagattggcggcgtctaccccgggagctaaagatccgagtgcggaagctacagaaggaacggattacaattctgctccccaagaggccccctaagaccacagaagataaggaggaaacaatacagaaactagagaccctggagaagaaggaagaagaagtaacttcagaggaggatgaggagaaagaagaagaagaagagaaggaagaggaggaagaagaagagtatgatgaagaagaacatgaagaggaaactgattacatcatgtcatattttgacaatggagaggactttggtggtgacagtgatgacaatatggacgaggctatatactgaagaaggactctggaccctcgtgtctttctttaggatacagagagtaactgtacctattatttgtttcttcagacaagcaaatcatttggtcagagttcatataatctgtctgttccctggaga

SEQ ID NO: 5828 - DNA, 1165 bp, Homo sapiens
cttgaggaagcccagtacatttcaagttggtcgcggcttgggctccgctttggggaggggcagcaggtttattcactggatctctgaatacccaggccccctccaccatggccagccggggtgggggccggggtcgtggccggggccagttgaccttcaacgtggaggccgtgggcattgggaaaggggatgctttgcccccacccaccctgcagccttctccactcttccctcccttggagttccgcccagtacctttgccctcaggcgaggaaggggaatatgtcctggcactgaagcaagagctacgaggagccatgaggcagctcccctacttcatccggccagctgtccccaagagagatgtggagcgttattcagacaaatatcagatgtcaggtccgattgacaatgccatcgattggaaccctgattggcggcgtctaccccgggagctaaagatccgagtgcggaagctacagaaggaacggattacaattctgctccccaagaggccccctaagaccacagaagataaggaggaaacaatacagaaactagagaccctggagaagaaggaagaagaagtaacttcagaggaggatgaggagaaagaagaagaagaagagaaggaagaggaggaagaagaagagtatgatgaagaagaacatgaagaggaaactgattacatcatgtcatattttgacaatggagaggactttggtggtgacagtgatgacaatatggacgaggctatatactgaagaaggactctggaccctcgtgtctttctttaggatacagagagtaactgtacctattatttgtttcttcagacaagcaaatcatttggtcagagttcatataatctgtctgttccctggagatgggaatagaggatgatgacagtttattttctacacttcccctccttccacatttgtatcacctttgctatcttggggaaagtgcaaaggacaaacatctcaattgtatgaagggagaaaggagaattgaaagaagaactggggttgttagagctgagatgactgtacacatacccctgcccaatttatatagctctttgtggagataattaggggtgggagcagtttgaaggagtaagcctggttttatacttttaaataaagtgtttttatctgtc

SEQ ID NO: 5829 - DNA, 2412 bp, Homo sapiens
gggtcatcggttccctggaaggagaaaaagctgccaattgaacggggcctcccggtcccagggatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaacgtccgtgtgtctgccgtcggtcctgtcaccga

SEQ ID NO: 5830 - DNA, 1804 bp, Homo sapiens
gcgcggcgtgtggcccttgcgggcgagcctggcggggttgcgttcctgtccgctagcaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaa

SEQ ID NO: 5831 - DNA, 1821 bp, Homo sapiens
ggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaa

SEQ ID NO: 5832 - DNA, 1283 bp, Homo sapiens
aagcgcccagaggccaacggtcccccagccatgggcgctgcagctccggccgagtccgcagacctcgggaacttctggaaggcgggagaacccctgctgcaaggccccgacgccctggcggctcccatgagcaggtcacccagcacgccccagaccacgccatctccccagggtcgccagagtccctggcccctgaggtccctgactcagagccatattcagtacttccagtgggggcgcccggtgcccagcacccacctcatcgaggtgcggcccacccaggaccccgccaagccgcagcgggtggtctccgagggctggaggcgccctgcccttcccggggagaccgctctggggcgagacctctcctgtgcctgggagggttgcatgaaaggggggctgtgtcgtgcctggaacccaggacggacctggagcccggtgaccatcgggatcgcgccccctgagcgtcaggagagcccctggagatcccctggacagagagcccgccccgcaggccgccccgccgcccaggagctcctggacccctgcacccgggagactctgctgggggcgctcagccagtgccccaagggaagcgctaggttcgacgggccgttgtggttcgaggtctcagacagcaagggtggcaggcggaacctgcagccccggccctctgccttcaagcccctgagcaaaaatggagcggttgcttccttcgtgcccaggccagggcctctgaagccgagcctcggcccctggagcctcagtttttgtgatgatgcttggccttccgtgctggtccagcccgccccatccgccatctgggacttctgggaggcgacaacgccttcctgcggcagctgcagtagggtctccttcgccctcgaggtcacccagtctgctggcccctttggctcctaagaatctgggctctgctacccacctccggagacacaagcccacgtatctactttcacttgctcatccttgctctacctcaacgtggggccctgacaccacgttatcaaacatgcagcccccacacccctcgtctgcccgcccccagatcttccctctgtgctccctgccaccccagcagctgttgatttcagaacccttgccttcgccctgctggccctctcctccctgcccttcttcctgcccttcctctgaaaagaggcatttcgggaaggcttgctttttctccatgtctcccagtttgtatagttaaattgtccagttgtatagttaaatatttgatcttattaaaaacatttgtctgc

SEQ ID NO: 5833 - DNA, 2916 bp, Homo sapiens
atgggcagtttcctgagcaaactggaactttcgccctcgtccccagcccaggtgcgcaccgacttgcccgagaggcccacgaaacgccggccacctcagccccttcaccaagttcatcgggttcagttcgtccaccgcgcccaccctgccccacggtatagacctgtgaggaggcggccaaacctggatcctgccaatccaaccacgtggctggccaacgaggcctggaggcgctttcccatgaagaagtcccagaattcccccctggggcctctcccttcagactggtgggaaagttacttaaagcggactatttggtctcttcgacatcccaggccaatttggagcccagtgaccatcaggatcactcctcctgaccagagagtgcccccttccacttctcctgaagatgtaattgcccttgcaggactcccgccctctgaggagctcgcagatccatgttcaaaggagacagtgttgagggccctcagagagtgcagaaaagggaaagggaggttggaagaaccactattccctgagagtctggacagtaagagaaggagtccagagaccagaccatcggcatttaagcccctgatgaaaaatggaaccctcacttcttttgtgcccaggcctgggccgctgaagagaagtctccactcctggggctcagatcacagcttgactaagaggcccaattgctcctccatgagctccttggccagcatatacagaggtggcaccctcagctccaaaaggaatgctattggcagctcttacagctcttgcagaaatttctcagacccttggaagagaagtgttcccagtgtatcattcgagacaccagagtggccaataaaaaaggaaaaaagttgtcatcggccttcctctccagtcccactggtatcagattttgagtccctaggaggatctgaaagttctgggcagcaaaaccagaagattccacagctgccgtctagccctgagaacctggtgtcagagatcccacctccccagcttggttatgcagtctctgatgagaacttgactttggggaagaaagctgagctacagtccacgggagaggcaaccagtgtggcccattctcctttgaagacacccagcctaccgaccccacctgggtgctcacagtcagagctccttccaggcacctctccagactcaaagcccacagctactttcatcctgctgacccccacctctcccacattaccagttactgacaccacctggccgccttcaacctctcaggctgacaggtctcccatgcccccagacccacctgcaccacccaccatccaaagtactttgcttggaatggtgagtagcccaacatcccatctttctgcatctgcacctcctgatgcaacttctgctcacctcatgttaaaaccgattttggggcccctgcacaacagcgagattggaagctcctcatattccagaatttcagtcacagctgcagcatcttcaatctcttccctttccacaattcagggtaccttaactcctaccttcaagcctatctttggcagcatagatccacttaaaactacgcccatgatagctcctttctcctccaagcagacccctcctccatttactcatgcttctacccatcatttccatggcctggtcaaggccacctctgtggtcatgtccaccaccctagccagcacatctaaagactctgtttttaagccacctttggattttggtgtagtgaatgtcaccagtgccgtaggcaacacttattctgtcccttccacttgcgacactttcctgcttgggactgctcaggccttcagggccgacttcaccccagccacaggattcattttcccaccacaccaccatcctacaattcctactgtgcatacagtcaccatgtttacccaggtcctttccagtgttgtacagatatcccctagaagcagcactgctaatttcaggggtatgggcagccctctgcctgcctctgccctagtatccacaaactggcttgcatcaacccccagcatctccaacctgactccagcaatcacaagtcccttgggatcaagctcaaggccacctttcccactatcccaaggagctaatccccagcctgcatttggtgccacaaatggacagaaacaagggccttcccagccagcccttatgccaagtgtcagtagttcttttctttttgggagctcagcagtggcattgccaacccccatgccaactccagctcagccagccttcattagtaccacacagtcagccttggggtgtttgacaccctcagcctccacctctcaaacccctgccagcacctggtcaggcattggcggcattccagcaggttttcccattagtcaagctagtacaactgggtttagaattgtaattcagacccaccaaagtggggcttttggctcagtgtttggcagcagagctccacaacctttcacttttgggggattcgtgacccctatggactgtgatgagtctgggatcataatgactggtccagacatgagccccacctctggagctttcagcattggagcattgcctagtgggaccactaacaccatgatcccctttggaaaaggctggagccagaacactgaaggcctgcccagccaccgcacagctttttccttggggagaggcagcatttctgcaagaaagactatggcccccattgctcaaaacaccccagtccctggacaagctaaggcaggcagcagtgttggctttgggatgccttttccacctgcccagggctctgttgggagaggaccttttagatcatcagcctcttcattttccattggcgcaaaatcaaaaaccccaaagaatcgggagaaagggcattcccgaaggcatcatgcctacaagaagtag

SEQ ID NO: 5834 - DNA, 3108 bp, Homo sapiens
atgggcagtttcctgagcaaactggaactttcgccctcgtccccagcccaggtgcgcaccgacttgcccgagaggcccacgaaacgccggccacctcagccccttcaccaagttcatcgggttcagttcgtccaccgcgcccaccctgccccacggtatagacctgtgaggaggcggccaaacctggatcctgccaatccaaccacgtggctggccaacgaggcctggaggcgctttcccatgaagaagtcccagaattcccccctggggcctctcccttcagactggtgggaaagttacttaaagcggactatttggtctcttcgacatcccaggccaatttggagcccagtgaccatcaggatcactcctcctgaccagagagtgcccccttccacttctcctgaagatgtaattgcccttgcaggactcccgccctctgaggagctcgcagatccatgttcaaaggagacagtgttgagggccctcagagagtgcagaaaagggaaagggaggttggaagaaccactattccctgagagtctggacagtaagagaaggagtccagagaccagaccatcggcatttaagcccctgatgaaaaatggaaccctcacttcttttgtgcccaggcctgggccgctgaagagaagtctccactcctggggctcagatcacagcttgactaagaggcccaattgctcctccatgagctccttggccagcatatacagaggtggcaccctcagctccaaaaggaatgctattggcagctcttacagctcttgcagaaatttctcagacccttggaagagaagtgttcccagtgtatcattcgagacaccagagtggccaataaaaaaggaaaaaagttgtcatcggccttcctctccagtcccactggtatcagattttgagtccctaggaggatctgaaagttctgggcagcaaaaccagaagattccacagctgccgtctagccctgagaacctggtgtcagagatcccacctccccagcttggttatgcagtctctgatgagaacttgactttggggaagaaagctgagctacaggtaagcaacaacgcaggagaagatacaactgaggtcaacacagaccctttccctgagacttggcttgctattcagccttccttgtctcttgctctgccttcttcagaaacagatctaacccagggagcaaatcctcagttggaaaacttaagaaaaatgcagaagtctctaggtccactggcctctccacagtccacgggagaggcaaccagtgtggcccattctcctttgaagacacccagcctaccgaccccacctgggtgctcacagtcagagctccttccaggcacctctccagactcaaagcccacagctactttcatcctgctgacccccacctctcccacattaccagttactgacaccacctggccgccttcaacctctcaggctgacaggtctcccatgcccccagacccacctgcaccacccaccatccaaagtactttgcttggaatggtgagtagcccaacatcccatctttctgcatctgcacctcctgatgcaacttctgctcacctcatgttaaaaccgattttggggcccctgcacaacagcgagattggaagctcctcatattccagaatttcagtcacagctgcagcatcttcaatctcttccctttccacaattcagggtaccttaactcctaccttcaagcctatctttggcagcatagatccacttaaaactacgcccatgatagctcctttctcctccaagcagacccctcctccatttactcatgcttctacccatcatttccatggcctggtcaaggccacctctgtggtcatgtccaccaccctagccagcacatctaaagactctgtttttaagccacctttggattttggtgtagtgaatgtcaccagtgccgtaggcaacacttattctgtcccttccacttgcgacactttcctgcttgggactgctcaggccttcagggccgacttcaccccagccacaggattcattttcccaccacaccaccatcctacaattcctactgtgcatacagtcaccatgtttacccaggtcctttccagtgttgtacagatatcccctagaagcagcactgctaatttcaggggtatgggcagccctctgcctgcctctgccctagtatccacaaactggcttgcatcaacccccagcatctccaacctgactccagcaatcacaagtcccttgggatcaagctcaaggccacctttcccactatcccaaggagctaatccccagcctgcatttggtgccacaaatggacagaaacaagggccttcccagccagcccttatgccaagtgtcagtagttcttttctttttgggagctcagcagtggcattgccaacccccatgccaactccagctcagccagccttcattagtaccacacagtcagccttggggtgtttgacaccctcagcctccacctctcaaacccctgccagcacctggtcaggcattggcggcattccagcaggttttcccattagtcaagctagtacaactgggtttagaattgtaattcagacccaccaaagtggggcttttggctcagtgtttggcagcagagctccacaacctttcacttttgggggattcgtgacccctatggactgtgatgagtctgggatcataatgactggtccagacatgagccccacctctggagctttcagcattggagcattgcctagtgggaccactaacaccatgatcccctttggaaaaggctggagccagaacactgaaggcctgcccagccaccgcacagctttttccttggggagaggcagcatttctgcaagaaagactatggcccccattgctcaaaacaccccagtccctggacaagctaaggcaggcagcagtgttggctttgggatgccttttccacctgcccagggctctgttgggagaggaccttttagatcatcagcctcttcattttccattggcgcaaaatcaaaaaccccaaagaatcgggagaaagggcattcccgaaggcatcatgcctacaagaagtag

SEQ ID NO: 5835 - DNA, 1374 bp, Homo sapiens
atggactctctgtggggcccaggagctgggagtcacccctttggggtccacaacagccggctgtccccagacttgtgtccagggaagatagtgttgagggccctcaaggagagcggggcagggatgcctgagcaggacaaggaccctagagtccaagagaatcctggtgatcagagaagggtccccgaggtcaccggggatgcaccgtctgcatttcggcccctgcgggacaatggaggcctctctccctttgtgcccgggcccgggcctctgcagacagacctccatgcccagaggtcagaaatcagatatgaccagtcatcccagacctcctggacgagctcgtgcaccaaccgaaatgccatctccagctcctacagctccacgggaggcttgccggggctaaagcggaggagggggccagcctcatcccactgccagctgaccctcagttcctcaaagacagtgagtgaggacaggcctcaggctgtctcttcgggtcacacccagtgtgaaaaggtggcagagaaagcaccagggcagacactcgccctcaggaatgactcctccagatccgaggcctctaggcccagtacacgcaagtttcccctgctgccacacaggcgaggggagcctttgatgctgccacctcccgtagagctggggtaccgggtcactgctgaagacctggactgggagaaggaggcggcattccagtgcatcaagagtgcactgcaggttgaggacaaggccatctcagactgcagaccctcacggccttcccacactttgtcctcacttgcaacaggggcttctggtctgcctgccgtttctaaagcacccagtatggatgcacagcaggagagacacaagtcccaagactgcctgggcctagtggcccccctagcatctgctacagaggtcccctctacagctcccatgtctggggagaagcacagaccaccaggccccctgttctcctcctcagatccccttcctgccacctcttcccactcccaggactcagcccaggtcacctcgctgattcctgcccccttcccagctgcaagcatggatgcgggcatgagaagaacaaggcctggcacttctgctcctgcagctgccgcagcagcccctcccccctccacattgaaccgcacattggggtcactattggagtggatggaggcccttcacatttctgggcctcagccacagctgcagcaggtgcccagaggtcagaaccagagatcccagacctcccggaccagctcgtgccccaaacgaaatgccatctcgagctcctgcagctctacgggagacctcccgggacgaaagcggaagaggcgccagcctcatcccactgccagctga

SEQ ID NO: 5836 - DNA, 2404 bp, Homo sapiens
ggcggctggacgaggacgctcagagcccagctctcgagagttcaagcaaccgacggttccccactgctcccaggagcggttacctgggcactctgtgcccctccttcctgttcgggcccaggccgaggacctgccagtagggctcagttgcctggagcccgttcagcccatcccccagttcactttgcctgtgggatctccccgttgctcctgcccgtggactgagtggcaggccatcctacaagcacccggacacttgacatcagtggtgtcaagacaactctaagaaggttttccgtgatcctgcaagccctgccttccttcctgggatcctgccttcaatttgattgcacaggtaccacagcaagccagtgctgtgtgctccgagttccagggcgtcctccagctcagccactgcactgagaacatggactctctgtggggcccaggagccgggagtcacccctttggggtccacaacacccggctgtccccagacttgtgtccagggaagatagtgttgagggccctcaaggagagcggggcagggatgcctgagcaggacaaggaccctagagtccaagagaatcctggtgatcagagaagggtccccgaggtcaccggggatgcaccgtctgcatttcggcccctgcgggacaatggaggcctctctccctttgtgcccgggcccgggcctctgcagacagacctccatgcccagaggtcagaaatcagatataaccagacatcccagacctcctggacgagctcctgcaccaaccgaaatgccatctccagctcctacagctccacgggaggcttgccggggctaaagcggaggagggggccagcctcatcccactgccagctgaccctcagttcctcaaagacagtgagtgaggacaggcctcaggctgtctcttcaggtcacacccagtgtgaaaaggcagcagatatagcaccagggcagacactcgccctcaggaatgactcctccacatccgaggcctctaggcccagtacacacaagtttcccctgctgccacgcaggcgaggggagcctttgatgctgccacctcccttagagctggggtaccgggtcactgttgaagaccttgaccgggagaaggaggcggcattccagcgcatcaacagtgcactgcaagttgaggacaaggccatctcggactgcagaccctcacggccttcccacactttgtcctcacttgcaacaggggcttctggtctgcctcccgtttctaaagcacccagtatggatgcacagcaggagacacacaagtcccaagactgcctgggcctactggcccccttagcatctgctgcaggggtcccctctacagctcccatgtctgggaagaagcacagaccaccaggccccctgttctcctcctcagatccccttcctgccacctcttcccattcccaggactcagcccaggtcacctcgctgattcctgcccccttcccagctgcaagcatggatgcgggcatgagaagaacaaggtgtggcacttctgctcctgcagctgccgcagcagcccctcccccctccacattgaaccccacgttggggtcactactggagtggatggaggcccttcacatttctgggcctcagccacagctgcagcaggtgcccagaggtcagaaccagagatcccagacctcccggaccagctcgtgccccaaacgaaatgccatctcgagcccctaccgctctacgggaggcctcccggaacgaaagcggagaagggggccagcctcatcccactgccagctgaccctcagttcctgaaacacagtgagtgaggacggacctcaggctgtctcttcaggtcacacccagtgtgaaaagatggcagatacagcaccagggcagacactcgcccccaggggtggctcccccagatcccaggcctctaggccctgtagatgcaagtttcccctgctgccacgcaggcgaggggagcctttgatgctgccacctcccttagagctggggtaccgggtcactgctgaagacctggaccaggagaaggaggcggctttccagcgcatcaggagtgcactgcaggttgaggacaaggccatttagtactgcagaccctcacggccttcccacactttgtcctcacttgcaacaggggcttctggtctgcctgccatttctaaagcacccagtatggatgcacagcaggagagacacaagtcccaagactgcctgggcctagtggccccccagcatctgctgcacaggcctgtagtcccagctactcaggaggctgaggcaggagaacggcataaacccgggaggcagagcttgcagtgagctgagatcgcgccactgcactccagcctgggtgacagagcgagactccgtctc

SEQ ID NO: 5837 - DNA, 1689 bp, Homo sapiens
caagccctgccttccttcctgggatcctgccttcaatttgattgcacaggtaccacagcaagccagtgctgtgtgctccgagttccagggcgtcctccagctcagccactgcactgagaacatggactctctgtggggcccaggagccgggagtcacccctttggggtccacaacacccggctgtccccagacttgtgtccagggaagatagtgttgagggccctcaaggagagcggggcagggatgcctgagcaggacaaggaccctagagtccaagagaatcctggtgatcagagaagggtccccgaggtcaccggggatgcaccgtctgcatttcggcccctgcgggacaatggaggcctctctccctttgtgcccgggcccgggcctctgcagacagacctccatgcccagaggtcagaaatcagatataaccagacatcccagacctcctggacgagctcctgcaccaaccgaaatgccatctccagctcctacagctccacgggaggcttgccggggctaaagcggaggagggggccagcctcatcccactgccagctgaccctcagttcctcaaagacagtgagtgaggacaggcctcaggctgtctcttcaggtcacacccagtgtgaaaaggcagcagatatagcaccagggcagacactcgccctcaggaatgactcctccacatccgaggcctctaggcccagtacacacaagtttcccctgctgccacgcaggcgaggggagcctttgatgctgccacctcccttagagctggggtaccgggtcactgttgaagaccttgaccgggagaaggaggcggcattccagcgcatcaacagtgcactgcaagttgaggacaaggccatctcggactgcagaccctcacggccttcccacactttgtcctcacttgcaacaggggcttctggtctgcctcccgtttctaaagcacccagtatggatgcacagcaggagacacacaagtcccaagactgcctgggcctactggcccccttagcatctgctgcaggggtcccctctacagctcccatgtctgggaagaagcacagaccaccaggccccctgttctcctcctcagatccccttcctgccacctcttcccattcccaggactcagcccaggtcacctcgctgattcctgcccccttcccagctgcaagcatggatgcgggcatgagaagaacaaggtgtggcacttctgctcctgcagctgccgcagcagcccctcccccctccacattgaaccccacgttggggtcactactggagtggatggaggcccttcacatttctgggcctcagccacagctgcagcaggtgcccagaggtcagaaccagagatcccagacctcccggaccagctcgtgccccaaacgaaatgccatctcgagcccctaccgctctacgggaggcctcccggaacgaaagcggagaagggggccagcctcatcccactgccagctgaccctcagttcctgaaacacataggacccagggtgcatgcccatctccagcccagggcagctcccctgtaagctgggtgagctactgaagccaaggcgggaggcagctgacaacacccacagcccatgcggaggtggtggaaaggctggactcagcagcaacaccaaatcctggaccaggcagaaaccacccaa

SEQ ID NO: 5838 - DNA, 7011 bp, Homo sapiens
cgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccaggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacgggaggggacttcgcgagcagacgcgcgcgccagcgacagcagcccgccccggcctctcgggagccgtggggcagaggctgcagagccccaggagggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagcccttcacatcctcagccgaagatctcacttcctcccagaggcctttgctgactgacccctcagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggcaacacttttgctcaccagcaagaacacagcccgaggaagggacccaataacctttcaaaacgcaaactgctgcctgcggtgagggcccagggtcttccacggagaggacaggcatcttcctttcccaccaggaaggagtgagcccggagcctctgctatgtgcaaggcggtgtgcaagcaccggctgcagctttttgctctcttctttctctttggggctgggctgggtgtgcgttctggtgctgatgctttggcctgtgaggctgagctagagaaatgtagatgttagatgtgccagtaccatcctgcgcctcccaagcatgcccccactcactcacgtcggcatctcgacccgttcaattacagcaacgaagaagccaccgctaagcgtggtcttgggggaagcccggaggcagtgctcggcacccgggaacgtgctcaggcctcggtggggccgggcaggcagggcgggagctagcctgcaagagaaacagccccaatgctgggtaagagagcagttcaccccatccccccctccacgaccctggcgcacgccctgtacctgaaggcgcccgggttctgctgcagcgcatcttgtaccatgtcttcattctcctcctggcagagggagcacatggagtagacgagccgctgcagggaagggaaagtgagcgcgtggcacagggctcgctgctggaaccctgccagggcatgcagacgcaccgggctaggtgtccctgccccgggctcctccagctgtctgctcggcatacctaaggaaaagcgtgtctcggttacacagcttcacaggctgcctcagtcctgaaatcctcgctcctgaaatcctcgcttcacagaggagaacttttgctccagggtcccaagcccattaaagtgtcagaactaagaccaaaacagatgactccaggtctaagctgctgtggacctctgagtccctcagccacgccttctcaccatctcacccgagccactgcaggaaggatccagcaggacatagtggacctcacgatagcgcggatctaagggggagaccgccaggaagtcctcctcagccagctcacagcaggagacgccagcccaggccagcagcgtggccatggatgccagccgcctggcatccaggtcaaaggcaaagatcttcctagggcagagggcagagcaggggtgagctgagcatgcatggagcagctaagggcctgtcacagctgacacagacaaccagaacatgcaggttaagccaggacacacaatattgaaacagcctatatttaaagggcccagggtcagaggtaactggcctggggtctctgccccaagggctaagggatccacatctcacacctgcagtggggaaagcttagcttggggcaaataccgtgaactactttggtgcagcaggaaagagttaagcgaaagtcatcctttcagccttcattacccactgaaaggcacaaaatcaaaccccatgtcctcctcctcctcctgtggcactcacccttggttcttcagaagagcagccaagtgactggtctttattgcctggggtggcacaggcatccatgacatgggagcctggcgggggtccagcagcatggctgggagacagctggcctggcaggcagaacacaggggccgggtaaacagagaccccaggctaggcccttcccgtgcctacacattcttcccttttctattcctcttgcctaccctgtcctgcagaatgaggtgtccggcccggtacagtgggtgttcatgcagatctgtctgggcgggaaacaccagcagctccggcatcaaggggtccaggagaaaatgcttccccttgagggctcgtaagtcatcgaggctgccagggaagaaccattcattcatcatttcctgaatttctccctgccaggccctatttcaacggtccattcatgcaacaaatgttaccacagctatggagaaatcaacagggtgataagggaatccgggatccgcagttgagggaatgggttgtcaagccagacttatgggtcaggagccccctctactgtttaccagcagtgggagcctgggcaagtgattcaatctcaagccccactggcatctctgtaaaatagtaggtgtgaggattcaatgagccaatatatccaagatacttacgtgccacaatttaataaatgttagctattcctgttgaagcataaccttggagaaaggttactttacaggggggtgaggagtggggaagtgagagctgagctcattcttgatggatgaggagttagtcatgtgaggcgcttaggttaaaactacattcactataactcagtaaagcagtcccgcccactctccgacccatgcagaaataggcctagggagtcacatgtctcagttcagaaatctatcgaagtggcagagctggaattcaaacacaagcagccgttctctgctattccaccctggtgtccaagcaacatggtagggcagaaggaagaggatcttacaaagagtaagggaaagggagaggggcagaggctgcttctcagagccaccaaaggacaaaataagacaggtgtgagcccagtggaggaggcacggggcagagaccagccactgttgctggcacgctggtgcacgtagcactgtggcagatggacctggagaggaagcaggagggacagcacaatggagccaagaaaggacttagcatggccgggcgcggtggttcatgcctgtaatcccagcattttgggaggccaaggtgggcagatcacctgaggtcaggagtttgagaccagcctggccaacatggagaaatcccgtctctactaaaaatacaaaattagccaggcatggtgctgcatgcctgcaatcctgtagggaaaagaaagagagatcagactgttactgtgtctgtgtagaaagggaagacataagaaattccattttgacctgtaccttgaacaattggttggctgagatgctgttaatttgtgactttgccccaaatttgagctcacaaaaacatgtgttgtatggaatcaaggtttaaaggatctagggctgtgcaggacatgccttgttaataaaacgtttacaagc

SEQ ID NO: 5839 - DNA, 1755 bp, Homo sapiens
tgacagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaacaagaaacgcaaagccaggggcaccatggtaaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaat

SEQ ID NO: 5840 - DNA, 1743 bp, Homo sapiens
atctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaagggcaccatggtaaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggct

SEQ ID NO: 5841 - DNA, 3533 bp, Homo sapiens
gcggggggtgggccgggggaggggaggagcgggatttgcggagcgccgcgccgctgccgggagccggcaggcccgagagtgaccggagtcacggcgggcgccggcggagctgcggcgtcggacccgcctcctggaggagctcagccccgaccaggcccggccccattcccgccccgcgccgcctccccgccgccgccgccgccgccgccgcgggagcgctcccctgcccaccccgcccccgcggccgagcccgggagtcgagtgggagtcggccggccggcgcgggcagcgccgggaccccgcgggggacactgcagccggagcccgggaggggccgcgccgccaccgtctgaactaggatgtcccgacatgaaggtgtcagctgtgatgcatgtttaaaaggaaattttcgaggtcgcagatataagtgtttaatttgctacgattacgatctttgtgcatcttgttatgaaagtggtgcaacaacaacaaggcatacaactgaccacccaatgcagtgcatattaacaagggtagattttgatttatactatggtggggaagctttctctgtagagcagccacagtcttttacttgtccctattgtggaaaaatgggctatacggagacatctcttcaagaacatgttacttctgaacatgcagaaacatcaacagaagtgatttgtccaatatgtgcagcgttacctggaggcgatcctaatcatgtcacggatgactttgcagctcatcttacacttgaacacagagcccctagagatttagatgaatcgagtggtgttcgacatgtacgtagaatgtttcaccctggccggggattaggaggtcctcgtgctcgtagatcaaacatgcactttactagcagttctactggtggactttcttcttctcagagttcatattctccaagcaatagggaagccatggatcctatagctgagcttttatctcagttatcaggagtgagacgttctgcaggaggacagcttaattcctctggcccttccgcttctcagttacaacaactgcagatgcagctgcagctagaacggcagcatgcccaggcagcacggcaacaactggagaccgcacgcaacgcaacccggcgtactaacacaagcagtgtcaccactacaatcacacaatccacagcaacaaccaacatagctaatacagaaagcagtcagcagactctacagaattcccagtttcttttaacaaggttgaatgatcctaaaatgtctgaaacggagcgccagtccatggaaagcgagcgtgcagaccgcagcctgtttgtccaagagctccttctgtccactttagtgcgtgaagagagctcatcctcagatgaggatgatcggggggagatggcagattttggtgctatgggctgtgtagatattatgcctttagatgttgctttagaaaacctaaatttaaaagagagtaataaaggaaatgagcctccaccacctcctctttgatgacatcccaattcgcagacaatgtcctctgtgctgtatttgccaatgaaagtggacaacaactatcttgggtttgtttggtgattgtaatttcaggtctgtcactcttgttacattgtgtacattcaaaaggaagagagaaaatatatatgataatcatttccacttaactaatttttacttctagcaggtaaatgtaggtagcagtgcaggggtgatctctgcttcctgtaccttgacatgcaaaaggctctcctaatactccacattcaaactgaagaggaaaattgaaatctctaatgaagctgctgtgtgtatttatgaatattaatgaataaaaactgcttggatggtttaccttaactactgcatgaggttttttgcagcgtgcatgagttttagtgaccttgttatttaagaagttaaatacaaggagtaaaacttaaaaaaaaaatacaaagcccaaagctttcccaaacattattcaatggttacacgacgaagtagcttttgaataatgtctgcctgaatcacctttctttgtgtgcctcctacgcacaaagccagctctgcagtggaatctggggattatagccgggtgtggcactccgccctgtgtgactgtcctgtcgccctgttagtcatcttgcctgtgtggagctcagcctgtctctttaactcatctgtagaagacacaccagtaaagctactgttggaatctgctgcaggggcctttgtgtgccctaaaaacaaatcctgttcatgtttgtttaaagtttttactttttgtggttgtttaaaattttttcaattgttaaatatgttttattcaggtgtagatgaatttcatttattgactgttcaacagagttaacctgaattatgttgtctttgtttttaaaaatctcacattctcaatcatattttgcattatttatgtatttgctttgtagtttgctgagacagatcagtatcaggggagctttgaggatttgccttcccagatttgtcagtatattacaaccaaattcttaatgctaattttagcaccttttatttattgggttttttctggcataaaaagtaaagccttttaattgaatcatgccacctatatgcctatattattaatcctatgtgtaaaaaaaatgtacagctttttttgggtttgttttggggtttggaagggccgggttattttttatttcctgtttcagtttttgtgcatagactttcacaatagctccaaggcagggacagcgggtttgggggttgggagggcagtttttggaatgtaaatttaggacttttaaaaaggtgcgcacagcttctgataaatttataactagacttaacctaatcatgtctcgttccagttctcttttctctgagcccttttcaaagtctcctctctttctcctgtcatccttttcctttcctgtccgtgtatctccgtttcttcaacatgacaagcatacagacttgaacacccctccggtgttcttccgagaactgtgaagtccatgttcatccaaatgtaaccaaaaaagaagtcaccctacatgtctgaaaaactgttgcttctcctctgaaacttcaaactccaacgatttccaaatacaatagctttgttttctttagttctgtaatggataatgtttaaaggaaaactttacaccaggcttctggttacactagaagtcaagcccattagggattttcattttttttcatttggttgttgagaagtttcaaaaatcagttttcaagctgtggtctttcaaacacatctgcacataagtcacacatttcaataaagcattttcaagactgttgaccacttgaatttctttggtgttagtggattaacctaaccattactctgagattttatatctctaatccagtattttttttctttttatgctaaacatgggagatcctggttttgtgtgaatgcattattttggatgtgagaaataaatgccaattatatgtactttcccttttctgcacaaattctgggaa

SEQ ID NO: 5842 - DNA, 4934 bp, Homo sapiens
gggggcgagagagaaagtaactccaggacgagaccggagcgacccgcgcagcgagcataggcggcgaagctgcgcccggcgcccgagaccggcagctgcgtggggcgggggctgcgcccgagcccgatctgccggctccgagcagtggtctcggaaagagggtcgtggtcccgcacggatgcgcttgttgggagaaaccttggagattcacggcaaggcgtaaagcctggggcttccaacgatactctgggcagggatggaagcctagatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgtgggcggccacatgtacaccagcagcctggccacgctcaccaagtaccctgactccaggataagccgcctcttcaatggcactgaacccatcgtcctggacagtttgaagcaacattatttcattgaccgggatggggagattttccgctacgtcctgagcttcctgcggacgtccaagctgctgcttccggatgactttaaggacttcagtctgctgtacgaggaggcgcgctactatcagctccagcccatggtgcgcgagctggagcgctggcagcaggagcaggagcagcggcgccgcagccgggcctgtgactgcctggtggtgcgcgtcacgcccgacttgggcgagcggatcgcactcagcggcgagaaggccctcatcgaggaggtcttccccgagaccggagacgtcatgtgcaactccgtcaacgccggctggaaccaggaccccacgcacgtcatccgcttcccgctcaatggctactgccggctcaactcggtacaggatgttctataaaaatggcccagagtattttcaacaaagcgtgcttcatttgacacccagagtctgactttggattcgaactaaacccaggcaacaggcgaggcaggacagaggctgagtggaaaggtggtctggagccccttccctctccctgctgacctgggagtcgcaggcacccaccagctgccaagagaatccctggaccggctcttcctggatgggtccaagaattggacagctcagatggagtgagggcctattttccaacagctcttcgcagacccaagagcttggcacatttccgggttagggtggaatgggctttgcagggaagagggccccctgtgcacgcattccacagcctgtcggtcagaacttgctagttgcaggagacgggtgttacacgcagtcatcagacctcaccctcacagaggcacaaacccacatagttgtggacgcctgcagagactcaaatattgagaggacttctcctttttctctccctccagagctcccacgagctgatgcacccccaggcttcaaaccacctggaatgcacagctcagggaagctggtggatgcctagaggctgaaggacagggaactctccattattggggcaggactcagggaggacacttggggccatgtgtctggagagagggcataggttacaccctacagaataaagaagggacccaaagcctctttttgcctcccggaatcaaggccctgagggcagcaggatggtggcctgggtggggtcgtccaactaggtttgctaacctgaggggtcactgggcctggccacttctgtccctctggtggtggaacccagcacgtggttctgtagggacctttgtcagtgagcaagactgagatcgtcacaggagaaggtgcccttgctggctgccccagcaggcacccacctccctgccaggccaagccaggtgtcctcttgcagcttggccttgatgacctctgtttcttcctgggcaggtcctggagcggctgttccagaggggtttcagcgtggctgcgtcctgtgggggcggtgtggactcctcccagttcagcgagtatgtgctttgccgggaggagcggcggccgcagcccacccccactgctgttcgaatcaagcaggaacccctggactaggccctgcttcagtgcccacctgggcccccccagggacctggaaacagtgctggggagttctgcctgtgtatacttggccgtgggcatgagaccgagggtgaggctggagggtccaaagctggcccagcgagcaccagggtcccaggtgtcatggcaacagaacgtgggatgctggaggcatgcctgcagaaggactgttgatgcgacccaaagatacagcggtgggatctctgctgccagctctcccagcccctcagcttcgcagcctggcgcagcatcctctgaggccccggggcctgttggggcggggttggaagagccgtctgcagctacttcagaggagctgtttatccctctccacgcggggcagactctggcgggtctcctagcgtccgagagatggcttattttctacagtatttaaaatggatgcagccctaactgcaaaagtcagagaggctgacaaggaccaatgcttctttatctggtgctcagttctcagtcagacgtgcagcatggctgcagggtggaccagctgcctggcattcaggcccagatgcctgcagggctggggctctcgggacagatgcagggatgtgtgctgcagggctgctgggaggagagtggtgggggcctgagggctgagtgattctgtaaccacctgagaccttcacgtttgctgccgttgggggctcaggctgcactccccgggtcacctgacctgctgcccaggggcttccagtcctgtctgtgtggactggcacctgggctgctggagaagtctcctcccgttcggaccagcctcagggctgcacgttacctcaggaatgggccccaccatgaaggggcccatctgtcagcagcgtcttctaggtccccagctcagggagccatccccagctccagttttctcatgcgaatatgcacagttttaattcacgttgttacactagcctgccgatgagacccagacacaggcagacctggcgctcttgacccctgattccagtgaggactggccctgaggagtccttgcagacctgctgcctcccccacgacaggcccaaagatggaccccccctggccttgtgacagctccccaagtgttctccggtggagaaactgcagaggactggtgggcggggctccccagccatcaccatcctgtgtacaatggctgtagacttgtatatggctcctttaatattgtaaagatgctgatgtacaattgtcgtgcatttgtgtgaacacattgcgttcccagtccatgccataaatgatgctctcaagcaaaagactggaggctctgtcctgtgcagaagcagcagccagactcccgcattcgatgttgtgcagggaggtttgggggcggaacggattcctcccttggatccttcagttcccatcgaggaataacccgcagcagtggtggaggaaggtcagtggctgggtcctgagcttggtgttatttattgcatttgggtgcctgtcccctcagggcagcacagattctgaattctgattcacagtccctagccagatgggaactgggaaagagacagaaggcgtctgggtgcttttgaaccctgtctcaaatgtttgggattttctctctcactattctttggttggggatgatgtcctctttagacccccacgtaatggtatgagaaggtggcaggcagtggctcagccagccagggggcaccaagtcatgcagccagcgtgagacctgcagttcacctaagcacagaacgagatctcagtatgcctccatgtaaacagattcacataggcctccaatttcaatgagaccttttgcattttttctcaaagcccttatgttctaacccatgagaaccattttacctgccctctaagggccaccagcttcgacctgcctcaggggacagcagcacagaccagtggctccctgtccaaggccgcagagcagacgccatcccactgtacaatcgaatttgctggacaaacttgataggtttctctgcttagcaacgagcctatagttagttggcacatctgcgttttggcatctgaggctcccatctgagtggaggagaaagtgttgtgtttattagcaggaagtcttgtgaaaacagctcgctgctgtgtatgtttatggatttttctgatataacagccagcatggttaccgagtggtagagattctcgaacattctcaaactctctttttgggtaaatgattgtgctaaaaataaaatttattaataaagaaggggaaaaaggagtaactctacctgactaaatgttactctaatttatttatttctttactaattaagtaaaaccaggaagtatgattttacatcaaccagagaatttctgaatttatagggaaacactatgtccccataatgatgctataattctaatatatctagtccccataaacagtaagtacaaattatcattcctttaaagcatttttacacttcctggaatgagtatattatcagcaatcttttgtcaaatgccagccgtataaatgttacttctgctctttgtaaacctcaaaactcattattcttgattataagcaactggacagaaccatgccaaagcttccccgtttcccaccaaacccctgccagtgagtgcagagaactcgcaaagccacagcaggcggtctcagccaccgtcccgctcacaggggcccaatgccaggtcacaacactaagaatatctttcaaaaaatgtgtcttttttttttttttttttaaagctactgcttgactgttccttagaataaataaaggatattttataaattaca

SEQ ID NO: 5843 - DNA, 2338 bp, Homo sapiens
gaaagtaactccaggacgagaccggagcgacccgcgcagcgagcataggcggcgaagctgcgcccggcgcccgagaccggcagctgcgtggggcgggggctgcgcccgagcccgatctgccggctccgagcttaagcagtggtctcggaaagagggtcgtggtcccgcacggatgcgcttgttgggagaaaccttggagattcacggcaaggcgtaaagcctggggcttccaacgatactctgggcagggatggaagcctagatgcctcaccgcaaggagcggccgagcgggtcctcgcttcacacacacggcagcaccggcaccgcggagggaggaaacatgtcccggctgtctctcacccggtcgcctgtgtctcccctggctgcccagggcatccccctgccagcccagctcaccaagtccaatgcacctgtgcacatcgatgtgggcggccacatgtacaccagcagcctggccacgctcaccaagtaccctgactccaggataagccgcctcttcaatggcactgaacccatcgtcctggacagtttgaagcaacattatttcattgaccgggatggggagattttccgctacgtcctgagcttcctgcggacgtccaagctgctgcttccggatgactttaaggacttcagtctgctgtacgaggaggcgcgctactatcagctccagcccatggtgcgcgagctggagcgctggcagcaggagcaggagcagcggcgccgcagccgggcctgtgactgcctggtggtgcgcgtcacgcccgacttgggcgagcggatcgcactcagcggcgagaaggccctcatcgaggaggtcttccccgagaccggagacgtcatgtgcaactccgtcaacgccggctggaaccaggaccccacgcacgtcatccgcttcccgctcaatggctactgccggctcaactcggtacaggtcctggagcggctgttccagaggggtttcagcgtggctgcgtcctgtgggggcggtgtggactcctcccagttcagcgagtatgtgctttgccgggaggagcggcggccgcagcccacccccactgctgttcgaatcaagcaggaacccctggactaggccctgcttcagtgcccacctgggcccccccagggacctggaaacagtgctggggagttctgcctgtgtatacttggccgtgggcatgagaccgagggtgaggctggagggtccaaagctggcccagcgagcaccagggtcccaggtgtcatggcaacagaacgtgggatgctggaggcatgcctgcagaaggactgttgatgcgacccaaagatacagcggtgggatctctgctgccagctctcccagcccctcagcttcgcagcctggcgcagcatcctctgaggccccggggcctgttggggcggggttggaagagccgtctgcagctacttcagaggagctgtttatccctctccacgcggggcagactctggcgggtctcctagcgtccgagagatggcttattttccagtatttaaaatggatgcagccctaactgcaaaagtcagagaggctgacaaggaccaatgcttctttatctggtgctcagttctcagtcagacgtgcagcatggctgcagggtggaccagctgcctggcattcaggcccagatgcctgcagggctggggctctcgggacagatgcagggatgtgtgctgcagggctgctgggaggagagtggtgggggcctgagggctgagtgattctgtaaccacctgagaccttcacgtttgctgccgttgggggctcaggctgcactccccgggtcacctgacctgctgcccaggggcttccagtcctgtctgtgtggactggcacctgggctgctggagaagtctcctcccgttcggaccagcctcagggctgcacgttacctcaggaatgggccccaccatgaaggggcccatctgtcagcagcgtcttctaggtccccagctcagggagccatccccagctccagttttctcatgcgaatatgcacagttttaattcacgttgttacactagcctgccgatgagacccagacacaggcagacctggcgctcttgacccctgattccagtgaggactggccctgaggagtccttgcagacctgctgcctcccccacgacaggcccaaagatggaccccccctggccttgtgacagctccccaagtgttctccggtggagaaactgcagaggactggtgggcggggctccccagccatcaccatcctgtgtacaatggctgtagacttgtatatggctcctttaatattgtaaagatgctgatgtac

SEQ ID NO: 5844 - DNA, 726 bp, Homo sapiens
agagcgagggcaggaggtgggtgcggcacggccggggtcgcggggctcggggactaccggcgaggatgcagaggagaaggaatgaattccagctgagagacctggccgatgcatgggatttgtcttcaaggtccaggcagaggggatggcagatgccaaattgcagaagtcgaagagggcccagtatggttggtctgtaaagactacttccagcaacccagtctcctgccatgtccgaccccatcacgctgaacgtcggggggaagctctatacaacctcactggcgaccctgaccagcttccctgactccatgctaggcgccatgttcagcgggaagatgcccaccaagagggacagccagggcaactgcttcattgaccgtgacggcaaagtgttccgctatatcctcaacttcctgcggacctcccaccttgacctgcctgaggacttccaggagatggggctgctccgcagggaggccgacttctaccaggtgcagcccctgattgaggccctgcaggagaaggaagtggagctctccaaggccgagaagaatgccatgctcaacatcacactgaaccagcgtgtgcagacggtccacttcactgtgcgcgaggcaccccagatctacagcctctcctcttccagcatggaggtcttcaacgccaacatcttcagcacctcctgcctcttcctcaagctccttggctctaagctcttctact

SEQ ID NO: 5845 - DNA, 538 bp, Homo sapiens
aaagctgcgctggccgctcgcggagggagaggctgcagagcgagggcaggagacaaatgaccgggagccatgacgtcatcgggggcgcaggaaagcaggtgctctgctgcttttgcaagcagagaaataagagtttgggcacctacccaggggtcccagggaatgccctgtggctcctgacctcccccgcctgtaatgctctgagcacttcagcagtaatgcatggaagagataagggtctgtgacccatggaactgtccaagtcctctctgacacccgcttcttttcctgccgtgaaggctggagttctgtggcgtaatcacggctcactgcagcctcaacctcccagactcaagcgatcctcccacctcagcctcccaagtagttgggactacaggactacttccagcaacccagtctcctgccatgtccgaccccatcacgctgaacgtcggggggaagctctatacaacctcactggcgaccctgaccagcttccctgactccatgctaggcgccatgttcagcgggaagatgc

SEQ ID NO: 5846 - DNA, 558 bp, Homo sapiens
gcgctggccgctcgcggagggagaggctgcagagcgagggcaggagatgcagaggagaaggaatgaattccagctgagagacctggccgatgcatgggatttgtcttcaaggtccaggcagaggggatggcagatgccaaattgcagaagtcgaagagggcccagtatggttggtctgtaaagactacttccagcaacccagtctcctgccatgtccgaccccatcacgctgaacgtcggggggaagctctatacaacctcactggcgaccctgaccagcttccctgactccatgctaggcgccatgttcagcgggaagatgcccaccaagagggacagccagggcaactgcttcattgaccgtgacggcaaagtgttccgctatatcctcaacttcctgcggacctcccaccttgacctgcctgaggacttccaggagatggggctgctccgcagggaggccgacttctaccaggtgcagcccctgattgaggccctgcaggagaaggaagtggagctctccaaggccgagaagaatgccatgctcaacatcacact

SEQ ID NO: 5847 - DNA, 559 bp, Homo sapiens
aaagctgcgctggccgctcgcggagggagaggctgcagagcgagggcaggagacaaatgaccgggagccatgacgtcatcgggggcgcaggaaagcaggtgctctgctgcttttgcaagcagagaaataagagtttgggcacctacccaggggtcccagggaatgccctgtggctcctgacctcccccgcctgtaatgctctgagcacttcagcagtaatgcatggaagagataagggtctgtgacccatggaactgtccaagtcctctctgacacccgcttcttttcctgccgtgaaggactacttccagcaacccagtctcctgccatgtccgaccccatcacgctgaacgtcggggggaagctctatacaacctcactggcgaccctgaccagcttccctgactccatgctaggcgccatgttcagcgggaagatgcccaccaagagggacagccagggcaactgcttcattgaccgtgacggcaaagtgttccgctatatcctcaacttcctgcggacctcccaccttgacctgcctgaggacttccaggagatg

SEQ ID NO: 5848 - DNA, 3695 bp, Homo sapiens
aaatgacctggcaattccgtctactgatgtctcgaacatgtttcagactaagctacgaaatgaaacttgggaagacttgccaaaaatgtcctgcacaactgagatccaagcagcattcattctctcttcctttgtgaccttcttcagtggactcatcatcctgttgatcttcaggctgatctggagatctgttaaaaaatggcaaatcatcaagggaacaggaattatcttggaactgttcacatcaggtaccatcgctaggagccatgtaagaagcctccacttccagggacaatttcgtgatcatatagaaatgttgctttcagcccagacctttgtggggcaagtgttggtgatccttgtctttgtactaagcattgggtctcttataatctatttcatcaattctgctgaccctgttggaagctgttcatcatatgaagacaaaaccattcctattgatttggttttcaatgctttctttagtttctattttggattgaggtttatggcagctgatgacaagatcaagttctggctggagatgaattcaatcgtagacatctttaccatcccaccaacctttatttcttattatttgaagagcaattggctaggtttaaggttcctaagagccttgcgcctgctagaactccctcaaatcttgcaaattctacgagccatcaagaccagtaactcagtgaagttttccaaactgctgtcaataattctcagtacctggttcacagctgcgggattcattcacctggtggaaaattctggtgatccctggctcaaaggtagaaattcacagaatatatcatattttgagtcaatttacctggtcatggcaacaacgtcaaccgttggatttggagatgtggtagccaagacatccttaggacggaccttcatcatgttcttcacactggggagtttgatattatttgcgaactatatacctgaaatggtggaactgtttgctaacaagaggaaatacaccagttcctatgaagcactcaaaggaaagaagtttattgtggtctgtggaaacatcactgtggacagtgtgaccgctttcctgaggaatttcctccgcgacaagtcaggagagatcaacactgaaattgttttcctgggagaaacccctccttctttggaacttgaaaccatatttaaatgctacttggcctacacaacgttcatttctggatctgcaatgaagtgggaggatctgaggcgagttgcggtggaatctgcagaggcatgcctgattatagccaatcctttgtgcagtgattcccatgctgaagatatttccaacattatgagggtgctctctatcaagaactatgattctaccaccagaatcatcatacagatactgcaatcccataacaaggtttatctgccaaagattcccagctggaactgggacaccggagacaacatcatctgctttgctgaattaaaacttggatttatcgcccaaggctgtttggtgccaggcttgtgtaccttcctaacatctctatttgtggagcaaaacaaaaaggttatgcctaaacagacctggaagaaacacttcttgaatagcatgaaaaacaaaattctgacccaacgtctctctgatgactttgctggaatgagctttcctgaagttgcccggctctgctttctgaagatgcacctcctgttgatagccatcgaatacaagtccctctttacggatggtttctgtggtctgatactaaatccacctccacaagtgaggatacgtaagaacacattagggttctttattgctgaaactccaaaggacgtcagaagagccttgttttactgttcagtctgtcatgatgatgtgttcattcctgagctaattacaaactgtggctgcaaaagcagaagccggcagcacatcacagtgccatcggtaaagagaatgaaaaaatgtctgaagggaatctcctctcgtatatcagggcaggattctccgccaagggtatctgcaagcacttcgagcatatcaaacttcaccaccaggactcttcaacatgatgtagaacaagattctgaccagcttgatagcagtgggatgtttcactggtgcaaaccaacctctttggacaaggtgactctgaaacgaactggcaagtcaaagtataagtttcggaaccatattgtagcatgtgtatttggagatgcccactcagccccgatggggcttcggaactttgtaatgcccttgagagccagcaactataccaggaaggagctgaaggacatagtgttcattgggtctctggactatctacagagagaatggcgatttctctggaattttccccagatatacattctgcctggatgtgcactttattctggagacctccatgcggccaacatagagcaatgctccatgtgtgctgtcttgtcccccccaccccagccatcaagcaaccagactttggtagacacagaagccatcatggcaaccctcaccatcggatccttgcaaattgactcctcctctgacccgtcaccctcagtgtcagaggagactccaggttacacaaatggacataatgagaaatcaaactgccgaaaagtccctatccttactgaactgaaaaatccttccaacattcactttattgaacagcttggtggactggaagggtccctccaagaaacaaatctgcatctcagcactgccttttctacgggcactgttttttccggcagcttcttggattctctgctggccacggccttctacaattatcatgtcctggaattgcttcagatgctggtgacaggaggagtaagttctcagctggaacaacatttagataaggataaagtctatggtgtggcagatagctgcacgtcgctcttgtctggaagaaaccggtgtaagctggggcttctgtccttacacgaaaccattttatcagacgttaatccaagaaacacctttggacaactgttctgtggctcattagatctttttggaatcctgtgtgttggcttataccgaataattgatgaagaggagctcaacccagaaaacaaaaggtttgtgatcacccggccagccaatgagttcaagctgctgccttcagatcttgtgttttgtgccatacccttcagcactgcttgttataaaaggaatgaagagttctcattgcaaaagtcatatgaaattgtaaataaagcatcacagacaacagagacacattcagacacaaattgtcctcccaccattgattcagttactgagacattgtattcaccagtctattcttaccagccgagaactaactccctctcttttcctaagcaaatagcatggaatcagagtagaacaaacagtattatatcatctcagatacctttaggtgacaatgcaaaagaaaatgaaaggaaaacttcagatgaggtttatgatgaggatccctttgcatattcagagccactatagacctgcccatattcttcacgtgctcttaacttgctgcttacaaatcatctcctgagatgctaactttgaacaaagaaaataagaatggaagcatgccatttttctgcccattgcttagtggttcatgaaggccacactgttttgggtgagacaaaagtctaatgccactggatcttgtgtgataaataaagaaatatatgatcaatgc

SEQ ID NO: 5849 - DNA, 2196 bp, Homo sapiens
agcaggccacagggaggcttgggcacagtcagctttccgtcctgttgggaagcctgtttctgctttcagtgcctacgtggtgtcaggaacgccggtcacagtgaacgcctgcaggacccacactgctgcatcgtctctgtgggacagatactgaagccagggcttggcttaccctcgtgacagtctcccgaggatgttctagtgactggatcctttccagctggtgcctgggaaatggcagccactactaattcagccttgaagacagtaccgtgcctactcagcaccattacgtagaagacagaactcaagaggagccgccctgcctggagctagcctgggggtgagccagggtcccccaacccccgggatgaccgcggccagccgggccaacccctacagcatcgtgtcattggaggaggacgggctgcacctggtcaccatgtcgggcgccaacggcttcggcaacggcaaggtgcacacgcggcgcaggtgccgcaaccgcttcgtcaagaagaatggccagtgcaacattgcgttcgccaacatggacgagaagtcacagcgctacctggctgacatgttcaccacctgtgtggacatccgctggcgctacatgctgctcatcttctcgctggccttccttgcctcctggctgctgttcggcgtcatcttctgggtcatcgcggtggcacacggtgacctggagccggctgagggccacggccgcacaccctgtgtgatgcaggtgcacggcttcatggcggccttcctcttctccatcgagacgcagaccaccatcggctacgggctgcgctgtgtgacggaggagtgcctggtggccgtcttcatggtggtggcccagtccatcgtgggctgcatcatcgactccttcatgattggtgccatcatggccaagatggcaaggcccaagaagcgggcacagacgctgctgttcagccacaacgccgtggtggccctgcgtgacggcaagctctgcctcatgtggcgtgtgggcaacctgcgcaagagccacattgtggaggcccatgtgcgcgcgcagctcatcaagccgcgggtcaccgaggagggcgagtacatcccgctggaccagatcgacatcgatgtgggcttcgacaagggcctggaccgcatctttctggtgtcgcccatcaccatcttgcatgaaattgacgaggccagcccgctcttcggcatcagccggcaggacctggagacggacgactttgagatcgtggtcatcctggaaggcatggtggaggccacagccatgaccacccaggcccgcagctcctacctggccaatgagatcctgtggggtcaccgctttgagcccgtgctcttcgaggagaagaaccagtacaagattgactactcgcacttccacaagacctatgaggtgccctctacgccccgctgcagtgcgaaggatctggtagagaacaagttcctgctgcccagtgccaactccttctgctatgagaacgagctggccttcctgagccgtgacgaggaggatgaggcggacggagaccaggacggccgaagccgggatggcctcagcccccaggccaggcatgactttgacagactccaggctggcggcggggtcctggagcagcggccctacagacgggggtcagagatctgagccaaccttggccgacatgcagcatccacccctggccggggagaggccccgcggtcgctcaggggccctgggtttgagcagaacgggcccagtgccctgggttgcagactcagtagcgttttagtcgttttatgtttctttgcaaaggcctcagaaggttggccggagagggggcagccagagcggcagcccccggcctcagaggctatcacaggctcagggcaaagaagtggcctcctggggggccaggccacgggggccagggcttctgcctgaagatggagctgcagcctgcggggaagcagcccagctcgatggtgggcccagcctctgctgtccaaggctggctagctgcggtgctccttgctggtttttaacttggggagaaacaccgggtttcagctttctcgaccttagcttgggtgagactgtttacaaaaaaaaaaaaaaccatgcaattggagaaaaaaattttaattcatagggggcaaaaagaacaattagaattccatgggtctgccagg

SEQ ID NO: 5850 - DNA, 2490 bp, Homo sapiens
tgagcaaatgaaagacaccaacaaaatccaacacataaagattcacacttgaaacagattaatcaggaatcaagtttcttactgggaaatgcccagattgtggattggcctgtagtttatagtaatgacggtttttgtaaactctctggatatcatcgagctgacgtcatgcagaaaagcagcacttgcagttttatgtatggggaattgactgacaagaagaccattgagaaagtcaggcaaacttttgacaactacgaatcaaactgctttgaagttcttctgtacaagaaaaacagaacccctgtttggttttatatgcaaattgcaccaataagaaatgaacatgaaaaggtggtcttgttcctgtgtactttcaaggatattacgttgttcaaacagccaatagaggatgattcaacaaaaggttggacgaaatttgcccgattgacacgggctttgacaaatagccgaagtgttttgcagcagctcacgccaatgaataaaacagaggtggtccataaacattcaagactagctgaagttcttcagctgggatcagatatccttcctcagtataaacaagaagcgccaaagacgccaccacacattattttacattattgtgcttttaaaactacttgggattgggtgattttaattcttaccttctacaccgccattatggttccttataatgtttccttcaaaacaaagcagaacaacatagcctggctggtactggatagtgtggtggacgttatttttctggttgacatcgttttaaattttcacacgactttcgtggggcccggtggagaggtcatttctgaccctaagctcataaggatgaactatctgaaaacttggtttgtgatcgatctgctgtcttgtttaccttatgacatcatcaatgcctttgaaaatgtggatgagggaatcagcagtctcttcagttctttaaaagtggtgcgtctcttacgactgggccgtgtggctaggaaactggaccattacctagaatatggagcagcagtcctcgtgctcctggtgtgtgtgtttggactggtggcccactggctggcctgcatatggtatagcatcggagactacgaggtcattgatgaagtcactaacaccatccaaatagacagttggctctaccagctggctttgagcattgggactccatatcgctacaataccagtgctgggatatgggaaggaggacccagcaaggattcattgtacgtgtcctctctctactttaccatgacaagccttacaaccataggatttggaaacatagctcctaccacagatgtggagaagatgttttcggtggctatgatgatggttggctctcttctttatgcaactatttttggaaatgttacaacaattttccagcaaatgtatgccaacaccaaccgataccatgagatgctgaataatgtacgggacttcctaaaactctatcaggtcccaaaaggccttagtgagcgagtcatggattatattgtctcaacatggtccatgtcaaaaggcattgatacagaaaaggtcctctccatctgtcccaaggacatgagagctgatatctgtgttcatctaaaccggaaggtttttaatgaacatcctgcttttcgattggccagcgatgggtgtctgcgcgccttggcggtagagttccaaaccattcactgtgctcccggggacctcatttaccatgctggagaaagtgtggatgccctctgctttgtggtgtcaggatccttggaagtcatccaggatgatgaggtggtggctattttagggaagggtgatgtatttggagacatcttctggaaggaaaccacccttgcccatgcatgtgcgaacgtccgggcactgacgtactgtgacctacacatcatcaagcgggaagccttgctcaaagtcctggacttttatacagcttttgcaaactccttctcaaggaatctcactcttacttgcaatctgaggaaacggggatggttctccatggcaaacgctctgtgaagggtgacctgctgggtgtgaaactgctgcacgacttcctacttcacccattcatctatccgagttttcacggagtccaggagaaagtataaaagttaccttgaggagcaggagagtggaatggttaagactgtttggaatctgaccccttggatttgcatcctggacacacagttgtgtgacctaagggaaaccacttaaactctttatgcctcaatttgcttctctgtgataaaagaataatatgacctgtgtcctacagtagagaataataggtcctagctcgtaaaatgttctcattccatgacacttaaatgagaaaatacgtgtgtggaagtgaccactttgctatatacagatattttattatcattttacaatgccattattttgttccatagtcaaaagtaaaataaaacaaatgtcaatttgtcttattctaatcct

SEQ ID NO: 5851 - DNA, 2711 bp, Homo sapiens
atgccggggggcaagagagggctggtggcaccgcagaacacatttttggagaacatcgtcaggcgctccagtgaatcaagtttcttactgggaaatgcccagattgtggattggcctgtagtttatagtaatgacggtttttgtaaactctctggatatcatcgagctgacgtcatgcagaaaagcagcacttgcagttttatgtatggggaattgactgacaagaagaccattgagaaagtcaggcaaacttttgacaactacgaatcaaactgctttgaagttcttctgtacaagaaaaacagaacccctgtttggttttatatgcaaattgcaccaataagaaatgaacatgaaaaggtggtcttgttcctgtgtactttcaaggatattacgttgttcaaacagccaatagaggatgattcaacaaaaggttggacgaaatttgcccgattgacacgggctttgacaaatagccgaagtgttttgcagcagctcacgccaatgaataaaacagaggtggtccataaacattcaagactagctgaagttcttcagctgggatcagatatccttcctcagtataaacaagaagcgccaaagacgccaccacacattattttacattattgtgcttttaaaactacttgggattgggtgattttaattcttaccttctacaccgccattatggttccttataatgtttccttcaaaacaaagcagaacaacatagcctggctggtactggatagtgtggtggacgttatttttctggttgacatcgttttaaattttcacacgactttcgtggggcccggtggagaggtcatttctgaccctaagctcataaggatgaactatctgaaaacttggtttgtgatcgatctgctgtcttgtttaccttatgacatcatcaatgcctttgaaaatgtggatgagggaatcagcagtctcttcagttctttaaaagtggtgcgtctcttacgactgggccgtgtggctaggaaactggaccattacctagaatatggagcagcagtcctcgtgctcctggtgtgtgtgtttggactggtggcccactggctggcctgcatatggtatagcatcggagactacgaggtcattgatgaagtcactaacaccatccaaatagacagttggctctaccagctggctttgagcattgggactccatatcgctacaataccagtgctgggatatgggaaggaggacccagcaaggattcattgtacgtgtcctctctctactttaccatgacaagccttacaaccataggatttggaaacatagctcctaccacagatgtggagaagatgttttcggtggctatgatgatggttggctctcttctttatgcaactatttttggaaatgttacaacaattttccagcaaatgtatgccaacaccaaccgataccatgagatgctgaataatgtacgggacttcctaaaactctatcaggtcccaaaaggccttagtgagcgagtcatggattatattgtctcaacatggtccatgtcaaaaggcattgatacagaaaaggtcctctccatctgtcccaaggacatgagagctgatatctgtgttcatctaaaccggaaggtttttaatgaacatcctgcttttcgattggccagcgatgggtgtctgcgcgccttggcggtagagttccaaaccattcactgtgctcccggggacctcatttaccatgctggagaaagtgtggatgccctctgctttgtggtgtcaggatccttggaagtcatccaggatgatgaggtggtggctattttagatcatctttcgtaagatcagtgatgtgaagaaagaggaggaggagcgcctccggcagaagaatgaggtgaccctcagcattcccgtggaccacccagtcagaaagctcttccagaagttcaagcagcagaaggagctgcggaatcagggctcaacacagggtgaccctgagaggaaccaactccaggtagagagccgctccttacagaatggagcctccatcaccggaaccagcgtggtgactgtgtcacagattactcccattcagacgtctctggcctatgtgaaaaccagtgaatcccttaagcagaacaaccgtgatgccatggaactcaagcccaacggcggtgctgaccaaaaatgtctcaaagtcaacagcccaataagaatgaagaatggaaatggaaaagggtggctgcgactcaagaataatatgggagcccatgaggagaaaaaggaagactggaataatgtcactaaagctgagtcaatggggctattgtctgaggaccccaagagcagtgattcagagaacagtgtgaccaaaaacccactaagaaaaacagattcttgtgacagtggaattacaaaaagtgaccttcgtttggataaggctggggaggcccgaagtccgctagagcacagtcccatccaggctgatgccaagcaccccttttatcccatccccgagcaggccttacagaccacactgcaggaagtcaaacacgaactcaaagaggacatccagctgctcagctgcagaatgactgccctagaaaagcaggtggcagaaattttaaaaatactgtcggaaaaaagcgtaccccaggcctcatctcccaaatcccaaatgccactccaagtacccccccagataccatgtcaggata

SEQ ID NO: 5852 - DNA, 1826 bp, Homo sapiens
ggtagacgcgatctgttcgctactaccggcctcccctggctgttaaaagcagatggtggctgaggtttgttcaatgcccactgcctctactgtgaagaagccatttgatctcaggagcaagatgggcaagtggtgccaccaccgcttcccctgctgcagggggagcggcaagagcaacatgggcacttctggagaccacgacgactcctttatgaagatgctcaggagcaagatgggcaagtgttgccgccactgcttcccctgctgcagggggagcggcacgagcaacgtgggcacttctggagaccatgaaaactcctttatgaagatgctcaggagcaagatgggcaagtggtgctgtcactgcttcccctgctgcagggggagcagcaagagcaacgtgggcgcttggggagactacgaccacagcgccttcatggagccgaggtaccacgtccgtcgagaagatctggacaagctccacagagctgcctggtggggtaaagtccccagaaaggatctcatcgtcatgctcagggacactgacatgaacaagagggacaaggaaaagaggactgctctacatttggcctctgccaatggaaattcagaagtagtacaactcctgctggacagacgatgtcaacttaatgtccttgacaacaaaaaaaggacagctctgataaaggccatacaatgccaggaagatgaatgtgtgttaatgttgctggaacatggcgctgatcgaaatattccagatgagtatggaaataccgctctacactatgctatctacaatgaagataaattaatggccaaagcactgctcttatatggtgctgatattgaatcaaaaaacaagtgtggcctcacaccacttttgcttggcgtacatgaacaaaaacagcaagtggtgaaatttttaatcaagaaaaaagctaatttaaatgtacttgatagatatggaagaactgccctcatacttgctgtatgttgtggatcagcaagtatagtcaatcttctacttgagcaaaatgttgatgtatcttctcaagatctatctggacagacggccagagagtatgctgtttctagtcatcatcatgtaatttgtgaattactttctgactataaagaaaaacagatgctaaaaatctcttctgaaaacagcaatccagaacaagacttaaagctgacatcagaggaagagtcacaaaggcttaaagtcagtgaaaatagccagccagagaaaatgtctcaagaaccagaaataaataaggactgtgatagagaggttgaagaagaaataaagaagcatggaagtaatcctgtgggattaccagaaaacctgactaatggtgccagtgctggcaatggtgatgatggattaattccacaaaggaggagcagaaaacctgaaaatcagcaatttcctgacactgagaatgaagagtatcacagtgacgaacaaaatgatacccggaaacaactttctgaagaacagaacactggaatatcacaagatgagattctgactaataaacaaaagcagatagaagtggctgaacagaaaatgaattctgagctttctcttagtcataagaaagaagaagatctcttgcgtgaaaacagcgtgttgcaggaagaaattgccgtgctaagactggaactagatgaaacaaaacatcagaaccagctaagggaaaataaaattttggaggaaattgaaagtgtgaaagaaaagactgataaacttctaagggctatgcaattgaatgaagaagcattaacgaaaaccaatatttaagtacagtggacagcttagg

SEQ ID NO: 5853 - DNA, 4031 bp, Homo sapiens
gattggaaacccggagttacctgctagttggtgaaactggttggtagacgcgatctgttggctactactggcttctcctggctgttaaaagcagatggtggttgaggttgattccatgccggctgcctcttctgtgaagaagccatttggtctcaggagcaagatgggcaagtggtgctgccgttgcttcccctgctacagggagagcggcaagagcaacgtgggcacttctggagaccacgacgactctgctatgaagacactcaggagcaagatgggcaagtggtgccaccactgcttcccctgctgcagggggagtggcaagagcaacgtgggcgcttctggagaccacgacgactctgctatgaagacactcaggaacaagatggggaagtggtgctgccactgcttcccctgctgcagggggagcggcaagagcaaggtgggcgcttggggagactacgatgacagcgccttcatggagcccaggtaccacgtccgtggagaagatctggacaagctccacagagctgcctggtggggtaaagtccccagaaaggatctcatcgtcatgctcagggacactgacgtgaacaagaaggacaagcaaaagaggactgctctacatctggcctctgccaatgggaattcagaagtagtaaaactcctgctggacagacgatgtcaacttaatgtccttgacaacaaaaagaggacagctctgataaaggccgtacaatgccaggaagatgaatgtgcgttaatgttgctggaacatggcactgatccaaatattccagatgagtatggaaataccactctgcactacgctatctataatgaagataaattaatggccaaagcactgctcttatatggtgctgatatcgaatcaaaaaacaagcatggcctcacaccactgttacttggtgtacatgagcaaaaacagcaagtcgtgaaatttttaatcaagaaaaaagcgaatttaaatgcactggatagatatggaaggactgctctcatacttgctgtatgttgtggatcagcaagtatagtcagccttctacttgagcaaaatattgatgtatcttctcaagatctatctggacagacggccagagagtatgctgtttctagtcatcatcatgtaatttgccagttactttctgactacaaagaaaaacagatgctaaaaatctcttctgaaaacagcaatccagaacaagagttaaagctgacatcagaggaagagtcacaaaggttcaaaggcagtgaaaatagccagccagagaaaatgtctcaagaactagaaataaataaggatggtgatagagaggttgaagaagaaatgaagaagcatgaaagtaataatgtgggattactagaaaacctgactaatggtgtcactgctggcaatggtgataatggattaattcctcaaaggaagagcagaacacctgaaaatcagcaatttcctgacaacgaaagtgaagagtatcacagaatttgtgaattactttctgactacaaagaaaagcagatgccaaaatactcttctgaaaacagcaacccagaacaagacttaaagctgacatcagaggaagagtcacaaaggcttaaaggcagtgaaaatggccagccagagaaaagatctcaagaaccagaaataaataaggatggtgatagagagctagaaaattttatggctatcgaagaaatgaagaagcacggaagtactcatgtcggattcccagaaaacctgactaatggtgccactgctggcaatggtgatgatggattaattcctccaaggaagagcagaacacctgaaagccagcaatttcctgacactgagaatgaagagtatcacagtgacgaacaaaatgatactcagaagcaattttgtgaagaacagaacactggaatattacacgatgagattctgattcatgaagaaaagcagatagaagtggttgaaaaaatgaattctgagctttctcttagttgtaagaaagaaaaagacgtcttgcatgaaaatagtacgttgcgggaagaaattgccatgctaagactggagctagacacaatgaaacatcagagccagctaagagaaaagaaatatttggaggatattgaaagtgtgaaaaaaaagaatgataatcttttaaaggctctacaattgaatgagctcaccatggatgatgataccgccgtgctcgtcattgacaacggctctggcatgtgcaaggccggctttgcgggcgacgatgccccccgggctgtcttcccttccatcgtggggcgccccaggcagcagggcatgatggggggcatgcatcagaaagagtcctatgtgggcaaggaggcccagagcaagagaggcatcctgaccctgaagtaccccatggaacacggcatcatcaccaactgggatgacatggagaagatctggcaccacaccttctacaacgagctgcgtgtggctcccgaggagcaccccatcctgctgaccgaggcccccctgaaccccaaggccaaccgcgagaagatgacccagatcatgtttgagaccttcaacaccccagccatgtacgtggccatccaggccgtgccgtccctgtacacctctggccgtactactggcatcgtgatggactctggtgacggggtcacccacactgtgcccatctatgaggggaatgccctcccccatgccaccctgcgcctagacctggctgggcgggaactgcctgactacctcatgaagatcctcaccgagcgtggctataggttcaccaccatggccgagcgggaaatcgtgcgtgacatcaaagagaagctgtgctatgttgccctggacttcgagcaggagatggccacggcggcctccagctcctccctagagaagagctacgagctgcccgatggccaggtcatcaccatcggcaacgagcggttccgctgccccgaggcgctcttccagccttgcttcctgggcatggaatcctgtggcatccatgaaactaccttcaactccatcatgaagtctgatgtggacatccgcaaagacctgtacaccaacacagtgctgtctggcggcaccaccatgtaccctggcatggcccacagaatgcagaaggagatcgctgccctggcgcctagcatgatgaagatcaggatcattgctcctcccaagcgcaagtactccgtgtgggtcggtggctccatcctggcctcgctgtccaccttccagcagatgtggatcagcaagcaggagtatgatgagtcaggcccctccattgtccaccgcaaatgcttctaggtggactctgacttagttgcgttacaccctttcttgacaaaaccaaacttctcagaaaacaacatgagattggcatggctttatttgttttcttgtttcattttttgttttgttttttattggcttgactcaggatttaaaaaccggaatggtgaaggtgacagcagtcggttggaggaagcttcctccaaagttctacaatgttgccaaggactttgattgtacattgttcttcttttcaatagtcattccaaatattgtgagacgcattgtttcaggaagccccttgccctgctaaaagccatcccacttctctctaaggagaatggcccagtcctctccctagttcacacaggggaggtgatagcattgcttttgtgcaaattacataatgcaaaattttttgaatcttcgccttaatactttttaattttgttttattttgaatgatcagccttcgtggcccccctcttttgtaccccaacttggggtgtatgaaggcttttggtctccctgagagtggctggaggcagccagggcttacctgtactctgacttgaggagagttggataaaagtgcacaccttaaaaaaaattgaggaagcacagtatttcagtacagtggacagcttagcatgttgacaactgagaataaaatgctcagttctgaactggacaatgtaagacacaacgaggaaacactggaaat

SEQ ID NO: 5854 - DNA, 3399 bp, Homo sapiens
ggtagacgcgatctgttggctactactggcttctcctggctgttaaaagcagatggtggttgaggttgattccatgccggctgcctcttctgtgaagaagccatttggtctcaggagcaagatgggcaagtggtgctgccgttgcttcccctgctacagggagagcggcaagagcaacgtgggcacttctggagaccacgacgactctgctatgaagacactcaggagcaagatgggcaagtggtgccaccactgcttcccctgctgcagggggagtggcaagagcaacgtgggcgcttctggagaccacgacgactctgctatgaagacactcaggaacaagatggggaagtggtgctgccactgcttcccctgctgcagggggagcggcaagagcaaggtgggcgcttggggagactacgatgacagcgccttcatggagcccaggtaccacgtccgtggagaagatctggacaagctccacagagctgcctggtggggtaaagtccccagaaaggatctcatcgtcatgctcagggacactgacgtgaacaagaaggacaagcaaaagaggactgctctacatctggcctctgccaatgggaattcagaagtagtaaaactcctgctggacagacgatgtcaacttaatgtccttgacaacaaaaagaggacagctctgataaaggtatgcagtagccaactatatcagcatgaggccgtacaatgccaggaagatgaatgtgcgttaatgttgctggaacatggcactgatccaaatattccagatgagtatggaaataccactctgcactacgctatctataatgaagataaattaatggccaaagcactgctcttatatggtgctgatatcgaatcaaaaaacaagcatggcctcacaccactgttacttggtgtacatgagcaaaaacagcaagtcgtgaaatttttaatcaagaaaaaagcgaatttaaatgcactggatagatatggaaggactgctctcatacttgctgtatgttgtggatcagcaagtatagtcagccttctacttgagcaaaatattgatgtatcttctcaagatctatctggacagacggccagagagtatgctgtttctagtcatcatcatgtaatttgccagttactttctgactacaaagaaaaacagatgctaaaaatctcttctgaaaacagcaatccagaaaatgtctcaagaactagaaataaataaggatggtgatagagaggttgaagaagaaatgaagaagcatgaaagtaataatgtgggattactagaaaacctgactaatggtgtcactgctggcaatggtgataatggattaattcctcaaaggaagagcagaacacctgaaaatcagcaatttcctgacaacgaaagtgaagagtatcacagaatttgtgaattactttctgactacaaagaaaagcagatgccaaaatactcttctgaaaacagcaacccagaacaagacttaaagctgacatcagaggaagagtcacaaaggcttaaaggcagtgaaaatggccagccagagaaaagatctcaagaaccagaaataaataaggatggtgatagagagctagaaaattttatggctatcgaagaaatgaagaagcacggaagtactcatgtcggattcccagaaaacctgactaatggtgccactgctggcaatggtgatgatggattaattcctccaaggaagagcagaacacctgaaagccagcaatttcctgacactgagaatgaagagtatcacagtgacgaacaaaatgatactcagaagcaattttgtgaagaacagaacactggaatattacacgatgagattctgattcatgaagaaaagcagatagaagtggttgaaaaaatgaattctgagctttctcttagttgtaagaaagaaaaagacgtcttgcatgaaaatagtacgttgcgggaagaaattgccatgctaagactggagctagacacaatgaaacatcagagccagctaagagaaaagaaatatttggaggatattgaaagtgtgaaaaaaaagaatgataatcttttaaaggctctacaattgaatgagctcaccatggatgatgataccgccgtgctcgtcattgacaacggctctggcatgtgcaaggccggctttgcgggcgacgatgccccccgggctgtcttcccttccatcgtggggcgccccaggcagcagggcatgatggggggcatgcatcagaaagagtcctatgtgggcaaggaggcccagagcaagagaggcatcctgaccctgaagtaccccatggaacacggcatcatcaccaactgggatgacatggagaagatctggcaccacaccttctacaacgagctgcgtgtggctcccgaggagcaccccatcctgctgaccgaggcccccctgaaccccaaggccaaccgcgagaagatgacccagatcatgtttgagaccttcaacaccccagccatgtacgtggccatccaggccgtgccgtccctgtacacctctggccgtactactggcatcgtgatggactctggtgacggggtcacccacactgtgcccatctatgaggggaatgccctcccccatgccaccctgcgcctagacctggctgggcgggaactgcctgactacctcatgaagatcctcaccgagcgtggctataggttcaccaccatggccgagcgggaaatcgtgcgtgacatcaaagagaagctgtgctatgttgccctggacttcgagcaggagatggccacggcggcctccagctcctccctagagaagagctacgagctgcccgatggccaggtcatcaccatcggcaacgagcggttccgctgccccgaggcgctcttccagccttgcttcctgggcatggaatcctgtggcatccatgaaactaccttcaactccatcatgaagtctgatgtggacatccgcaaagacctgtacaccaacacagtgctgtctggcggcaccaccatgtaccctggcatggcccacagaatgcagaaggagatcgctgccctggcgcctagcatgatgaagatcaggatcattgctcctcccaagcgcaagtactccgtgtgggtcggtggctccatcctggcctcgctgtccaccttccagcagatgtggatcagcaagcaggagtatgatgagtcaggcccctccattgtccaccgcaaatgcttctaggtggactctgacttagttgcgttacaccctttcttgacaaaaccaaacttctcagaaaacaacatgagattggcatggctttatttgttttcttgtttcattttttgttttgttttttattggcttgactcaggatttaaaaaccggaatggtgaaggtg

SEQ ID NO: 5855 - DNA, 7061 bp, Homo sapiens
ggtagacgcgatctgctggctactaccggcctcccctggctgttaaaagcagatggtggctgaggctggttcaatgccggctgcctcctctgtgaagaagccatttggtctcagaagcaagatgggcaagtggtgccgccactgcttcccctggtgcagggggagcggcaagagcaacgtgggcacttctggagaccacgatgattctgctatgaagacactcaggagcaagatgggcaagtggtgccgccactgcttcccctggtgcagggggagcggcaagagcaacgtgggcacttctggagaccacgacgactctgctatgaagacactcaggagcaagatgggcaagtggtgctgccactgcttcccctgctgcagggggagcggcaagagcaaagtgggcccctggggagactacgacgacagcgctttcatggagccgaggtaccacgtccgtcgagaagatctggacaagctccacagagctgcctggtggggtaaagtccccagaaaggatctcatcgtcatgctcaaggacactgacatgaacaagaaggacaagcaaaagaggactgctctacatctggcctctgccaatggaaattcagaagtagtaaaactcctgctggacagacgatgtcaacttaatatccttgacaacaaaaagaggacagctctgacaaaggccgtacaatgccaggaagatgaatgtgcgttaatgttgctggaacatggcactgatccgaatattccagatgagtatggaaataccgctctacactatgctatctacaatgaagataaattaatggccaaagcactgctcttatacggtgctgatatcgaatcaaaaaacaagcatggcctcacaccactgttacttggtgtacatgagcaaaaacagcaagtggtgaaattcttaatcaagaaaaaagcaaatttaaatgcactggatagatatggaagaactgttctcatacttgctgtatgttgtggatcggcaagtatagtcagccttctacttgagcaaaacattgatgtatcttctcaagatctatctggacagacggccagagagtatgctgtttctagtcgtcataatgtaatttgccagttactttctgactacaaagaaaaacagatactaaaagtctcttctgaaaacagcaatccagaacaagacttaaagctgacatcagaggaagagtcacaaaggcttaaaggaagtgaaaatagccagccagaggaaatgtctcaagaaccagaaataaataagggtggtgatagaaaggttgaagaagaaatgaagaagcacggaagtactcatatgggattcccagaaaacctgcctaacggtgccactgctgacaatggtgatgatggattaattccaccaaggaaaagcagaacacctgaaagccagcaatttcctgacactgagaatgaacagtatcacagtgatgaacaaaatgatactcagaagcaactttctgaagaacagaacactggaatattacaagatgagattctgattcatgaagaaaagcagatagaagtggctgaaaatgaattctgagctttctcttagttataagaaagaaaaagacctcttgcatgaaaatagtacgttgcaggaagaaattgtcatgctaagactggaactagacgtaatgaaacatcagagccagctaagagaaaagaaatatttggaggaaattgaaagtgtggaaaaaaagaatgataatcttttaaagggtctacaactgaatgagctcaccatggatgatgatactgccgtgctcgtcattgacaacggctctggcatgtgcaaggccggctttgcaggtgacgatgccccccgggctgtcttcccttccatcgtggggtgccccaggcaccagaacatgatggggggcatgcgtcagatggagtcctatgtgggcaatgaggcccagagcaagagaggcatcctgaccctgaagtaccccatggagcacggcatcatcaccaactgggacgacatggagaagatctggcaccacaccttctacaatgagctgcgtgtggctcccgaggagcaccccatcctgctgaccgaggcacccctgaaccccaaggccaaccgtgagaagatgacccagatcatgtttgagaccttcaacaccccagccatgtacgtggccatccaagccgtgctgtccttgtacacctctggccgtactactggcattgtgatggactctggtgacggggtcacccacactgtgcccatctatgaggggaatgccctcccccatgccaccctgcgcctagacctggctggccgggaactgactgactacctcatgaagatcctcaccgagcgtggctatagtttcaccaccatggccgagcaggaaatcgtgcgtgacatcacagagaagctgtgctatgttgccctggacttcgagcaggagatggccacagcggcctccagctcctccctagagaacagctatgagctgcccaacggccaggtcatcaccattagcaacgagcggttccgctgccccgaggtgctcttccagccttgcttcctgggcatggaatcctgtggcatccacgaaactaccttcaactctatcatgaagtctgatgtggacatccacaaagacctgtacaccaacacagtgctatctggtggcaccaccatgtaccctggcattgcccacaggatgcagaaggagatcgctgccctggcgcctagcacgatgaagatcaagattgttgctcctcccaagcgcaagtactccgtgtgggtcggtggctccatcctggcctcgctgtccaccttccagcagatgtggatcagcaagcaggagtatgatgagtcaggcccctccattgtccaccgcaaatgcttctaggtggacgctgacttagttgcattacaccctttcttgacaaaaccaaacttcgcagaaagccacatgagattggtatggctttaattgttttcttatttcattttttgttttgttttttattggcttgactcaggatttaaaaactggaatggtgaaggcgagagcagttggttggagtgagcttcccccaaagttctacaatgtggctgaggactttgatcgtacattgtttttcttttcaatagtcattccaaatattgtgagatgcattgtttcaggaagccccttgcccttctaaaagccaccccacttctctctaaggagaatggcccagtcctctccctaattcacacaggggaggtgatggcattgctttcatgcaaattacgtaatgcagaattttttgaatctttgcctaaatactttttaattttgttttatttagaatgatcagccttcgcggccccccttttttgtaccccaacttggggtgtatgaaggcttttggtctccctgagagtggctggaggcagccagggcttacctgtactctgacttaaggagagttggaaaaaagtgcacaccttaaaaaaaattcaatgaggaagcattaacaaaaacagtatttctgtacagtggacagcttagcatgttgacaactgagaataaaatgctcagttctgaactggacaatgtaagacacaacgacgaaacactggaaatggaaattcaattacatcattgtagactggctactgctctacatgattgtgaccaaagtcagagagctgaaagagacttctttccagagaacaagacatgaacaggtttatttacagaagacaatgaattctcatttgtctaacctaaaagattacagaatctttctcaacaagtctaatgtagacagtaaaatcaacaggctaaaaattaagttccatgaaacaagataaaactctgagagaaaagatggggcaggccgccatctttcccgttcgggcaacttagtcattccagcctgagggctttggagagtacaaactgaccagggaaagaagagatcccagagcacagcatagctgctttaccaaatcatggccagactgcttctgtaagcaggcccctgatcctgttccacctcactggacaggacctcccaactggggcctccagctacccccaccagcatcccttggccaatggaaatttgaaatgttcctgggacagagctcctggagagaggggcaggccaccacctttgctgtttgggtgactagccgttctggcctgcaggctttggagagcccaagctgacaaggggtagaagaggtgcctcagcacagcacagccacgctacgaaaacatggccagactcttgtttaagtcagtccccgaacacatttctagtcagtgggtgaagtctttcaaccagggtctctggctaccttgactgctgttctctggccgacagaggtctcaggcctccctgagtcagagctcccggggggaggaccagattgtcatctttgctgtttgggtgacccagccatttcagccttagggcttcagagtgtctgaggtagccaggggctgaagtgaacccccagcacagcacagctgctctataaaaacgtggccagactttttctttaagcaagtccctgttcttattcctcctgactaggtaagacttctcaacttgcctccagccacatcttattggtgtgttcagattggcaacaggttcgtacctcagtggtacagagctcccagaggaaggggtaggctatcatcttccctggaaaatacgagtcaattagggacttgaggggacccccagcattccacagcagcccttcagaaaagtggccagactctgtacttgatgggcagatcctcctggcctgtgtctctagccagcccaccactggagctatcaagccagtagcaactcagcagttccttggacagagcttccaggagcaaatgaaatcctttctgccactgcctttgcagtgaactgcccttgctatcctcagaagatatatcacgggagcaaagaccctaagtgccatatcaacacctccaataagctgcagttgacccaaagaacaagccaatccatctcccataggtaccacacacactccactactcatcaccagacagggaaccctggcttgggcccacagcacagaccctccatcctgggccgattacactgagtgattgctaactcacatgtctctgggatggagcacccaggagacaagcaaagtggtggagcagcaagtcaggtgatgtggagcccagagggcagggacagctatctctctaggctccacttgcccttgtgagacactttgtcccagcactttaggaatgctgaggtcagaccagccacatctcatgtgcaagattgcccagcagacatcaggtctgagagttccccttttaaaaaaggggacttgcttaaaaaagaagtctagccacgattgtgtagagcagctgtgctgtgctggagattcacttttgagagagttctcctctgagacctgatctttagaggctgggcagtcttgcacatgagatggggctggtctgatctcagcactccttagtctgcttgcctctcccagggccccagcctggccacacctgcttacagggcactctcagatgcccataccatagtttctgtgctagtggaccgtaccatatcagtggagagctgcagcaaggtggcccctacggccacgcaccagcctgcacattacctctccatactgcagccctttatatggaaacttcctacatcactttgctgtgtgtgtttacacaggtggattttgctttacttgcactgacagcacacaggagggcagcacacaccccaacccacatcaactgccattaaagaaaagaaatttcagcccataatttcatgtccagcaaaattaggcatcataagtgaaggagaaataagatccttttcagacaagcaaatgctgagggaattcaatatcaccagatctaccttacaagagctcctgaaggaagcactaaatatggaaagaaaaaaccatcaccagccactacaaaaatgcagtgaagaacgcagtgaattacgcagtccagtgatgctaaaaaccaaccacatacgttaagtctgcaaaataaccagctgacagcatgacgacaggataaaatccacacataccattactaaccttaaatgaaaatgggctaaatgctcccattgaaagacacggggcaagctggataaagaaccaagacccactggagtatgctgtcttcaagaaacccatctcacatgcggtggcatacataggctcaaaataaaggaatggagaaaaatatttcaagcaaatggaaaacagaaaaaagcaggtgttgcactcctactttctgacaaaacagactatgcgaataaagataaaaaagagaaggacattacaaaggtggtcctgacctttgataaatctcattgcttgataccaacctgggctgttttaattgcccaaaccaataggataatttgctgaggttgtggagcttctcccctgcagagagtccctgatctcccaaaatttggttgagatgtaaggttgattttgctgtacaactccttttctgaagttttactcatttccaaaaaggaaggcaagttttcctgcttccatgacgatggagagcaggcatctcctttcctgagtttcagcttgcttctgacagggaaggtgagtgtaagttttttccagcttctaagatggcagagaacgatcaccagcctgagccttatttccaggtaagtagctgaattagagttttgtcttaaaatttttccttaatgaataaaatgtaagattacccaccagctgcttttaatttctccttagcattagaacactcagtaatcatatgaattgtgcatttgtttgttttgcttaactctttctgtttgtttatgtttggggttttattgttgttgtttcacttttctcccatctcttcctgacttggtcaaatccaaaggaatcttccaaattgtggggagcaaggcatctgaaatggctaaaactcctgtggctgcaaaaaataaaaataaaaaaaaatatataaaaaaataaa

SEQ ID NO: 5856 - DNA, 1629 bp, Homo sapiens
atggtgactgaggtttgttcaatgcccgctgcctctgctgtgaagaagccattcgatctcaggagcaagatgggcaagtggtttcaccaccgcttcccctgctgcaaggggagcggcaagagcaacatgggcacttctggagaccacgacgactcctttatgaagatgctcaggagcaagatgggcaagtgttgccaccactgcttcccctgctgcagggggagcggcacgagcaacgtgggcacttctggagaccatgacaactcctttatgaagacgctcaggagcaagatgggcaagtggtgctgtcactgcttcccctgctgcagggggagcggcaagagcaacgtgggcgcttggggagactacgacgacagcgccttcatggagccgaggtaccacgtccgtcgagaagatctggacaagctccacagagctgcctggtggggtaaggtccccagaaaggatctcatcgtcatgctcagggacacggacatgaacaagagggacaagcaaaagaggactgctctacatttggcctctgccaatggaaattcagaagtagtacaactcctgctggacagacgatgtcaacttaatgtccttgacaacaaaaaaaggacagctctgataaaggccgtacaatgccaggaagatgaatgtgtgttaatgttgctggaacatggcgctgatcaaaatattccagatgagtatggaaataccactctacactatgctgtccacaatgaagataaattaatggccaaagcactgctcttatatggtgctgatattgaatcaaaaaacaagtgtggcctcacaccacttttgcttggcgtacatgaacaaaaacagcaagtggtgaaatttttaatcaagaaaaaagctaatttaaatgcacttgatagatatggaagaactgccctcatacttgctgtatgttgtggatcagcaagtatagtcaatcttctccttgagcaaaatgttgatgtatcttctcaagatctatctggacagacggccagagagtatgctgtttctagtcatcatcatgtaatttgtgaattactttctgactataaagaaaaacagatgctaaaaatctcttctgaaaacagcaatccagaacaagacttaaagctaacatcagaggaagagtcacaaaggcttaaagtcagtgaaaatagccagccagagaaaatgtctcaagaaccagaaataaataaggactgtgatagagaggttgaagaagaaataaagaagcatggaagtaatcctgtgggattaccagaaaacctgactaatggtgccagtgctggcaatggtgatgatggattaattccacaaaggaggagcagaaaacctgaaaatcagcaatttcctgacactgagaatgaagagtatcacagtgacgaacaaaatgatacccggaaacaactttctgaagaacagaacactggaatatcacaagatgagattctgactaataaacaaaagcagatagaagtggctgaaaagaaaatgaattctgagctttctcttagtcataagaaagaagaagatctcttgcgtgaaaacagcatgttgcaggaagaaattgccatgctaatttctggagactggaactag

SEQ ID NO: 5857 - DNA, 1600 bp, Homo sapiens
ataacggcttggcttacctgtaacgggtacgcttcgctttgcgttcctcgcttggccttgcgttcctagcttggcttggcgttagtcgctttgcctggtgtttcttgcttggattggcgtttcctccctcgcattcctttgctgggcttgactttttctctgctgggtttggcattcccttgactgggctgggtgtttccttgggagggggggcttggcctttcctggggtgggcgttgggtccccctggtgggcgtgggctttccccgggtgggtgtgggttttccctgggtggggtggactgggctcccttgctggggttggcaagttttggctgggattgacctttctcttcaaacagattggaaacccagggtttcctgctagttggtgaaactggttggtagacgcgatctgttcgctactaccggcctccccgggctgttaaaagcagatggtgactgaggtttgttcaatgcccgctgcctctgctgtgaagaagccattcgatctcaggagcaagatgggcaagtggtttcaccaccgcttcccctgctgcaaggggagcggcaagagcaacatgggcacttctggagaccacgacgactcctttatgaagatgctcaggagcaagatgggcaagtgttgccaccactgcttcccctgctgcagggggagcggcacgagcaacgtgggcacttctggagaccatgacaactcctttatgaagacgctcaggagcaagatgggcaagtggtgctgtcactgcttcccctgctgcagggggagcggcaagagcaacgtgggcgcttggggagactacgacgacagcgccttcatggagccgaggtaccacgtccgtcgagaagatctggacaagctccacagagctgcctggtggggtaaggtccccagaaaggatctcatcgtcatgctcagggacacggacatgaacaagagggacaagcaaaagaggactgctctacatttggcctctgccaatggaaattcagaagtagtacaactcctgctggacagacgatgtcaacttaatgtccttgacaacaaaaaaaggacagctctgataaaggccgtacaatgccaggaagatgaatgtgtgttaatgttgctggaacatggcgctgatcaaaatattccagatgagtatggaaataccactctacactatgctgtccacaatgaagataaattaatggccaaagcactgctcttatatggtgctgatattgaatcaaaaaacaagtgtggcctcacaccacttttgcttggcgtacatgaacaaaaacagcaagtggtgaaatttttaatcaagaaaaaagctaatttaaatgcacttgatagatatggaagaactgccctcatacttgctgtatgttgtggatcagcaagtatagtcaatcttctccttgagcaaaatgttgatgtatcttctcaagatctatctggacagacggccagagagtatgctgtttctagtcatcatcatgtaatttgtgaattactttctgactataaagaaaaacagatgctaaaaatctcttctgaaaacagcaatccaggtaaagaagcagaagaataa

SEQ ID NO: 5858 - DNA, 7062 bp, Homo sapiens
ggtagacgcgatctgctggctactaccggcctcccctggctgttaaaagcagatggtggctgaggctggttcaatgccggctgcctcctctgtgaagaagccatttggtctcagaagcaagatgggcaagtggtgccgccactgcttcccctggtgcagggggagcggcaagagcaacgtgggcacttctggagaccacgacgattctgctatgaagacactcaggagcaagatgggcaagtggtgccgccactgcttcccctggtgcagggggagcagcaagagcaacgtgggcacttctggagaccacgacgactctgctatgaagacactcaggagcaagatgggcaagtggtgctgccactgcttcccctgctgcagggggagcggcaagagcaaagtgggcccttggggagactacgacgacagcgctttcatggagccgaggtaccacgtccgtcgagaagatctggacaagctccacagagctgcctggtggggtaaagtccccagaaaggatctcatcgtcatgctcaaggacactgacatgaacaagaaggacaagcaaaagaggactgctctacatctggcctctgccaatggaaattcagaagtagtaaaactcctgctggacagacgatgtcaacttaatatccttgacaacaaaaagaggacagctctgacaaaggccgtacaatgccgggaagatgaatgtgcgttaatgttgctggaacatggcactgatccgaatattccagatgagtatggaaataccgctctacactatgctatctacaatgaagataaattaatggccaaagcactgctcttatacggtgctgatatcgaatcaaaaaacaagcatggcctcacaccactgttacttggtgtacatgagcaaaaacagcaagtggtgaaattcttaatcaagaaaaaagcaaatttaaatgcactggatagatatggaagaactgctctcatacttgctgtatgttgtggatcggcaagtatagtcagccttctacttgagcaaaacattgatgtatcttctcaagatctatctggacagacggccagagagtatgctgtttctagtcatcataatgtaatttgccagttactttctgactacaaagaaaaacagatgctaaaagtctcttctgaaaacagcaatccagaacaagacttaaagctgacatcagaggaagagtcacaaaggcttaaaggaagtgaaaatagccagccagaggaaatgtctcaagaaccagaaataaataagggtggtgatagaaaggttgaagaagaaatgaagaagcacggaagtactcatatgggattcccagaaaacctgcctaacggtgccactgctgacaatggtgatgatggattaattccaccaaggaaaagcagaacacctgaaagccagcaatttcctgacactgagaatgaacagtatcacagtgatgaacaaaatgatactcagaagcaactttctgaagaacagaacactggaatattacaagatgagattctgattcatgaagaaaagcagatagaagtggctgaaaatgaattctgagctttctcttagttataagaaagaaaaagacctcttgcatgaaaatagtacgttgcaggaagaaattgtcatgctaagactggaactagacgtaatgaaacatcagagccagctaagagaaaagaaatatttggaggaaattgaaagtgtggaaaaaaagaatgataatcttttaaagggtctacaactgaatgagctcaccatggatgatgatactgccgtgctcgtcattgacaacggctctggcatgtgcaaggccggctttgcaggtgacgatgccccccgggctgtcttcccttccatcgtggggtgccccaggcaccagaacatgatggggggcatgcgtcagatggagtcctatgtgggcaatgaggcccagagcaagagaggcatcctgaccctgaagtaccccatggagcacggcatcatcaccaactgggacgacatggagaagatctggcaccacaccttctacaatgagctgcgtgtggctcccgaggagcaccccatcctgctgaccgaggcacccctgaaccccaaggccaaccgtgagaagatgacccggatcatgtttgagaccttcaacaccccagccatgtacgtggccatccaagccgtgctgtccttgtacacctctggccgtactactggcattgtgatggactctggtgacggggtcacccacactgtgcccatctatgaggggaatgccctcccccatgccaccctgcgcctagacctggctggccgggaactgactgactacctcatgaagatcctcaccgagcgtggctataggttcaccaccatggccgagcgggaaatcgtgcgtgacatcacagagaagctgtgctatgttgccctggacttcgagcaggagatggccacagcggcctccagctcctccctagagaacagctatgagctgcccaacggccaggtcatcaccattagcaacgagcggttccgctgccccgaggtgctcttccagccttgcttcctgggcatggaatcctgtggcatccacgaaactaccttcaactctatcatgaagtctgatgtggacatccacaaagacctgtacaccaacacagtgctatctggtggcaccaccatgtaccctggcattgcccacaggatgcagaaggagatcgctgccctggcgcctagcacgatgaagatcaagattgttgctcctcccaagcgcaagtactccgtgtgggtcggtggctccatcctggcctcgctgtccaccttccagcagatgtggatcagcaagcaggagtatgatgagtcaggcccctccattgtccaccgcaaatgcttctaggtggacgctgacttagttgcattacaccctttcttgacaaaaccaaacttcgcagaaagccacatgagattggtatggctttaattgttttcttatttcattttttgttttgttttttattggcttgactcaggatttaaaaactggaatggtgaaggcgagagcagttggttggagtgagcttcccccaaagttctacaatgtggctgaggactttgatcgtacattgtttttcttttcaatagtcattccaaatattgtgagatgcattgtttcaggaagccccttgcccttctaaaagccaccccacttctctctaaggagaatggcccagtcctctccctaattcacacaggggaggtgatggcattgctttcatgcaaattacgtaatgcaaaattttttgaatctttgcctaaatactttttaattttgttttatttagaatgatcagccttcgcggccccccttttttgtaccccaacttggggtgtatgaaggcttttggtctccctgagagtggctggaggcagccagggcttacctgtactctgacttaaggagagttggaaaaaagtgcacaccttaaaaaaaattcaatgaggaagcattaacaaaaacagtatttctgtacagtggacagcttagcatgttgacaactgagaataaaatgctcagttctgaactggacaatgtaagacacaacgacgaaacactggaaatggaaattcaattacatcattgtagactggctactgctctacatgattgtgaccaaagtcagagagctgaaagagacttctttccagagaacaagacatgaacaggtttatttacagaagacaatgaattctcatttgtctaacctaaaagattacagaatctttctcaacaagtctaatgtagacagtaaaatcaacaggctaaaaattaagttccatgaaacaagataaaactctgagagaaaagatggggcaggccgccatctttcccgttcgggcaacttagtcattccagcctgagggctttggagagtacaaactgaccagggaaagaagagatcccagagcacagcatagctgctttaccaaatcatggccagactgcttctgtaagcaggcccctgatcctgttccacctcactggacaggacctcccaactggggcctccagctacccccaccagcatcccttggccaatggaaatttgaaatgttcctgggacagagctcctggagagaggggcaggccaccacctttgctgtttgggtgactagccgttctggcctgcaggctttggagagcccaagctgacaaggggtagaagaggtgcctcagcacagcacagccacgctacgaaaacatggccagactcttgtttaagtcagtccccgaacacatttctagtcagtgggtgaagtctttcaaccagggtctctggctaccttgactgctgttctctggccgacagaggtctcaggcctccctgagtcagagctcccggggggaggaccagattgtcatctttgctgtttgggtgacccagccatttcagccttagggcttcagagtgtctgaggtagccaggggctgaagtgaacccccagcacagcacagctgctctataaaaacgtggccagactttttctttaagcaagtccctgttcttattcctcctgactaggtaagacttcttaacttgcctccagccacatcttattggtgtgttcagattggcaacgggttcgtacctcagtggtacagagctcccagaggaaggggtaggctatcatcttccctggaaaatacgagtcaattagggacttgaggggacccccagcattccacagcagcccttcagaaaagtggccagactctgtacttgatgggcagatcctcctggcctgtgtctctagccagcccaccactggagctatcaagccagtagcaactcagcagttccttggacagagcttccaggagcaaatgaaatcctttctgccactgcctttgcagtgaactgcccttgctatcctcagaagatatatcacgggagcaaagaccctaagtgccatatcaacacctccaataagctgcagttgacccgaagaacaaggcaatccatctcccacaggtaccacacacactccactactcatcaccagacagggaaccctggcttgggcccacagcacagaccctccatcctgggccgattacactgagtgattgctaactcacatgtctctgggatggagcacccaggagacaagcaaagtggtggagcagcaagtcaggtgatgtggagcccagagggcagggacagctatctctctaggctccacttgcccttgtgagacactttgtcccagcactttaggaatgctgaggtcagaccagccacatctcatgtgcaagattgcccagcagacatcaggtctgagagttccccttttaaaaaaggggacttgcttaaaaaagaagtctagccacgattgtgtagagcagctgtgctgtgctggagattcacttttgagagagttctcctctgagacctgatctttagaggctgggcagtcttgcacatgagatggggctggtctgatctcagcactccttagtctgcttgcctctcccagggccccagcctggccacacctgcttacagggcactctcaggtgcccataccatagtttctgtgctagtggaccgtaccatatcagtggagagctgcagcaaggtggcccctacggccacgcaccagcctgcacattacttctccatactgcagccctttatatggaaacttcctacatcactttgctgtgtgtgtttacacaggtggattttgctttacttgcactgacagcacacaggagtgcagcacacaccccaacccacatcaactgccattaaagaaaagaaatttcagcccataatttcatgtccagcaaaattaggcatcataagtgaaggagaaataagatccttttcagacaagcaaatgctgagggaattcaatatcaccagatctaccttacaagagctcctgaaggaagcactaaatatggaaagaaaaaaccatcaccagccactacaaaaatgcagtgaagaacgcagtgaattacgcagtccagtgatgctaaaaaccaaccacatacgttaagtctgcaaaataaccagctgacagcatgacgacaggataaaatccacacataccattactaaccttaaatgaaaatgggctaaatgctcccattgaaagacacggggcaagctggataaagaaccaagacccactggagtatgctgtcttcaagaaacccatctcacatgcggtggcatacataggctcaaaataaaggaatggagaaaaatatttcaagcaaatggaaaacagaaaaaagcaggtgttgcactcctactttctgacaaaacagactatgcgaataaagataaaaaagagaaggacattacaaaggtggtcctgacctttgataaatctcattgcttgataccaacctgggctgttttaattgcccaaaccaaaaggataatttgctgaggttgtggagcttctcccctgcagagagtccctgatctcccaaaatttggttgagatgtaaggttgattttgctgtacaactccttttctgaagttttactcatttccaaaaaggaaggcaagttttcctgcttccatgacgatggagagcaggcatctcctttcctgagtttcagcttgcttctgacagggaaggtgagtgtaagttttttccagcttctaagatggcagagaacgatcaccagcctgagccttatttccaggtaagtagctgaattagagttttgtcttaaaatttttccttaatgattaaaatgtaagattacccaccagctgcttttaatttctccttagcattagaacactcagtaatcatatgaattgtgcatttgtttgttttgcttaactctttctgtttgtttatgtttggggttttattgttgttgtttcacttttctcccatctcttcctgacttggtcaaatccaaaggaatgttccaaattgtggggagcaaggcatctgaaatggctaaaactcctgtggctgcaaaaaataaaaataaaaaaaaaatataaaaaaataaaca

SEQ ID NO: 5859 - DNA, 1510 bp, Homo sapiens
ggtagacgcgatctgctggctactaccggcctcccctggctgttaaaagcagatggtggctgaggctggttcaatgccggctgcctcctctgtgaagaagccatttggtctcagaagcaagatgggcaagtggtgccgccactgcttcccctggtgcagggggagcggcaagagcaacgtgggcacttctggagaccacgatgattctgctatgaagacactcaggagcaagatgggcaagtggtgccgccactgcttcccctggtgcagggggagcggcaagagcaacgtgggcacttctggagaccacgacgactctgctatgaagacactcaggagcaagatgggcaagtggtgctgccactgcttcccctgctgcagggggagcggcaagagcaaagtgggcccctggggagactacgacgacagcgctttcatggagccgaggtaccacgtccgtcgagaagatctggacaagctccacagagctgcctggtggggtaaagtccccagaaaggatctcatcgtcatgctcaaggacactgacatgaacaagaaggacaagcaaaagaggactgctctacatctggcctctgccaatggaaattcagaagtagtaaaactcctgctggacagacgatgtcaacttaatatccttgacaacaaaaagaggacagctctgacaaaggccgtacaatgccaggaagatgaatgtgcgttaatgttgctggaacatggcactgatccgaatattccagatgagtatggaaataccgctctacactatgctatctacaatgaagataaattaatggccaaagcactgctcttatacggtgctgatatcgaatcaaaaaacaagcatggcctcacaccactgttacttggtgtacatgagcaaaaacagcaagtggtgaaattcttaatcaagaaaaaagcaaatttaaatgcactggatagatatggaagaactgttctcatacttgctgtatgttgtggatcggcaagtatagtcagccttctacttgagcaaaacattgatgtatcttctcaagatctatctggacagacggccagagagtatgctgtttctagtcgtcataatgtaatttgccagttactttctgactacaaagaaaaacagatactaaaagtctcttctgaaaacagcaatccagaacaagacttaaagctgacatcagaggaagagtcacaaaggcttaaaggaagtgaaaatagccagccagaggaaatgtctcaagaaccagaaataaataagggtggtgatagaaaggttgaagaagaaatgaagaagcacggaagtactcatatgggattcccagaaaacctgcctaacggtgccactgctgacaatggtgatgatggattaattccaccaaggaaaagcagaacacctgaaagccagcaatttcctgacactgagaatgaacagtatcacagggacttttctggccatcccaactttcccacgacccttcccatcaaacag

SEQ ID NO: 5860 - DNA, 2181 bp, Homo sapiens
ggtagacgcgatctgctggctactaccggcctcccctggctgttaaaagcagatggtggctgaggctggttcaatgccggctgcctcctctgtgaagaagccatttggtctcagaagcaagatgggcaagtggtgccgccactgcttcccctggtgcagggggagcggcaagagcaacgtgggcacttctggagaccacgatgattctgctatgaagacactcaggagcaagatgggcaagtggtgccgccactgcttcccctggtgcagggggagcggcaagagcaacgtgggcacttctggagaccacgacgactctgctatgaagacactcaggagcaagatgggcaagtggtgctgccactgcttcccctgctgcagggggagcggcaagagcaaagtgggcccctggggagactacgacgacagcgctttcatggagccgaggtaccacgtccgtcgagaagatctggacaagctccacagagctgcctggtggggtaaagtccccagaaaggatctcatcgtcatgctcaaggacactgacatgaacaagaaggacaagcaaaagaggactgctctacatctggcctctgccaatggaaattcagaagtagtaaaactcctgctggacagacgatgtcaacttaatatccttgacaacaaaaagaggacagctctgacaaaggccgtacaatgccaggaagatgaatgtgcgttaatgttgctggaacatggcactgatccgaatattccagatgagtatggaaataccgctctacactatgctatctacaatgaagataaattaatggccaaagcactgctcttatacggtgctgatatcgaatcaaaaaacaagattgagtctcactctgtttcccaggctggagtgcagtggtgtgatcacagctcactgcaacctcgacctcccgaagctcagatggtcctccaacctcaacctcagtttttttttctttctttctttttatttttatttttatttttatttttttttagtagagatgaggtttttgccatgtttctcaggctggtcttgaactcctgggctcaagcaattcatccccctcagcctcccaaagtgctaggattacagcatggcctcacaccactgttacttggtgtacatgagcaaaaacagcaagtggtgaaattcttaatcaagaaaaaagcaaatttaaatgcactggatagatatggaagaactgttctcatacttgctgtatgttgtggatcggcaagtatagtcagccttctacttgagcaaaacattgatgtatcttctcaagatctatctggacagacggccagagagtatgctgtttctagtcgtcataatgtaatttgccagttactttctgactacaaagaaaaacagatactaaaagtctcttctgaaaacagcaatccagaacaagacttaaagctgacatcagaggaagagtcacaaaggcttaaaggaagtgaaaatagccagccagaggaaatgtctcaagaaccagaaataaataagggtggtgatagaaaggttgaagaagaaatgaagaagcacggaagtactcatatgggattcccagaaaacctgcctaacggtgccactgctgacaatggtgatgatggattaattccaccaaggaaaagcagaacacctgaaagccagcaatttcctgacactgagaatgaacagtatcacagtgatgaacaaaatgatactcagaagcaactttctgaagaacagaacactggaatattacaagatgagattctgattcatgaagaaaagcagatagaagtggctgaaaatgaattctgagctttctcttagttataagaaagaaaaagacctcttgcatgaaaatagtacgttgcaggaagaaattgtcatgctaagactggaactagacgtaatgaaacatcagagccagctaagagaaaagaaatatttggaggaaattgaaagtgtggaaaaaaagaatgataatcttttaaagggtctacaactgaatgagctcaccatggatgatgatactgccgtgctcgtcattgacaacggctctggcatgtgcaaggccggctttgcaggtgacgatgccccccgggctgtcttcccttccatcgtggggtgccccaggcaccagaacatgatggggggcatgcgtc

SEQ ID NO: 5861 - DNA, 1583 bp, Homo sapiens
aacatttccaaatcttggcattcttatccacaaagtgaagataataattgtcaattcacaggtgattatgatttaaagagattacttttgaagagttcctaacacattcagtcaacatttaatgatgcttcaggcactgtgttcattgctagtgagcgtatgacacacacagccatacggtcacagagctttcaatgaaaagtaacataattgctcatttcaccaggcccccggcttggggcgccttccttccccatggcgggacacctggcttcggatttcgccttctcgccccctccaggcggtgggggtgatgggccatggggggcggagccgggctgggttgatcctctgacctggctaagcttccaaggccctcctggagggccaggaatcgggccgggggttgggccaggctctgaggtgtgggggattcccccttgccccccgccgtatgagttatgtggggggatggcgtactgtgggcctcaggttggagtggggctagtgccccaaggcggcttggagacctctcagcctgagagcgaagcaggagtcggggtggagagcaactccaatggggcctccccggaaccctgcaccgtcccccctggtgccgtgaagctggagaaggagaagctagagcaaaacccggagaagtcccaggacatcaaagctctgcagaaagaactcgagcaatttgccaagctcctgaagcagaagaggatcaccctgggatatacacaggccgatgtggggctcatcctgggggttctatttgggaaggtgttcagccaaaagaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcatgcaggcccgaaagagaaagcgaaccagtatcgagaaccgagtgagaggcaacctggagaatttgttcctgcagtgcccgaaacccacactgcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctccggccccagggccccattttggtaccccaggctatgggagccctcacttcactgcactgtactcctcagtccctttccctgagggggaagtctttcccccagtctccgtcatcactctgggctctcccatgcattcaaactgaggtgcctgcccttctaggaatggggaacaggggaggggaggagctagggaaagagaacctggagtttgtggcagggcttttgggattaagttcttcattcactaaggaaggaattgggaacactaagggtgggggcaggggagtttggggcaactggttggagggaaggtgaagttcaatgatgctcttgattttaatcccacatcatgtatcacttttttcttaaataaagaagcctgggacacagt

SEQ ID NO: 5862 - DNA, 5357 bp, Homo sapiens
aactggcagcatggcatgatggaaatggaatagaatcaggaattgttttgtacctgtgtgtgtgtgactttggtgttctgactcagacacatatttgagaggtagagaggggagaagagggttgccacattatgtaacagaaaggagcccactgcttaaacacttaccttgtgccagacattgcactaggactttattacctgcaacccatcctgcaaaactgtgaagatttgatatgatcattctcattttatggttgagaaacaagggttaaggacattaaaaatttactcaatgtttaaacatttgcctgtcttattctaaagccccttctcttttcacaatccctttaagaaatggacatccaatatttgagtggcagaggcaaaaacatggcctaccagaaccattatgatagctttacaatatgcccaccaattatttgatagtcctcctgccaaatggtgaaggctaattaccctcctacagaatgtgactcacttctaatgaataaaatatggcacaagtaaaagtgtgcgatttcagagactaggtcataaagaacgcagtggcttcttccctgctctctctttcttaggtcattctctctgggtgaatccagctgacatgttgtgaggacactcaagcagctttatggaaaagcccacatggtgagcaactgaggcctcctaccaacagccaacaagaaaccggggcctttgccaacagccaagaaataagaatcagaaagaaggacacaccattccatagcacagaacacaagtagatggctcccatgaagaatctagcatcatggtatggcagaagcagaatggactcaggaatcatggtgcctacactggaatttcagatcggccactgacacaatggacacattattcaacatttccaaatcttggcattcttatccacaaagtgaagataataattgtcaattcacaggtgattatgatttaaagagattacttttgaagagttcctaacacattcagtcaacatttaatgatgcttcaggcactgtgttcattgctagtgagcgtatgacacacacagccatacggtcacagagctttcaatgaaaagtaacataattgctcatttcaccaggcccccggcttggggcgccttccttccccatggcgggacacctggcttcggatttcgccttctcgccccctccaggcggtgggggtgatgggccatggggggcggagccgggctgggttgatcctctgacctggctaagcttccaaggccctcctggagggccaggaatcgggccgggggttgggccaggctctgaggtgtgggggattcccccttgccccccgccgtatgagttatgtggggggatggcgtactgtgggcctcaggttggagtggggctagtgccccaaggcggcttggagacctctcagcctgagagcgaagcaggagtcggggtggagagcaactccaatggggcctccccggaaccctgcaccgtcccccctggtgccgtgaagctggagaaggagaagctagagcaaaacccggagaagtcccaggacatcaaagctctgcagaaagaactcgagcaatttgccaagctcctgaagcagaagaggatcaccctgggatatacacaggccgatgtggggctcatcctgggggttctatttgggaaggtgttcagccaaaagaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcatgcaggcccgaaagagaaagcgaaccagtatcgagaaccgagtgagaggcaacctggagaatttgttcctgcagtgcccgaaacccacactgcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctccggccccagggccccattttggtaccccaggctatgggagccctcacttcactgcactgtactcctcagtccctttccctgagggggaagtctttcccccagtctccgtcatcactctgggctctcccatgcattcaaactgaggtgcctgcccttctaggaatggggaacaggggaggggaggagctagggaaagagaacctggagtttgtggcagggcttttgggattaagttcttcattcactaaggaaggaattgggaacactaagggtgggggcaggggagtttggggcaactggttggagggaaggtgaagttcaatgatgctcttgattttaatcccacatcatgtatcacttttttcttaaataaagaagcctgggacacagtaaaaaaaaaaaaaaaagaaagaaaagaaaagtaacataattgagtaataattttttaagtgtggtaaaatgtgtggcacgtagtaggtattcaataaatacttgcttttttcctcctttttaccttttcctagagtgctacttgatggtagctgtagtttttcttcaagacatcctatttgtcctgatacaaaacctcttttgaccgctaacggcatagttcggccctcaccattccctcacatattccacaaaaatgtgagcattaaccattccccatgatacagataattcattttttaatttaattttttaaaattttatttatttacttatttattttgagaccaggttatgagactggctaatttttgtatttttggtggagatggggttttgccatattgtctaggctggtctcaaactcctgagctcaagggatcctcctgcctgggcctcccaaagtactgggattacaggcatgagccattgcacctggcccggataattttttttctttttttgaggtagtgccttcctttatagctcaggctggagtgcagtggtgtgatctcggctcactgcaacctctgcctcccaggttcaagtaattctcctgcctcaacctcctgagtagctgggattacaggcgcccactaccacgcccggctaatttttgtatttttagtagagatggggtttcaccatgttggccaggctggtctcgaactcttgacctcaggtgatctgcctgccttggcctcccaaagtattgggattgtaggcgtgaaccaccacgcccggccctgaaaattcatttttaaaagaacatcatatctaccttaaatgcattaagatttcacattagactcattattcatagtgaacattaggaacttaagtccactcagtaataatgcacctattcatgactcttgattcaaagatgtgcacctatttaccctggaccagctccttggaaggacatgaaatagagggtaataatcacatctttccaaatttgctatgaaactgcatcgccaaaaactgagactcattttccgattgatgaatcaaatgacaacaaaatctccagggcattctgaaacccaacagggattaatgattaggcataccagtggtagttaggagacttgcccaaatttccagttttctgcagatggcatctaagttagaagactgtcataaatttattcatggcttggctttctgctatttgctcattggtgacacttttatatacaatggtgtttctatggctaggaaatcccagtggagatcaagaaacctgggttctacaaactaatggggtgacctttgattagtcctaactcccttcctaagcctcagtttctttagacatgaaatgaaagcaatggattacattgccttagactttttcctagatcgaaaatgtgataattgtgcctttccaacaataattgataccactagtgaacattctttcttaagcacatctattaaggacttcatttatattatttttctaatctttaagcaaactctgagataagtgactatgatgtttattccataggtgcaaaagatttgtcaagtaactctccaaagtaaaagagagggctggagtttagactcatgactgttctgctctaacccaagtgattctggatcccagactccccaaatgacaagttattccagaaatactcagaaaaaggagggtgccgtatgtcgcacatggaaaaatagaaaaagtaacagaatccagccaaaggattcccagaaattgaggctcttctgttcttggcatttgcatctttggatgtgtgttttttacattgctctatgcaaaaggtatgtttcaatgtgattttttttttctcctcccatcctaccactgaggaatcacagggaatagactcgacacctgtgaactcaatttaccctagaaaaatgtttcagtcacacttaaaataaaaagggcatcaattagaataagaaggacactttgttgcctaggaggactgaacttttttggacctggggcaccttatcagcttcatttttagctctagtataatcaaaaggtcaggatctccactggaccttagaaattttttatttttcgataagattttctgaatgcctgccatgtgtgaagggaaatgcctggacttctatgcatatgtatttcattgtctccccacatctacccaggaagacaggcacagtgagccttgcatgttgtagataaggaagctaagtctcaaagacagagaaggaatttctcaaggtcacactgtaagtaaaaggcaaaggagggattagaaccctggatcctctttattacaccaagcctgcctcacaaggatgccaatctctcatcacttactgggaaagacccactcctcccattcatgataaggtaatgctatccaataaaaaccccaaagcaggcataaaatatgaagtagcgaaactcaggcaggcagaaagcagagtggtttagacatggctgctgtctgcagcagggagaagttcctggcaacatgaccctgaaaataacaatgagtgactgaagctaagaaggaagaatcttccaaggactctgaaactagatattttctcaagccccacctatggacaaacacaaatcatggagaaataaagatgccagtctccaggaagcaccagagttaaattcattctggaatttaactcctggcattaacagttagctgggagattaaaacaaaccaacacacaaacacaaaaaaataatcagtggaaaaaagttaaaaaaaatcaatggacagtggtttcatagcagatggcaaagaggaatattaaaagctgtattttatttggaa

SEQ ID NO: 5863 - DNA, 1334 bp, Homo sapiens
atcagttcctaccagagccgctgcgggtgccattccacccatggccggacacaggccctcaaaccacttctgcccccttccaggcagtggtgggggcggccccagagggccgatgcccctgcgggttgacactctgacctggttgagcacccaggcggcccctggcagggtgatggtctggccggcagtcaggccagggatctgcccaggccctgacgtgtggaggattcccctgggtcccctgccacacgaattccggggctggatagcaccctgcaggccccgtcttggagctagtgaggcaggggactggttgcgacgcccctccgaaggcgccctcccggggccctacattgccctgcggagcattccgaagttgccgccgccagaggacatctcgggcatactgaaagagttgcagcaattggccaaggagttgaggcagaagaggttgagcctagggtactcgcaggccgatgtggggatcgctgtgggagctctgtttgggaaggtgcttagccagacgaccatctgccgcttcgaggcccagcagctaagcgtcgccaacatgtggaagctgcgaccactgctgaaaaagtggctgaaggaagtggaagcagagaaccttctgggcttatgcaaaatggagatgatcctgcaacagtctgggaagtggagacgggcaagcagagagcgacgaatcggaaacagcctggagaaattcttccagcggtgccctaagcccacaccccagcaaatcagccacattgctgggtgcctccagctgcagaaggatgtggttcgagtttggttctataaccgcagcaagatgggcagtcgaccaaccaatgatgcttccccacgggagattgtggggacagccgggcctccttgcccaggagcaccagtgtgctttcacctgggactggggctcccagtggatatcccccactatacacgtctctactctgcaggggtagcccactcctctgccccagccaccactctgggcctcctcagattttagggctgaggggcttgcccttcacggcacggttggagaggggagaagaagggaaaacccaggaaatgtccctagggttcatttgagggcttttagtattaatttctcattcactgtctaaagaagttaaggatacatagtagggaatgggggtgggaattgttcaagaaaaacctgggagagaagatgaagtttattgcagttttgtgttttccctttgtttttccctagcattggtttaaaggtacattacagtatatagatggtttcgatattttgttcctttttttattaaatattgtgtctgtta

SEQ ID NO: 5864 - DNA, 2385 bp, Homo sapiens
atgggacagtcagggaggtcccggcaccagaagcgcgcccgcgcccaggcgcagctccgcaacctcgaggcctatgccgcgaacccgcactcgttcgtgttcacgcgaggctgcacgggtcgcaacatccggcagctcagcctggacgtgcggcgggtcatggagccgctcactgccagccgtctgcaggttcgtaagaagaactcgctgaaggactgcgtggcagtggctgggcccctcggggtcacacactttctgatcctgagcaaaacagagaccaatgtctactttaagctgatgcgcctcccaggaggccccaccttgaccttccaggtcaagaagtactcgctggtgcgtgatgtggtctcctcactgcgccggcaccgcatgcacgagcagcagtttgcccacccacccctcctggtactcaacagctttggcccccatggtatgcatgtgaagctcatggccaccatgttccagaacctgttcccctccatcaacgtgcacaaggtgaacctgaacaccatcaagcgctgcctcctcatcgactacaaccccgactcccaggagctggacttccgccactatagcatcaaagttgttcctgtgggcgcgagtcgcgggatgaagaagctgctccaggagaagttccccaacatgagccgcctgcaggacatcagcgagctgctggccacgggcgcggggctgtcggagagcgaggcagagcctgacggcgaccacaacatcacagagctgcctcaggctgtcgctggccgtggcaacatgcgggcccagcagagtgcagtgcggctcaccgagatcggcccgcggatgacactgcagctcatcaaggtccaggagggcgtcggggagggcaaagtgatgttccacagttttgtgagcaagacggaggaggagctgcaggccatcctggaagccaaggagaagaagctgcggctgaaggcgcagaggcaggcccagcaggcccagaatgtgcagcgcaagcaggagcagcgggaggcccacagaaagaagagcctggagggcatgaagaaggcacgggtcgggggtagtgatgaagaggcctctgggatcccttcaaggacggcgagcctggagttgggtgaggacgatgatgaacaggaagatgatgacatcgagtatttctgccaggcggtgggcgaggcgcccagtgaggacctgttccccgaggccaagcagaaacggcttgccaagtctccagggcggaagcggaagcggtgggaaatggatcgaggtgccaagtcctgccctgccaacttcttggcagctgccgacgacaaactcagtgggttccagggggacttcctgtggcccatactggtggttgagttcctggtggccgtggccagcaatggcctggccctgtaccgcttcagcatccggaagcagcgcccatggcaccccgccgtggtcttctctgtccagctggcagtcagcgacctgctctgcgccctgacgctgcccccgctggccgcctacctctatccccccaagcactggcgctatggggaggccgcgtgccgcctggagcgcttcctcttcacctgcaacctgctgggcagcgtcatcttcatcacctgcatcagcctcaaccgctacctgggcatcgtgcaccccttcttcgcccgaagccacctgcgacccaagcacgcctgggccgtgagcgctgccggctgggtcctggccgccctgctggccatgcccacactcagcttctcccacctgaagaggccgcagcagggggcgggcaactgcagcgtggccaggcccgaggcctgcatcaagtgtctggggacagcagaccacgggctggcggcctacagagcgtatagcctggtgctggcggggttgggctgcggcctgccgctgctgctcacgctggcagcctacggcgccctcgggcgggccgtgctacgcagcccaggcatgactgtggccgagaagctgcgtgtggcagcgttggtggccagtggtgtggccctctacgccagctcctatgtgccctaccacatcatgcgggtgctcaacgtggatgctcggcggcgctggagcacccgctgcccgagctttgcagacatagcccaggccacagcagccctggagctggggccctacgtgggctaccaggtgatgcggggcctcatgcccctggccttctgtgtccaccctctactctacatggccgcagtgcccagcctgggctgctgctgccgacactgccccggctacagggacagctggaacccagaggacgccaagagcactggccaagccctgcccctcaatgccacagccgcccctaaaccgtcagagccccagtcccgtgagctgagccaatga

SEQ ID NO: 5865 - DNA, 2661 bp, Homo sapiens
gtgtctccatagcaaccgctccatctgattgcccctccccgctcccagaggccacctagtgcgcaggcccgcctgatgtcgtcccacgccgtgccggctctcaggcgccggaagtgagctgcgcagcgccggaagcggcggacgcaggaggcctcgtggaggacacagcagcatgggacagtcagggaggtcccggcaccagaagcgcgcccgcgcccaggcgcagctccgcaacctcgaggcctatgccgcgaacccgcactcgttcgtgttcacgcgaggctgcacgggtcgcaacatccggcagctcagcctggacgtgcggcgggtcatggagccgctcactgccagccgtctgcaggttcgtaagaagaactcgctgaaggactgcgtggcagtggctgggcccctcggggtcacacactttctgatcctgagcaaaacagagaccaatgtctactttaagctgatgcgcctcccaggaggccccaccttgaccttccaggtcaagaagtactcgctggtgcgtgatgtggtctcctcactgcgccggcaccgcatgcacgagcagcagtttgcccacccacccctcctggtactcaacagctttggcccccatggtatgcatgtgaagctcatggccaccatgttccagaacctgttcccctccatcaacgtgcacaaggtgaacctgaacaccatcaagcgctgcctcctcatcgactacaaccccgactcccaggagctggacttccgccactatagcatcaaagttgttcctgtgggcgcgagtcgcgggatgaagaagctgctccaggagaagttccccaacatgagccgcctgcaggacatcagcgagctgctggccacgggcgcggggctgtcggagagcgaggcagagcctgacggcgaccacaacatcacagagctgcctcaggctgtcgctggccgtggcaacatgcgggcccagcagagtgcagtgcggctcaccgagatcggcccgcggatgacactgcagctcatcaaggtccaggagggcgtcggggagggcaaagtgatgttccacagttttgtgagcaagacggaggaggagctgcaggccatcctggaagccaaggagaagaagctgcggctgaaggcgcagaggcaggcccagcaggcccagaatgtgcagcgcaagcaggagcagcgggaggcccacagaaagaagagcctggagggcatgaagaaggcacgggtcgggggtagtgatgaagaggcctctgggatcccttcaaggacggcgagcctggagttgggtgaggacgatgatgaacaggaagatgatgacatcgagtatttctgccaggcggtgggcgaggcgcccagtgaggacctgttccccgaggccaagcagaaacggcttgccaagtctccagggcggaagcggaagcggtgggaaatggatcgaggcaggggtcgcctttgtgaccagaagtttcccaagaccaaggacaagtcccagggagcccaggtgccaagtcctgccctgccaacttcttggcagctgccgacgacaaactcagtgggttccagggggacttcctgtggcccatactggtggttgagttcctggtggccgtggccagcaatggcctggccctgtaccgcttcagcatccggaagcagcgcccatggcaccccgccgtggtcttctctgtccagctggcagtcagcgacctgctctgcgccctgacgctgcccccgctggccgcctacctctatccccccaagcactggcgctatggggaggccgcgtgccgcctggagcgcttcctcttcacctgcaacctgctgggcagcgtcatcttcatcacctgcatcagcctcaaccgctacctgggcatcgtgcaccccttcttcgcccgaagccacctgcgacccaagcacgcctgggccgtgagcgctgccggctgggtcctggccgccctgctggccatgcccacactcagcttctcccacctgaagaggccgcagcagggggcgggcaactgcagcgtggccaggcccgaggcctgcatcaagtgtctggggacagcagaccacgggctggcggcctacagagcgtatagcctggtgctggcggggttgggctgcggcctgccgctgctgctcacgctggcagcctacggcgccctcgggcgggccgtgctacgcagcccaggcatgactgtggccgagaagctgcgtgtggcagcgttggtggccagtggtgtggccctctacgccagctcctatgtgccctaccacatcatgcgggtgctcaacgtggatgctcggcggcgctggagcacccgctgcccgagctttgcagacatagcccaggccacagcagccctggagctggggccctacgtgggctaccaggtgatgcggggcctcatgcccctggccttctgtgtccaccctctactctacatggccgcagtgcccagcctgggctgctgctgccgacactgccccggctacagggacagctggaacccagaggacgccaagagcactggccaagccctgcccctcaatgccacagccgcccctaaaccgtcagagccccagtcccgtgagctgagccaatgatgtggcctagcggaagctgcctcctcaccctaggtgttgctg

SEQ ID NO: 5866 - DNA, 965 bp, Homo sapiens
cttccctgcaatgcgtcaaactggggcgagccactgcaaggtggtggtgggtggtcaaggtgaagccccacgacaaggatgccaaaatgaaataccaggagtgcaacaagatcgtgaagcagaaggcctttgagcgggccatcgcaggcgacgagcacaagcgctccgtggtggactcgctggacatcgagagcatgaccatcgagggtgagtacagcggacccaagcttgaggacgacaaagtgacaatcaccttcatgaaggggctcatgcagtggtacaaggaccagaagaaactgcaccagaaatgcgcctaccaggatttcagacaaaaatcaggaatcatcaccagccaagactgtgttcagaccacgtgacgtcttccaggcaccaggaagaaatacgaccaacctccgtaacaaatgagagaaacttcacctgactgtgttttgtgcatttggtttatgagtcgttttaaaaacgtgtacttttactgctgcgttcaggttttcagccatagaatattctagaaaaaaatagtgataacatttatttcaccgctataaccctgaatgtgtagctgtgttttttaaaaaaacatttttttacaattgtagaatatgtaacatgcctccagaaacgtgccctaaacacaaatatataatttggcaaataattacatagcaagtcctatgttactgtcatctgatctagaaatcatcgtcctcccagaagcccctcatgtgctctggccatctcaaatccctccctgccccagggataaataacatcctgttttgtgataaacgctgccttttctatacacgtgtatgcttattaacaaactatgaatttctccacacggtagatttgattatgtttgaatcttacatgaatgtaatcctattggtggattgtttttaatgtatgtgtgtgtgtgtttcagaaaaaatacattaagaaaa

SEQ ID NO: 5867 - DNA, 859 bp, Homo sapiens
caacggtccggccccgtccgcacagacgctcctgtcggcggcgcccgggagcggctcggctgcccgatgcttccgccccggctgccgcgggccgggctgtacgcttagtgcccggctcaggccccctgaagcgcccgcgggggtgagagcggcctccggccccgcggagacggagcggcttgaggacgaggcggcggccgcggggaggaggatgggggctaaccagttagtggtgctcaacgtgtacgacatgtattggatgaacgaatatacctcatccattggaattggagtttttcattcaggaattgaagtctatggcagagctgttgttttagggagcacggacttcctagaagatgatatagaaaaaattgtagaagaactgggaaaagaatacaaaggcaatgcttatcatttaatgcataaaaactgcaatcatttttcttcagctttatcagagattctttgtgggaaagagattcctcgctggatcaatcgacttgcctacttcagctcctgtataccctttctacagagttgcctcccgaaggagtggctcacgcccgcagccctgcagtctagtgtcagccaagaactccaggatgaactggaggaagcagaggatgctgccgcatccgcttccgtggcaagcactgcagcaggctccagacccgggcgccacactaaactataaatgtctccaaagtcacacattcagaactgtctctggcagtcgaatatcactagagaaaagtaaacagagaagcatcctttagatattttgtatgcaaagatggctctcccccaaatcccagtttttcagctcaggattatatttgtaatcaaaaaaaaaaaa

SEQ ID NO: 5868 - DNA, 4208 bp, Homo sapiens
attttaggtcccgaggtgcgccggccgagaaccagagcgcaggcgggctcagtcctggcgccgggccggccccgcccccggggcgcctggcgcccgccccttgctcaagccccgcctttccccacgtgtctgccgcctaggggaggtgcctcatccggagcgggccgccaacggtccggccccgtccgcacagacgctcctgtcggcggcgcccgggagcggctcggctgcccgatgcttccgccccggctgccgcgggccgggctgtacgcttagtgcccggctcaggccccctgaagcgcccgcgggggtgagagcggcctccggccccgcggagacggagcggcttgaggacgaggcggcggccgcggggaggaggatgggggctaaccagttagtggtgctcaacgtgtacgacatgtattggatgaacgaatatacctcatccattggaattggagtttttcattcaggaattgaagtctatggcagagaatttgcttatggtggccatccttaccccttttctggaatatttgaaatttccccaggaaatgcttctgaactaggagaaacatttaaatttaaagaagctgttgttttagggagcacggacttcctagaagatgatatagaaaaaattgtagaagaactgggaaaagaatacaaaggcaatgcttatcatttaatgcataaaaactgcaatcatttttcttcagctttatcagagattctttgtgggaaagagattcctcgctggatcaatcgacttgcctacttcagctcctgtataccctttctacagagttgcctcccgaaggagtggctcacgcccgcagccctgcagtctagtgtcagccaagaactccaggatgaactggaggaagcagaggatgctgccgcatccgcttccgtggcaagcactgcagcaggctccagacccgggcgccacactaaactataaatgtctccaaagtcacacattcagaactgtctctggcagtcgaatatcactagagaaaagtaaacagagaagcatcctttagatattttgtatgcaaagatggctctcccccaaatcccagtttttcagctcaggattatatttgtaatcaaaaaaaaaaaatcacttggcgcaggagggagaactttgtaagaagctgccctctgttttttttatccactcgtaaatctggatttatttcttctgttttatacaagctctgttaagttatgtttacagtatcttgtatcgctgtttacaaatcttgcatggactcctgccacagtgaaagaagaaaatcttcatgtcttcaaaaattaggcaggtaatctttgtatacttctgacaattgccagatctatggcataaataggcacacaaaaaggtacttaaacagttatagtcaccatcacctgcttcagaatggtcttttagatttgtgtttgttttgttaaagttgttggcaccaggatgcagagaatcagactggcctgaggtgaaggagcacacagccctgagggcttggaaccctgggtccagttcctcttcacacccccttccactctgagtagcacatctccccaggtgcccatggaacacctgctttcatcccaaatatccgtccacctaggcggggtggtatgttcttacgtctctctgactttgatgccactcattctatagtttagctggttttcgttcaagatattcttggtagtaactgacaagtatgttgcacatgtattgggggaggcgcttcatttttattttaatacacatgtatttcctccttgcacaggattttgatggtgtgggaatatcctaagtggtagccttccaagtagcagtgagttgacattcagctgcttttaactattcaggctaccttttatactaaaccttgaaaactagaatctaatgtctaccccaaaaaagtagttctttgatattttatactttttatgtaccatgtcagaaagagtatgttggcgtttgtcatgggactcatttcacataatagaatgcctagtctcattgaccaatcgttaaaaaatcatatttgtgtgtcttaagattcatatttatatgttctctcaaatgtatgtctcttacgtaacatactctaagaatgaaactgtcaccacaggtaaatccttgttagcaaggaatctgtctgctccagtctactcctagtttgatccttggatgtaagaaccaagtcattacatgtcaaattcaatttttctgccttaagaatgaatgtccttcataaaatattggatgcagtgtaacactatccaaggcagtgacttcagctttatatacatataaaatatagttagttttaaaattattgacatttatttaaacttttagattggattgtttgctattgctctgtgtgaggatacataatctttcagtaaactgtatttttaacttttccataagctgattttggttcattttatcaacgtaagcacaccctgttcatagggaaaataaaccttgggttataagcattagcctgaggacaatgaagccacttaacctaatttatgctttcgactgttctgtttccagagaggaaagcctttacaaattactctcagttctttaggggcagaaggcttgtttcaagaggtttgacagaagaaaggaatatatgaacttaatgagatgtcgacttggttcaggtctaaaaatgagggcaaaacactaaggctctagcagtgacttgttcactaaaaagagagagtcctgtccccagacggttagtacaaagccttggatacagtttgcttgtaatatttttaataatgtgaggagtacagtgttttctaattcattcaagtatatatgatttaaacctgggctactgacacacacacagtagccattagttagactcttcttagtgaatatcaggaacatcccatctgtgcttaaccagaatccagcaagtcagcacacaagtgattttattgttattttgttgtatttacttgcatttgttgtatttactttcatctgcagcatttggagtttaaaaataatgtaaagggttctagtagaaatagtgtcctaaggccaattacctaccatactaacaatcagcagataaaattctggacgtgagattccttataatctaattatacctgaggttgagcaagaaatgtcttcctttagaaaatctcattcaagtcaggttcttctctacagttcaaaattgagaatggatttaattaactagcatttagccagctttttcttgcccttggagaaaaagaatcattctcaacctgataatctgttaagaaaaatcccatatgaacaatctggtcattaacatacatatgatacggagtctctttgttgtcaccaagtgaacatacttctcatggtgggttggacagtaatacatgttagagggtcagaagcttctggtttctgctgtttgctttaaatacccttggggtttttttttaaacccttacaaggggagcatcagctttggaaagtgtgactctgtaggagtgtagaaggcagtggtgtatgatcttagcctcgtcctgatgcctgaatccagccagctgttgctctgacccacagcaatagagcaagttacccatcaccagcatttgtacagagcagggaattctggttttagtccattggtagcattgtgtgtatgaggagattcaacaccacagacagctgcaggactcgatatccatggcttctttccatcacaaaacgggtagaaacacattcactgcttcagggttctaatctgtgtgtctccttatgactccatttctgtaagctactctgtaactttgatatatgctgtattttctttctttaaaagatttagatgttttttcagcaagctagccatacaaccattgtatctctttctcttcagtatggtttagagcccagatcagttagtaggctttcgttgtcttctctttcaatacatgtacatctttactgtttgaaaagtgttacagctgtcaaagaatcttcatggacctgaagataatttcttgtgaagttgaatgcaagtgtactgtcattcatagtgtttatatcaaaataccaggaatcttcacttttgctaccttgatatagcattgggctatcatgttacaacattgaaatacattgatttattaaaaaatacttttataagaaa

SEQ ID NO: 5869 - DNA, 486 bp, Homo sapiens
agctcctctgcttctgccgaactgtccgtctctctccatggctacgtcttcagaaactcccaagcccctctaagtccagaaggtcacagctttcgggtgcctgtgctagaatctcttcaaaggtgaacaggagccaacacaccctttccttgtgtgttaaaggcaacctcgttaaaatatgaatgaggctaacatttctcaagaaaatagcccagctgaattatttagagatcctggtggtgctcctttcctacactctgaagaccactttccagtattggatgaacgaatatacctcatccattggaattggagtttttcattcaggaattgaagtctatggcagagaatttgcttatggtggccatccttaccccttttctggaatatttgaaatttccccaggaaatgcttctgaactaggagaaacatttaaatttaaagaagctgttgttttagggagcacggacttcctagaagatgata

SEQ ID NO: 5870 - DNA, 5817 bp, Homo sapiens
caaaaatgaagccagctcttcctcacagccggtagatggaagtcatttttccagggcctggaaggagttggtaggaagactagatttcagccagcccttgcgccctgtttgtgccagcaggcaccagcgaaccaaaagcaggtgtccatgtctgcttactctgtgccttcaacttttgcccaggcctcattgccagttcataaccaggtgctgccttccatcgagagtgtagatgggtccgaccctttggcaactctgcagacccctctaggcagactggaggccaaagaggaagaggatgaggatgaggacgaggacactgaggaagatgaggaagaagacggtgaggacacggatctggatgactgggagccagacccgccccggcccttcgacccacacgacttgtggtgtgaggagtgcaataacgcgcatgcttcagtgtgtccgaagcacggccccttgcacccgatccccaaccggccggtgctcacccgggccagggcgagcctccccctggtgctctacatagacaggtttctgggcggggtgttctccaagcggcgcatccccaagcgcacccagtttggccccgtggaggggcctctcgtcaggggctcggagctgaaagactgttacattcacctcaaggtttctcttgataaaggggacaggaaagaaagggatttacatgaagacctatggtttgagttgtctgatgagacgctttgtaactggatgatgtttgtacggccagcccagaatcacctggagcagaacctggtggcttaccagtatggccaccatgtgtattatacaaccataaaaaatgtggagcccaagcaggaactgaaggtgtggtatgccgcatcctatgctgagttcgtgaaccagaaaattcatgacatttctgaggaagaaaggaaagttcttcgagagcaagagaagaattggccctgctatgaatgtaaccgccgatttataagctcggagcagttgcaacagcatctcaattctcatgatgagaaactagatgtgtttagcagaacaagaggcagaggaaggggacgaggcaagaggcgattcggtccaggtcgacggccggggcgtcctccaaaatttatccgcctggaaatcaccagcgaaaatggggaaaagagtgacgatgggacacaggacttgctacattttcccacaaaggagcaatttgatgaggctgaaccagccactctgaatgggctggatcaaccagaacagaccactatcccaatccctcagctgccacaggaaacccagtcttccctggaacatgaaccagaaactcacaccctgcacctgcagccgcagcatgaagagagcgtggtgcccacccagagcacgctgacagccgacgacatgcgcagagccaagcgcatccgaaatgcagctcttcagcatctgtttattcggaagtccttccggccttttaaatgcttgcagtgtgggaaggccttccgggaaaaggacaaactggaccagcacttacgcttccatgggcgggaggggaactgcccactgacctgtgatctctgtaacaagggcttcatcagcagcacatccttggagagccacatgaagctccactcagaccagaagacttactcttgcattttttgcccagaatcctttgaccgccttgatttgttgaaagatcatgtggccattcatatcaatgatggctacttcacctgcccaacttgtaagaaacggttcccagattttatccaggtgaaaaaacacgtgcgcagcttccactcagaaaagatctaccagtgcacagagtgtgacaaggccttctgtcgccccgataaactgcgactccacatgctccggcattcggaccgcaaagacttcctgtgttccacctgtgggaagcaatttaagcgaaaagacaaactacgggaacacatgcagaggatgcataatcctgagagggaggccaagaaagccgaccgcatcagccgctccaagacgttcaagccccgcatcacgtccacagactacgacagcttcacgttcaagtgccgcctgtgcatgatgggcttccggcggcgcggcatgctggtaaatcacttatcgaagagacacccagacatgaagatagaagaggtgccagagttaactctacccatcataaaacccaatcgtgattacttttgtcagtattgcgataaggtttataaaagtgccagcaagcgcaaagcccacattctgaagaaccacccaggagcagagctcccaccgagcattcggaagctccgacccgctggtcctggagagccagaccccatgctgagcacacacacccagctgacgggcaccatcgccacccctcccgtctgctgtccccactgctccaagcagtacagcagcaagaccaagatggtccagcacattcgaaagaagcatccagagttcgcccagctctccaacaccatacacacaccactgacgacagctgtgatcagtgccaccccagcggttttgactacagacagcgccactggagagactgtggtgacgacggacctgctcacccaagcaatgacagaactgtcccagaccttaacgacagactaccgaacgccacaaggggattaccagagaattcagtacatccctgtgtcgcagtcggcgtctggcctccagcagcctcagcacatacagctgcaagtggttcaagtggcctcggtatctgggcagccgttgagtccctcagcccagcaggctcagcaggggctcagcccctcccacatccagggcagttcttccacacaggggcaggctctgcagcagcagcagcagcagcagcagaattcctctgtgcagcacacgtacctgcccagtgcttggaattccttccgtggctattcatctgagattcaaatgatgacgcttcctccgggtcagtttgtgattacagacagtggtgtggcaactccagttactactggccaggtgaaggcggttacttcgggtcattatgtgttatcagaaagtcaatcagaattggaagaaaagcaaacttctgccctctctggtggagtccaggtcgagccacctgcacacagtgactccctggacccccagaccaacagccaacagcagaccacacagtacatcatcaccaccaccaccaacgggaacggaagcagcgaagtgcatatcaccaaaccatgacttccaccctggagcttgaatccagcacccacctcatgtctgttctcataagtctgaaagctctgacacgtagagctcttttgtaagatttattattcactcaagagttcggaaaccacagttttgtctctcatccatacactggggtttattttgccaaggtcatctttatcaaattgactcttcaaaccctcggtttttgccacagaacagagatctttcaggggaaagtagatttcgaggtggagagaatttgccttgctcttgagctggtcttttaacatactgacgagccttacttttcctttgtggaaatattaagtggcatattgtgttcataccaaaggtggagacaggatgtgccaagttcatggttactggacttcttattccaagccatggcaccaaaggagaaggggcattttgtgggtgtgcattaggtctgaactgctttatcttgttttagttttcagtaatttaacaaagggagcctgctgaataacaaaattaaaatgatgaaacaaaagtttgacagtgatattctgaagcaaaaactgtcatctaaatttttcttgctgattttttttaacttccctattttagaaaactattgttgggctgttggtagtgctttccacagatgctggtcctcagtggattaggtcagaagctcatgttctgatagttcttcattatttcacaaaggtggacaacctgaaagagaaaaggctgcttgatgtcagcagaatctaaacccctacattaaagctttgcctcccattctgtggttgtggtggtggtaagaaggagatattggtaccaagaaaaatttccaaaactattgagagagagagagagaaagtattgaaattttgttctgccttgcaggatccatttatcattcattggtaaaggatatattccttgttcttaccaagtgtacatttaactcttgctgacatgttcagtgtattttattacttttaatgctgtcttaaaatgaacattctttaaagttggacaggaaggtggcatttcttatttattaacatttttaactttaaacatattgtgactcatctagaccttttaataagacggtcaacttcacacttagggaaaaaattaaaatgtgatggccacttctaataattcaggtagttataagggatctggaagaaatccagtctttatgaatatactattagttgggcattaaaaaatcagtatatattttaactttttgtgacatgctaacacattttcagaataattattgcatagtagaatttattactccagaacagaaagaccttacttcatttcaaatgaagttaattaatttacatttctgggtaaaaactggttctataaattaagtagagtagcttctttatgataaagacaattttctgaaaagtgaacaattctgttaaaagaactttattgatgtgtagatttcgcactttatttctgagactgcgttcatgtagttgttccccaatgtttgagtactaagagaacttgagaaaattacttcataaacatatggaaactgaaaatggactctctttgtgacaaagatattcaacagaaaatattgaccctgcattgcaaaacacaggttcgggttccctaagtcccacagtgtaatgattacaaatatcctagtgtccggtctagaaagactttctaggagaagactagtggaattttctaaaggttcagttttagcttttataacttaaatttggccctgttacgttctttttaatttgaaccataaggtatctcccctcccttcaggaataacttattggaaaactgaaaagaatcactgaatggaatgttcattttatggcagttgttttaagttttaaaatacacagaggaaaatattgtggaaggacctctttgttgctttcccttctaagttgtcttcttcttcttcttcttcttcttcttctttggtccttaagtgaaataaagactctaaaactaatttgtatattatcagccagagatgcggatggcagtcgagccaaatcgcatggctttcagatcaggtattctgcacattcattccaaggtcatagatttttaaaaggacctggatttgaagagatggcaaatgatgagccatcagaaaacttaatttggaaaacatgtatgtagccagtgtggatattgtggcctctctcaagacacattgacactgtagacttcattcagtccagtgtgagtattttggagtaggttggatgtagattttgtttttatcattgatttgtaccgacagaaatagacatttcatcatgtaaaattcctgttattctggaaaaacctattgttttgatcttcttgttttctgacttggaagtatcctttcaaaaaaactcttaagatatctaggtctaaaaagcacttcatgagatgctaaagctgacccactggttgaaaatgttgaccctatcctgttatttaaatgtgaacatttattgtacattcagtgagttatagtgttaatagtcttgtgctatgcagcaggtgtaaaaattaataaatatattttttaataaacatgtttgtatgtgtgaa

SEQ ID NO: 5871 - DNA, 6322 bp, Homo sapiens
actctgcggcgggaagaaccacctggaggtggcggggggggttgatttctatcacccctagggagagaggatcggggacccgctgatcttccagctcccctcacccaacgtcgtgcatgctgcagacagacctttccgtccttcatgaacacacgtgtggtagacagatgactgtcctgtaccctgtgctgctctaggtgtgccagacgtggagctgtccagttgggagaagatggattccaaagatgaaagctcgcatgtgtggccgacatctgcagagcatgaacagaatgccgcacaggtgcactttgttccggacacaggaacagtggctcagattgtctataccgatgaccaggttcgccccccacagcaggtggtgtacacggcagatggtgcctcctacacatcagtggatggtccagagcacacgctggtgtacatccacccggtggaagctgcacagactctgtttacagaccccggccaggtagcttatgtccaacaggatgctacagctcagcaggcctcattgccagttcataaccaggtgctgccttccatcgagagtgtagatgggtccgaccctttggcaactctgcagacccctctaggcagactggaggccaaagaggaagaggatgaggatgaggacgaggacactgaggaagatgaggaagaagacggtgaggacacggatctggatgactgggagccagacccgccccggcccttcgacccacacgacttgtggtgtgaggagtgcaataacgcgcatgcttcagtgtgtccgaagcacggccccttgcacccgatccccaaccggccggtgctcacccgggccagggcgagcctccccctggtgctctacatagacaggtttctgggcggggtgttctccaagcggcgcatccccaagcgcacccagtttggccccgtggaggggcctctcgtcaggggctcggagctgaaagactgttacattcacctcaaggtttctcttgataaaggggacaggaaagaaagggatttacatgaagacctatggtttgagttgtctgatgagacgctttgtaactggatgatgtttgtacggccagcccagaatcacctggagcagaacctggtggcttaccagtatggccaccatgtgtattatacaaccataaaaaatgtggagcccaagcaggaactgaaggtgtggtatgccgcatcctatgctgagttcgtgaaccagaaaattcatgacatttctgaggaagaaaggaaagttcttcgagagcaagagaagaattggccctgctatgaatgtaaccgccgatttataagctcggagcagttgcaacagcatctcaattctcatgatgagaaactagatgtgtttagcagaacaagaggcagaggaaggggacgaggcaagaggcgattcggtccaggtcgacggccggggcgtcctccaaaatttatccgcctggaaatcaccagcgaaaatggggaaaagagtgacgatgggacacaggacttgctacattttcccacaaaggagcaatttgatgaggctgaaccagccactctgaatgggctggatcaaccagaacagaccactatcccaatccctcagctgccacaggaaacccagtcttccctggaacatgaaccagaaactcacaccctgcacctgcagccgcagcatgaagagagcgtggtgcccacccagagcacgctgacagccgacgacatgcgcagagccaagcgcatccgattggagctgcagaatgcagctcttcagcatctgtttattcggaagtccttccggccttttaaatgcttgcagtgtgggaaggccttccgggaaaaggacaaactggaccagcacttacgcttccatgggcgggaggggaactgcccactgacctgtgatctctgtaacaagggcttcatcagcagcacatccttggagagccacatgaagctccactcagaccagaagacttactcttgcattttttgcccagaatcctttgaccgccttgatttgttgaaagatcatgtggccattcatatcaatgatggctacttcacctgcccaacttgtaagaaacggttcccagattttatccaggtgaaaaaacacgtgcgcagcttccactcagaaaagatctaccagtgcacagagtgtgacaaggccttctgtcgccccgataaactgcgactccacatgctccggcattcggaccgcaaagacttcctgtgttccacctgtgggaagcaatttaagcgaaaagacaaactacgggaacacatgcagaggatgcataatcctgagagggaggccaagaaagccgaccgcatcagccgctccaagacgttcaagccccgcatcacgtccacagactacgacagcttcacgttcaagtgccgcctgtgcatgatgggcttccggcggcgcggcatgctggtaaatcacttatcgaagagacacccagacatgaagatagaagaggtgccagagttaactctacccatcataaaacccaatcgtgattacttttgtcagtattgcgataaggtttataaaagtgccagcaagcgcaaagcccacattctgaagaaccacccaggagcagagctcccaccgagcattcggaagctccgacccgctggtcctggagagccagaccccatgctgagcacacacacccagctgacgggcaccatcgccacccctcccgtctgctgtccccactgctccaagcagtacagcagcaagaccaagatggtccagcacattcgaaagaagcatccagagttcgcccagctctccaacaccatacacacaccactgacgacagctgtgatcagtgccaccccagcggttttgactacagacagcgccactggagagactgtggtgacgacggacctgctcacccaagcaatgacagaactgtcccagaccttaacgacagactaccgaacgccacaaggggattaccagagaattcagtacatccctgtgtcgcagtcggcgtctggcctccagcagcctcagcacatacagctgcaagtggttcaagtggcctcggccacttcccctcaccagtcacagcagtccactgtggatgttggccagctccatgatcctcagccctacccccagcacgccatccaggtgcagcacatccaggtcagcgagcctaccgcctcggccccgtcctccgcccaggtatctgggcagccgttgagtccctcagcccagcaggctcagcaggggctcagcccctcccacatccagggcagttcttccacacaggggcaggctctgcagcagcagcagcagcagcagcagaattcctctgtgcagcacacgtacctgcccagtgcttggaattccttccgtggctattcatctgagattcaaatgatgacgcttcctccgggtcagtttgtgattacagacagtggtgtggcaactccagttactactggccaggtgaaggcggttacttcgggtcattatgtgttatcagaaagtcaatcagaattggaagaaaagcaaacttctgccctctctggtggagtccaggtcgagccacctgcacacagtgactccctggacccccagaccaacagccaacagcagaccacacagtacatcatcaccaccaccaccaacgggaacggaagcagcgaagtgcatatcaccaaaccatgacttccaccctggagcttgaatccagcacccacctcatgtctgttctcataagtctgaaagctctgacacgtagagctcttttgtaagatttattattcactcaagagttcggaaaccacagttttgtctctcatccatacactggggtttattttgccaaggtcatctttatcaaattgactcttcaaaccctcggtttttgccacagaacagagatctttcaggggaaagtagatttcgaggtggagagaatttgccttgctcttgagctggtcttttaacatactgacgagccttacttttcctttgtggaaatattaagtggcatattgtgttcataccaaaggtggagacaggatgtgccaagttcatggttactggacttcttattccaagccatggcaccaaaggagaaggggcattttgtgggtgtgcattaggtctgaactgctttatcttgttttagttttcagtaatttaacaaagggagcctgctgaataacaaaattaaaatgatgaaacaaaagtttgacagtgatattctgaagcaaaaactgtcatctaaatttttcttgctgattttttttaacttccctattttagaaaactattgttgggctgttggtagtgctttccacagatgctggtcctcagtggattaggtcagaagctcatgttctgatagttcttcattatttcacaaaggtggacaacctgaaagagaaaaggctgcttgatgtcagcagaatctaaacccctacattaaagctttgcctcccattctgtggttgtggtggtggtaagaaggagatattggtaccaagaaaaatttccaaaactattgagagagagagagagaaagtattgaaattttgttctgccttgcaggatccatttatcattcattggtaaaggatatattccttgttcttaccaagtgtacatttaactcttgctgacatgttcagtgtattttattacttttaatgctgtcttaaaatgaacattctttaaagttggacaggaaggtggcatttcttatttattaacatttttaactttaaacatattgtgactcatctagaccttttaataagacggtcaacttcacacttagggaaaaaattaaaatgtgatggccacttctaataattcaggtagttataagggatctggaagaaatccagtctttatgaatatactattagttgggcattaaaaaatcagtatatattttaactttttgtgacatgctaacacattttcagaataattattgcatagtagaatttattactccagaacagaaagaccttacttcatttcaaatgaagttaattaatttacatttctgggtaaaaactggttctataaattaagtagagtagcttctttatgataaagacaattttctgaaaagtgaacaattctgttaaaagaactttattgatgtgtagatttcgcactttatttctgagactgcgttcatgtagttgttccccaatgtttgagtactaagagaacttgagaaaattacttcataaacatatggaaactgaaaatggactctctttgtgacaaagatattcaacagaaaatattgaccctgcattgcaaaacacaggttcgggttccctaagtcccacagtgtaatgattacaaatatcctagtgtccggtctagaaagactttctaggagaagactagtggaattttctaaaggttcagttttagcttttataacttaaatttggccctgttacgttctttttaatttgaaccataaggtatctcccctcccttcaggaataacttattggaaaactgaaaagaatcactgaatggaatgttcattttatggcagttgttttaagttttaaaatacacagaggaaaatattgtggaaggacctctttgttgctttcccttctaagttgtcttcttcttcttcttcttcttcttcttctttggtccttaagtgaaataaagactctaaaactaatttgtatattatcagccagagatgcggatggcagtcgagccaaatcgcatggctttcagatcaggtattctgcacattcattccaaggtcatagatttttaaaaggacctggatttgaagagatggcaaatgatgagccatcagaaaacttaatttggaaaacatgtatgtagccagtgtggatattgtggcctctctcaagacacattgacactgtagacttcattcagtccagtgtgagtattttggagtaggttggatgtagattttgtttttatcattgatttgtaccgacagaaatagacatttcatcatgtaaaattcctgttattctggaaaaacctattgttttgatcttcttgttttctgacttggaagtatcctttcaaaaaaactcttaagatatctaggtctaaaaagcacttcatgagatgctaaagctgacccactggttgaaaatgttgaccctatcctgttatttaaatgtgaacatttattgtacattcagtgagttatagtgttaatagtcttgtgctatgcagcaggtgtaaaaattaataaatatattttttaataaacatgtttgtatgtgtgaagctacaaga

SEQ ID NO: 5872 - DNA, 6301 bp, Homo sapiens
actctgcggcgggaagaaccacctggaggtggcggggggggttgatttctatcacccctagggagagaggatcggggacccgctgatcttccagctcccctcacccaacgtcgtgcatgctgcagacagacctttccgtccttcatgaacacacgtgtggtagacagatgactgtcctgtaccctgtgctgctctaggtgtgccagacgtggagctgtccagttgggagaagatggattccaaagatgaaagctcgcatgtgtggccgacatctgcagagcatgaacagaatgccgcacaggtgcactttgttccggacacaggaacagtggctcagattgtctataccgatgaccaggttcgccccccacagcaggtggtgtacacggcagatggtgcctcctacacatcagtggatggtccagagcacacgctggtgtacatccacccggtggaagctgcacagactctgtttacagaccccggccaggtagcttatgtccaacaggatgctacagctcagcaggcctcattgccagttcataaccaggtgctgccttccatcgagagtgtagatgggtccgaccctttggcaactctgcagacccctctaggcagactggaggccaaagaggaagaggatgaggatgaggacgaggacactgaggaagatgaggaagaagacggtgaggacacggatctggatgactgggagccagacccgccccggcccttcgacccacacgacttgtggtgtgaggagtgcaataacgcgcatgcttcagtgtgtccgaagcacggccccttgcacccgatccccaaccggccggtgctcacccgggccagggcgagcctccccctggtgctctacatagacaggtttctgggcggggtgttctccaagcggcgcatccccaagcgcacccagtttggccccgtggaggggcctctcgtcaggggctcggagctgaaagactgttacattcacctcaaggtttctcttgataaaggggacaggaaagaaagggatttacatgaagacctatggtttgagttgtctgatgagacgctttgtaactggatgatgtttgtacggccagcccagaatcacctggagcagaacctggtggcttaccagtatggccaccatgtgtattatacaaccataaaaaatgtggagcccaagcaggaactgaaggtgtggtatgccgcatcctatgctgagttcgtgaaccagaaaattcatgacatttctgaggaagaaaggaaagttcttcgagagcaagagaagaattggccctgctatgaatgtaaccgccgatttataagctcggagcagttgcaacagcatctcaattctcatgatgagaaactagatgtgtttagcagaacaagaggcagaggaaggggacgaggcaagaggcgattcggtccaggtcgacggccggggcgtcctccaaaatttatccgcctggaaatcaccagcgaaaatggggaaaagagtgacgatgggacacaggacttgctacattttcccacaaaggagcaatttgatgaggctgaaccagccactctgaatgggctggatcaaccagaacagaccactatcccaatccctcagctgccacaggaaacccagtcttccctggaacatgaaccagaaactcacaccctgcacctgcagccgcagcatgaagagagcgtggtgcccacccagagcacgctgacagccgacgacatgcgcagagccaagcgcatccgaaatgcagctcttcagcatctgtttattcggaagtccttccggccttttaaatgcttgcagtgtgggaaggccttccgggaaaaggacaaactggaccagcacttacgcttccatgggcgggaggggaactgcccactgacctgtgatctctgtaacaagggcttcatcagcagcacatccttggagagccacatgaagctccactcagaccagaagacttactcttgcattttttgcccagaatcctttgaccgccttgatttgttgaaagatcatgtggccattcatatcaatgatggctacttcacctgcccaacttgtaagaaacggttcccagattttatccaggtgaaaaaacacgtgcgcagcttccactcagaaaagatctaccagtgcacagagtgtgacaaggccttctgtcgccccgataaactgcgactccacatgctccggcattcggaccgcaaagacttcctgtgttccacctgtgggaagcaatttaagcgaaaagacaaactacgggaacacatgcagaggatgcataatcctgagagggaggccaagaaagccgaccgcatcagccgctccaagacgttcaagccccgcatcacgtccacagactacgacagcttcacgttcaagtgccgcctgtgcatgatgggcttccggcggcgcggcatgctggtaaatcacttatcgaagagacacccagacatgaagatagaagaggtgccagagttaactctacccatcataaaacccaatcgtgattacttttgtcagtattgcgataaggtttataaaagtgccagcaagcgcaaagcccacattctgaagaaccacccaggagcagagctcccaccgagcattcggaagctccgacccgctggtcctggagagccagaccccatgctgagcacacacacccagctgacgggcaccatcgccacccctcccgtctgctgtccccactgctccaagcagtacagcagcaagaccaagatggtccagcacattcgaaagaagcatccagagttcgcccagctctccaacaccatacacacaccactgacgacagctgtgatcagtgccaccccagcggttttgactacagacagcgccactggagagactgtggtgacgacggacctgctcacccaagcaatgacagaactgtcccagaccttaacgacagactaccgaacgccacaaggggattaccagagaattcagtacatccctgtgtcgcagtcggcgtctggcctccagcagcctcagcacatacagctgcaagtggttcaagtggcctcggccacttcccctcaccagtcacagcagtccactgtggatgttggccagctccatgatcctcagccctacccccagcacgccatccaggtgcagcacatccaggtcagcgagcctaccgcctcggccccgtcctccgcccaggtatctgggcagccgttgagtccctcagcccagcaggctcagcaggggctcagcccctcccacatccagggcagttcttccacacaggggcaggctctgcagcagcagcagcagcagcagcagaattcctctgtgcagcacacgtacctgcccagtgcttggaattccttccgtggctattcatctgagattcaaatgatgacgcttcctccgggtcagtttgtgattacagacagtggtgtggcaactccagttactactggccaggtgaaggcggttacttcgggtcattatgtgttatcagaaagtcaatcagaattggaagaaaagcaaacttctgccctctctggtggagtccaggtcgagccacctgcacacagtgactccctggacccccagaccaacagccaacagcagaccacacagtacatcatcaccaccaccaccaacgggaacggaagcagcgaagtgcatatcaccaaaccatgacttccaccctggagcttgaatccagcacccacctcatgtctgttctcataagtctgaaagctctgacacgtagagctcttttgtaagatttattattcactcaagagttcggaaaccacagttttgtctctcatccatacactggggtttattttgccaaggtcatctttatcaaattgactcttcaaaccctcggtttttgccacagaacagagatctttcaggggaaagtagatttcgaggtggagagaatttgccttgctcttgagctggtcttttaacatactgacgagccttacttttcctttgtggaaatattaagtggcatattgtgttcataccaaaggtggagacaggatgtgccaagttcatggttactggacttcttattccaagccatggcaccaaaggagaaggggcattttgtgggtgtgcattaggtctgaactgctttatcttgttttagttttcagtaatttaacaaagggagcctgctgaataacaaaattaaaatgatgaaacaaaagtttgacagtgatattctgaagcaaaaactgtcatctaaatttttcttgctgattttttttaacttccctattttagaaaactattgttgggctgttggtagtgctttccacagatgctggtcctcagtggattaggtcagaagctcatgttctgatagttcttcattatttcacaaaggtggacaacctgaaagagaaaaggctgcttgatgtcagcagaatctaaacccctacattaaagctttgcctcccattctgtggttgtggtggtggtaagaaggagatattggtaccaagaaaaatttccaaaactattgagagagagagagagaaagtattgaaattttgttctgccttgcaggatccatttatcattcattggtaaaggatatattccttgttcttaccaagtgtacatttaactcttgctgacatgttcagtgtattttattacttttaatgctgtcttaaaatgaacattctttaaagttggacaggaaggtggcatttcttatttattaacatttttaactttaaacatattgtgactcatctagaccttttaataagacggtcaacttcacacttagggaaaaaattaaaatgtgatggccacttctaataattcaggtagttataagggatctggaagaaatccagtctttatgaatatactattagttgggcattaaaaaatcagtatatattttaactttttgtgacatgctaacacattttcagaataattattgcatagtagaatttattactccagaacagaaagaccttacttcatttcaaatgaagttaattaatttacatttctgggtaaaaactggttctataaattaagtagagtagcttctttatgataaagacaattttctgaaaagtgaacaattctgttaaaagaactttattgatgtgtagatttcgcactttatttctgagactgcgttcatgtagttgttccccaatgtttgagtactaagagaacttgagaaaattacttcataaacatatggaaactgaaaatggactctctttgtgacaaagatattcaacagaaaatattgaccctgcattgcaaaacacaggttcgggttccctaagtcccacagtgtaatgattacaaatatcctagtgtccggtctagaaagactttctaggagaagactagtggaattttctaaaggttcagttttagcttttataacttaaatttggccctgttacgttctttttaatttgaaccataaggtatctcccctcccttcaggaataacttattggaaaactgaaaagaatcactgaatggaatgttcattttatggcagttgttttaagttttaaaatacacagaggaaaatattgtggaaggacctctttgttgctttcccttctaagttgtcttcttcttcttcttcttcttcttcttctttggtccttaagtgaaataaagactctaaaactaatttgtatattatcagccagagatgcggatggcagtcgagccaaatcgcatggctttcagatcaggtattctgcacattcattccaaggtcatagatttttaaaaggacctggatttgaagagatggcaaatgatgagccatcagaaaacttaatttggaaaacatgtatgtagccagtgtggatattgtggcctctctcaagacacattgacactgtagacttcattcagtccagtgtgagtattttggagtaggttggatgtagattttgtttttatcattgatttgtaccgacagaaatagacatttcatcatgtaaaattcctgttattctggaaaaacctattgttttgatcttcttgttttctgacttggaagtatcctttcaaaaaaactcttaagatatctaggtctaaaaagcacttcatgagatgctaaagctgacccactggttgaaaatgttgaccctatcctgttatttaaatgtgaacatttattgtacattcagtgagttatagtgttaatagtcttgtgctatgcagcaggtgtaaaaattaataaatatattttttaataaacatgtttgtatgtgtgaa

SEQ ID NO: 5873 - DNA, 5998 bp, Homo sapiens
agccctcccaggtgtgggacagaaggggcagagggagggcagaggcttaaaggctgtgagcagtcagatcaaaaatgaagccagctcttcctcacagccggtagatggaagtcatttttccagggcctggaaggagttggtaggaagactagatttcagccagcccttgcgccctgtttgtgccagcaggcaccagcgaaccaaaagcaggtgtccatgtctgcttactctgtgccttcaacttttgcccaggcctcattgccagttcataaccaggtgctgccttccatcgagagtgtagatgggtccgaccctttggcaactctgcagacccctctaggcagactggaggccaaagaggaagaggatgaggatgaggacgaggacactgaggaagatgaggaagaagacggtgaggacacggatctggatgactgggagccagacccgccccggcccttcgacccacacgacttgtggtgtgaggagtgcaataacgcgcatgcttcagtgtgtccgaagcacggccccttgcacccgatccccaaccggccggtgctcacccgggccagggcgagcctccccctggtgctctacatagacaggtttctgggcggggtgttctccaagcggcgcatccccaagcgcacccagtttggccccgtggaggggcctctcgtcaggggctcggagctgaaagactgttacattcacctcaaggtttctcttgataaaggggacaggaaagaaagggatttacatgaagacctatggtttgagttgtctgatgagacgctttgtaactggatgatgtttgtacggccagcccagaatcacctggagcagaacctggtggcttaccagtatggccaccatgtgtattatacaaccataaaaaatgtggagcccaagcaggaactgaaggtgtggtatgccgcatcctatgctgagttcgtgaaccagaaaattcatgacatttctgaggaagaaaggaaagttcttcgagagcaagagaagaattggccctgctatgaatgtaaccgccgatttataagctcggagcagttgcaacagcatctcaattctcatgatgagaaactagatgtgtttagcagaacaagaggcagaggaaggggacgaggcaagaggcgattcggtccaggtcgacggccggggcgtcctccaaaatttatccgcctggaaatcaccagcgaaaatggggaaaagagtgacgatgggacacaggacttgctacattttcccacaaaggagcaatttgatgaggctgaaccagccactctgaatgggctggatcaaccagaacagaccactatcccaatccctcagctgccacaggaaacccagtcttccctggaacatgaaccagaaactcacaccctgcacctgcagccgcagcatgaagagagcgtggtgcccacccagagcacgctgacagccgacgacatgcgcagagccaagcgcatccgattggagctgcagaatgcagctcttcagcatctgtttattcggaagtccttccggccttttaaatgcttgcagtgtgggaaggccttccgggaaaaggacaaactggaccagcacttacgcttccatgggcgggaggggaactgcccactgacctgtgatctctgtaacaagggcttcatcagcagcacatccttggagagccacatgaagctccactcagaccagaagacttactcttgcattttttgcccagaatcctttgaccgccttgatttgttgaaagatcatgtggccattcatatcaatgatggctacttcacctgcccaacttgtaagaaacggttcccagattttatccaggtgaaaaaacacgtgcgcagcttccactcagaaaagatctaccagtgcacagagtgtgacaaggccttctgtcgccccgataaactgcgactccacatgctccggcattcggaccgcaaagacttcctgtgttccacctgtgggaagcaatttaagcgaaaagacaaactacgggaacacatgcagaggatgcataatcctgagagggaggccaagaaagccgaccgcatcagccgctccaagacgttcaagccccgcatcacgtccacagactacgacagcttcacgttcaagtgccgcctgtgcatgatgggcttccggcggcgcggcatgctggtaaatcacttatcgaagagacacccagacatgaagatagaagaggtgccagagttaactctacccatcataaaacccaatcgtgattacttttgtcagtattgcgataaggtttataaaagtgccagcaagcgcaaagcccacattctgaagaaccacccaggagcagagctcccaccgagcattcggaagctccgacccgctggtcctggagagccagaccccatgctgagcacacacacccagctgacgggcaccatcgccacccctcccgtctgctgtccccactgctccaagcagtacagcagcaagaccaagatggtccagcacattcgaaagaagcatccagagttcgcccagctctccaacaccatacacacaccactgacgacagctgtgatcagtgccaccccagcggttttgactacagacagcgccactggagagactgtggtgacgacggacctgctcacccaagcaatgacagaactgtcccagaccttaacgacagactaccgaacgccacaaggggattaccagagaattcagtacatccctgtgtcgcagtcggcgtctggcctccagcagcctcagcacatacagctgcaagtggttcaagtggcctcggccacttcccctcaccagtcacagcagtccactgtggatgttggccagctccatgatcctcagccctacccccagcacgccatccaggtgcagcacatccaggtatctgggcagccgttgagtccctcagcccagcaggctcagcaggggctcagcccctcccacatccagggcagttcttccacacaggggcaggctctgcagcagcagcagcagcagcagcagaattcctctgtgcagcacacgtacctgcccagtgcttggaattccttccgtggctattcatctgagattcaaatgatgacgcttcctccgggtcagtttgtgattacagacagtggtgtggcaactccagttactactggccaggtgaaggcggttacttcgggtcattatgtgttatcagaaagtcaatcagaattggaagaaaagcaaacttctgccctctctggtggagtccaggtcgagccacctgcacacagtgactccctggacccccagaccaacagccaacagcagaccacacagtacatcatcaccaccaccaccaacgggaacggaagcagcgaagtgcatatcaccaaaccatgacttccaccctggagcttgaatccagcacccacctcatgtctgttctcataagtctgaaagctctgacacgtagagctcttttgtaagatttattattcactcaagagttcggaaaccacagttttgtctctcatccatacactggggtttattttgccaaggtcatctttatcaaattgactcttcaaaccctcggtttttgccacagaacagagatctttcaggggaaagtagatttcgaggtggagagaatttgccttgctcttgagctggtcttttaacatactgacgagccttacttttcctttgtggaaatattaagtggcatattgtgttcataccaaaggtggagacaggatgtgccaagttcatggttactggacttcttattccaagccatggcaccaaaggagaaggggcattttgtgggtgtgcattaggtctgaactgctttatcttgttttagttttcagtaatttaacaaagggagcctgctgaataacaaaattaaaatgatgaaacaaaagtttgacagtgatattctgaagcaaaaactgtcatctaaatttttcttgctgattttttttaacttccctattttagaaaactattgttgggctgttggtagtgctttccacagatgctggtcctcagtggattaggtcagaagctcatgttctgatagttcttcattatttcacaaaggtggacaacctgaaagagaaaaggctgcttgatgtcagcagaatctaaacccctacattaaagctttgcctcccattctgtggttgtggtggtggtaagaaggagatattggtaccaagaaaaatttccaaaactattgagagagagagagagaaagtattgaaattttgttctgccttgcaggatccatttatcattcattggtaaaggatatattccttgttcttaccaagtgtacatttaactcttgctgacatgttcagtgtattttattacttttaatgctgtcttaaaatgaacattctttaaagttggacaggaaggtggcatttcttatttattaacatttttaactttaaacatattgtgactcatctagaccttttaataagacggtcaacttcacacttagggaaaaaattaaaatgtgatggccacttctaataattcaggtagttataagggatctggaagaaatccagtctttatgaatatactattagttgggcattaaaaaatcagtatatattttaactttttgtgacatgctaacacattttcagaataattattgcatagtagaatttattactccagaacagaaagaccttacttcatttcaaatgaagttaattaatttacatttctgggtaaaaactggttctataaattaagtagagtagcttctttatgataaagacaattttctgaaaagtgaacaattctgttaaaagaactttattgatgtgtagatttcgcactttatttctgagactgcgttcatgtagttgttccccaatgtttgagtactaagagaacttgagaaaattacttcataaacatatggaaactgaaaatggactctctttgtgacaaagatattcaacagaaaatattgaccctgcattgcaaaacacaggttcgggttccctaagtcccacagtgtaatgattacaaatatcctagtgtccggtctagaaagactttctaggagaagactagtggaattttctaaaggttcagttttagcttttataacttaaatttggccctgttacgttctttttaatttgaaccataaggtatctcccctcccttcaggaataacttattggaaaactgaaaagaatcactgaatggaatgttcattttatggcagttgttttaagttttaaaatacacagaggaaaatattgtggaaggacctctttgttgctttcccttctaagttgtcttcttcttcttcttcttcttcttcttctttggtccttaagtgaaataaagactctaaaactaatttgtatattatcagccagagatgcggatggcagtcgagccaaatcgcatggctttcagatcaggtattctgcacattcattccaaggtcatagatttttaaaaggacctggatttgaagagatggcaaatgatgagccatcagaaaacttaatttggaaaacatgtatgtagccagtgtggatattgtggcctctctcaagacacattgacactgtagacttcattcagtccagtgtgagtattttggagtaggttggatgtagattttgtttttatcattgatttgtaccgacagaaatagacatttcatcatgtaaaattcctgttattctggaaaaacctattgttttgatcttcttgttttctgacttggaagtatcctttcaaaaaaactcttaagatatctaggtctaaaaagcacttcatgagatgctaaagctgacccactggttgaaaatgttgaccctatcctgttatttaaatgtgaacatttattgtacattcagtgagttatagtgttaatagtcttgtgctatgcagcaggtgtaaaaattaataaatatattttttaataaacatgtttgtatgtgtg

SEQ ID NO: 5874 - DNA, 3308 bp, Homo sapiens
agcccttgcgccctgtttgtgccagcaggcaccagcgaaccaaaagcaggtgtccatgtctgcttactctgtgccttcaacttttgcccaggcctcattgccagttcataaccaggtgctgccttccatcgagagtgtagatgggtccgaccctttggcaactctgcagacccctctaggcagactggaggccaaagaggaagaggatgaggatgaggacgaggacactgaggaagatgaggaagaagacggtgaggacacggatctggatgactgggagccagacccgccccggcccttcgacccacacgacttgtggtgtgaggagtgcaataacgcgcatgcttcagtgtgtccgaagcacggccccttgcacccgatccccaaccggccggtgctcacccgggccagggcgagcctccccctggtgctctacatagacaggtttctgggcggggtgttctccaagcggcgcatccccaagcgcacccagtttggccccgtggaggggcctctcgtcaggggctcggagctgaaagactgttacattcacctcaaggtttctcttgataaaggggacaggaaagaaagggatttacatgaagacctatggtttgagttgtctgatgagacgctttgtaactggatgatgtttgtacggccagcccagaatcacctggagcagaacctggtggcttaccagtatggccaccatgtgtattatacaaccataaaaaatgtggagcccaagcaggaactgaaggtgtggtatgccgcatcctatgctgagttcgtgaaccagaaaattcatgacatttctgaggaagaaaggaaagttcttcgagagcaagagaagaattggccctgctatgaatgtaaccgccgatttataagctcggagcagttgcaacagcatctcaattctcatgatgagaaactagatgtgtttagcagaacaagaggcagaggaaggggacgaggcaagaggcgattcggtccaggtcgacggccggggcgtcctccaaaatttatccgcctggaaatcaccagcgaaaatggggaaaagagtgacgatgggacacaggacttgctacattttcccacaaaggagcaatttgatgaggctgaaccagccactctgaatgggctggatcaaccagaacagaccactatcccaatccctcagctgccacaggaaacccagtcttccctggaacatgaaccagaaactcacaccctgcacctgcagccgcagcatgaagagagcgtggtgcccacccagagcacgctgacagccgacgacatgcgcagagccaagcgcatccgattggagctgcagaatgcagctcttcagcatctgtttattcggaagtccttccggccttttaaatgcttgcagtgtgggaaggccttccgggaaaaggacaaactggaccagcacttacgcttccatgggcgggaggggaactgcccactgacctgtgatctctgtaacaagggcttcatcagcagcacatccttggagagccacatgaagctccactcagaccagaagacttactcttgcattttttgcccagaatcctttgaccgccttgatttgttgaaagatcatgtggccattcatatcaatgatggctacttcacctgcccaacttgtaagaaacggttcccagattttatccaggtgaaaaaacacgtgcgcagcttccactcagaaaagatctaccagtgcacagagtgtgacaaggccttctgtcgccccgataaactgcgactccacatgctccggcattcggaccgcaaagacttcctgtgttccacctgtgggaagcaatttaagcgaaaagacaaactacgggaacacatgcagaggatgcataatcctgagagggaggccaagaaagccgaccgcatcagccgctccaagacgttcaagccccgcatcacgtccacagactacgacagcttcacgttcaagtgccgcctgtgcatgatgggcttccggcggcgcggcatgctggtaaatcacttatcgaagagacacccagacatgaagatagaagaggtgccagagttaactctacccatcataaaacccaatcgtgattacttttgtcagtattgcgataaggtttataaaagtgccagcaagcgcaaagcccacattctgaagaaccacccaggagcagagctcccaccgagcattcggaagctccgacccgctggtcctggagagccagaccccatgctgagcacacacacccagctgacgggcaccatcgccacccctcccgtctgctgtccccactgctccaagcagtacagcagcaagaccaagatggtccagcacattcgaaagaagcatccagagttcgcccagctctccaacaccatacacacaccactgacgacagctgtgatcagtgccaccccagcggttttgactacagacagcgccactggagagactgtggtgacgacggacctgctcacccaagcaatgacagaactgtcccagaccttaacgacagactaccgaacgccacaaggggattaccagagaattcagtacatccctgtgtcgcagtcggcgtctggcctccagcagcctcagcacatacagctgcaagtggttcaagtggcctcggccacttcccctcaccagtcacagcagtccactgtggatgttggccagctccatgatcctcagccctacccccagcacgccatccaggtgcagcacatccaggtcagcgagcctaccgcctcggccccgtcctccgcccaggtatctgggcagccgttgagtccctcagcccagcaggctcagcaggggctcagcccctcccacatccagggcagttcttccacacaggggcaggctctgcagcagcagcagcagcagcagcagaattcctctgtgcagcacacgtacctgcccagtgcttggaattccttccgtggctattcatctgagattcaaatgatgacgcttcctccgggtcagtttgtgattacagacagtggtgtggcaactccagttactactggccaggtgaaggcggttacttcgggtcattatgtgttatcagaaagtcaatcagaattggaagaaaagcaaacttctgccctctctggtggagtccaggtcgagccacctgcacacagtgactccctggacccccagaccaacagccaacagcagaccacacagtacatcatcaccaccaccaccaacgggaacggaagcagcgaagtgcatatcaccaaaccatgacttccaccctggagcttgaatccagcac

SEQ ID NO: 5875 - DNA, 2229 bp, Homo sapiens
gtcttgaggaccatctctcccggcagcataccgtgtggcttcacactgctctgcctctctgaacctcggtttcttcatctataaaatgggaataagagtaagccacctcaatggactgtgggaggcttaagtaaattgaagtgccatgcaagtagctagcatgcagttgcagctcaatgaatattatgatggccgcagatacgatggctacagctggggcacccatttcgggtcacaaggtagggttcaatgttgaagatggcagagccaattgcatccctgatgatcgtggagtgccgggcctgcctgagatgctcacctctcttcctttaccagagagagaaagacagaatgaccgagaacatgaaggagtgcttggcccagaccaatgcagccgtgggggatatggtgacggtggtgaagacggaggtctgctcaccactccgagaccaggagtatggccagccctgctctaggagaccggactcctcggccatggaagttgagcccaagaaactgaaggggaagcgcgacctcatcgtgcccaaaagcttccagcaagtggacttctggttctgtgagtcctgccaggagtacttcgtggatgaatgcccaaaccatggccccccggtgtttgtgtctgacacaccggtgcccgtgggcatcccagaccgggcggcgctcaccatcccacagggcatggaggtggtcaaggacactagtggagagagtgacgtgcgatgtgtaaacgaggtcatccccaagggccacatcttcggcccctatgaggggcagatctccacccaggacaaatcagctggcttcttctcctggctgattgtggacaagaacaaccgctataagtccatagatggctcagacgagaccaaagccaactggatgaggtacgtggtcatctcccgggaggagagggagcagaacctgctggcgttccagcacagtgagcgcatctacttccgggcgtgcagggacatccggcctggggagtggctgcgggtctggtacagcgaggactacatgaagcgcctgcacagcatgtcccaggaaaccattcaccgcaacctggccagaggagagaagaggttgcagagggagaagtctgagcaggttctggataacccagaagacctgaggggtcccattcatctctctgtgctgagacagggcaaaagtccctacaagcgtggctttgatgagggggatgtacacccccaagctaagaagaagaaaattgacctgattttcaaggatgttctggaggcctcactggaatctgcgaaggtggaagcccaccagttggccctgagcacctcactggtcatcaggaaagtccccaaataccaggatgacgcctacagtcagtgtgcaacaacaatgacccatggtgtgcagaatataggccagacccagggggagggggactggaaggtcccccagggggtctccaaggagccaggccaattggaggatgaagaagaggagccttcatcattcaaggccgacagtcctgccgaggcctcccttgcatctgaccctcatgaacttcccaccacctctttttgccctaactgtattcgcctaaagaagaaggttcgggagctccaggcagaattagacatgcttaagtctgggaaacttcctgagccccccgtattgccaccacaggtactggagctcccagagttctcggaccctgcaggtaagttggtttggatgagattattgtcggagggcagagtacgcagtgggctgtgtggagggtagcctaaagctctctgtggaaaccaccttccgggagacctgaggagtgtaacgtggaggcggctacctccgtgggtgggagcccaggtcctcagtgtctctggcagacccatcggcagctctgccaggtgctccatgtgttgcccttgtatcctccttgtcaataaaggaagttccgctgcagaaggggtgtgtgctgtgttcttgacccgttgcctttctctggtactggtgtcttaccccaaagcccaatttctaaacccagtctttctctgtccccagtctcaagcagggtgtcccactggagagatctcttggcttccctaacttagtccaggaacacagccttgttcttctcttcctgaatctctgtcctgccacacatggtcccagttccctagcctggagttctagaaggatggagagtgaggggatccaggccattca

SEQ ID NO: 5876 - DNA, 1536 bp, Homo sapiens
atgttgaagatggcagagccaattgcatccctgatgatcgtggagtgccgggcctgcctgagatgctcacctctcttcctttaccagagagagaaagacagaatgaccgagaacatgaaggagtgcttggcccagaccaatgcagccgtgggggatatggtgacggtggtgaagacggaggtctgctcaccactccgagaccaggagtatggccagccctgctctaggagaccggactcctcggccatggaagttgagcccaagaaactgaaggggaagcgcgacctcatcgtgcccaaaagcttccagcaagtggacttctggttctgtgagtcctgccaggagtacttcgtggatgaatgcccaaaccatggccccccggtgtttgtgtctgacacaccggtgcccgtgggcatcccagaccgggcggcgctcaccatcccacagggcatggaggtggtcaaggacactagtggagagagtgacgtgcgatgtgtaaacgaggtcatccccaagggccacatcttcggcccctatgaggggcagatctccacccaggacaaatcagctggcttcttctcctggctgattgtggacaagaacaaccgctataagtccatagatggctcagacgagaccaaagccaactggatgaggtacgtggtcatctcccgggaggagagggagcagaacctgctggcgttccagcacagtgagcgcatctacttccgggcgtgcagggacatccggcctggggagtggctgcgggtctggtacagcgaggactacatgaagcgcctgcacagcatgtcccaggaaaccattcaccgcaacctggccagaggagagaagaggttgcagagggagaagtctgagcaggttctggataacccagaagacctgaggggtcccattcatctctctgtgctgagacagggcaaaagtccctacaagcgtggctttgatgagggggatgtacacccccaagctaagaagaagaaaattgacctgattttcaaggatgttctggaggcctcactggaatctgcgaaggtggaagcccaccagttggccctgagcacctcactggtcatcaggaaagtccccaaataccaggatgacgcctacagtcagtgtgcaacaacaatgacccatggtgtgcagaatataggccagacccagggggagggggactggaaggtcccccagggggtctccaaggagccaggccaattggaggatgaagaagaggagccttcatcattcaaggccgacagtcctgccgaggcctcccttgcatctgaccctcatgaacttcccaccacctctttttgccctaactgtattcgcctaaagaagaaggttcgggagctccaggcagaattagacatgcttaagtctgggaaacttcctgagccccccgtattgccaccacaggtactggagctcccagagttctcggaccctgcaggtaagttggtttggatgagattattgtcggagggcagagtacgcagtgggctgtgtggagggtag

SEQ ID NO: 5877 - DNA, 1858 bp, Homo sapiens
agttctcgcggacgccctcggccccgcgccgggggctgctgcggggtgctcggggatgaaggtgggaggcgtcctttgggatgcgacgaagccttctccatcgcggttcgcgattgcccgcgaagcgtggccgagccggagggcatttctggaatgcgttttaagtgtcagttgcggtgtagactcttcgggaaacctctccggagcgtagcctccaccccccactcgcagtccccaaggacagaatgaccgagaacatgaaggagtgcttggcccagaccaatgcagccgtgggggatatggtgacggtggtgaagacggaggtctgctcaccactccgagaccaggagtatggccagccctgctctaggagaccggactcctcggccatggaagttgagcccaagaaactgaaggggaagcgcgacctcatcgtgcccaaaagcttccagcaagtggacttctggttctgtgagtcctgccaggagtacttcgtggatgaatgcccaaaccatggccccccggtgtttgtgtctgacacaccggtgcccgtgggcatcccagaccgggcggcgctcaccatcccacagggcatggaggtggtcaaggacactagtggagagagtgacgtgcgatgtgtaaacgaggtcatccccaagggccacatcttcggcccctatgaggggcagatctccacccaggacaaatcagctggcttcttctcctggctgattgtggacaagaacaaccgctataagtccatagatggctcagacgagaccaaagccaactggatgaggtacgtggtcatctcccgggaggagagggagcagaacctgctggcgttccagcacagtgagcgcatctacttccgggcgtgcagggacatccggcctggggagtggctgcgggtctggtacagcgaggactacatgaagcgcctgcacagcatgtcccaggaaaccattcaccgcaacctggccagaggagagaagaggttgcagagggagaagtctgagcaggttctggataacccagaagacctgaggggtcccattcatctctctgtgctgagacagggcaaaagtccctacaagcgtggctttgatgagggggatgtacacccccaagctaagaagaagaaaattgacctgattttcaaggatgttctggaggcctcactggaatctgcgaaggtggaagcccaccagttggccctgagcacctcactggtcatcaggaaagtccccaaataccaggatgacgcctacagtcagtgtgcaacaacaatgacccatggtgtgcagaatataggccagacccagggggagggggactggaaggtcccccagggggtctccaaggagccaggccaattggaggatgaagaagaggagccttcatcattcaaggccgacagtcctgccgaggcctcccttgcatctgaccctcatgaacttcccaccacctctttttgccctaactgtattcgcctaaagaagaaggttcgggagctccaggcagaattagacatgcttaagtctgggaaacttcctgagccccccgtattgccaccacaggtactggagctcccagagttctcggaccctgcaggtaagttggtttggatgagattattgtcggagggcagagtacgcagtgggctgtgtggagggtagcctaaagctctctgtggaaaccaccttccgggagacctgaggagtgtaacgtggaggcggctacctccgtgggtgggagcccaggtcctcagtgtctctggcagacccatcggcagctctgccaggtgctccatgtgttgcccttgtatcctccttgtcaataaaggaagttccgctgc

SEQ ID NO: 5878 - DNA, 2160 bp, Homo sapiens
acccacagcactcattcctgaagctactggttggttccctgagaggtcccagaactctgcgaagtgagtccagcgctgagattttccttgcagatctatcaggatgagcatccaggccccacccagactactggagctggcagggcagagcctgctgagagaccaggccttgtccatctctgccatggaggagctgcccagggtgctctatctcccactcttcatggaggccttcagcaggagacacttccagactctgacggtgatggttcaggcctggcccttcacctgcctccctctgggatcactgatgaagacgcttcatttggagaccttaaaagcattgctggaagggcttcatatgctgcttacacagaaggatcgccccaggaggtggaaacttcaagtgctggatttgcgggatgttgacgagaatttctgggccagatggcctggagcctgggccctgtcctgcttcccagagaccacgagtaagaggcagacagcagaggactgtccaaggatgggagagcaccagcccttaaaggtgttcatagacatctgcctcaaggaaataccccaggatgaatgcctgagatacctcttccagtgggtttaccaaaggagaggtttagtacacctgtgctgtagtaagctggtcaattatctaacgccgattaaatatctcagaaagtcattgaaaataatatacctgaatagtattcaagagctggaaattcgcaacatgtcctggccacgtctgataagaaagcttcgttgttacctgaaggagatgaagaatcttcgcaaactcgttttctccaggtgccatcattacacgtcagataatgaactccaaggacggttagttgccaaattcagctctgtgttcctcaggctggaacaccttcagttgcttaaaataaaattgatcaccttcttcagtgggcacctggaacagctgatcaggtgcctccagaaccccttggagaacttggaattaacttatggctacctattggaagaagacatgaagtgtctctcccagtacccaagcctcggttacctaaagcatctgaatctcagctacgtgctgctgttccgcatcagtcttgaacccctcggagctctgctggagaaaattgctgcctctctcaaaaccctcatcttggagggctgtcagatccactactcccaactcagtgccatcctgcctgccctgagccggtgctcccagctcaccaccttctactttggcagaaattgcatgtctattgacgccctgaaggacctgctgcgccacaccagtgggctgagcaagttaagcctggagacgtatcctgcccctgaggagagtttgaattccttggttcgtgtcaattgggagatcttcaccccacttcgggctgagctgatgtgtacactgagggaagtcaggcagcccaagaggatcttcattggccccaccccctgcccttcctgtggctcatcaccgtctgaggaactggagctccatctttgctgctagggaaggcgtgcccagtggggtagagaaatccaaagttctcttccaggcacttggacactaaaatctactatgtgggtgcaaactatttttctcttttcttatttatttcattttttaataattccaaaatttttattaaagacaatttgagacagggtttcgctgtgttgctccagctggtctcaaactgctgggcttatgggatcctcctgcctcagcttcctaaagtgctgggattactggcatgagtgactgtgtccaggccacatgcaacttaaaggaagcacaggcaagtgttcagtgtgagggaaaaaacataacagcagggggcaaggttggaggaaaatgttgaggtgacatcagtgagaacttcagggacccgtgtcctagagtcggaaagagaagctaaagttctacagtgatgagactgttatccctgcaaggatggttaccaaggaatatcagcaataaagagcacctgaatgaaaacttttaacctgttgtgcaatttatccatcagaaatctctagttatcgagttacggatggaaaaataacgaaatactaatttgtctgtgattgagtttcagttgtagaacatcaaagcaaccaaataaaaattagatcattttg

SEQ ID NO: 5879 - DNA, 1327 bp, Homo sapiens
ggggtcacctggggtagaagctagagagggacatcatgtacaagctagttagtgggggtttcagctctattgggggtgcacgtgtgaatttcctgttacaaagtgtgtttcaagttgatatgatgtcaaagagataatagaggagggtatgaaaggagggaaagcgcatcaaacctgtccatttcacaatagaacgtctgtcctcaccggcttagtgatcacgaatgatcctgtctctgattccctgtttgtaaaaggttgttttgaactccaggaaaggtgcctccagaaccccttggagaacttggaattaacttatggctacctattggaagaagacatgaagtgtctctcccagtacccaagcctcggttacctaaagcatctgaatctcagctacgtgctgctgttccgcatcagtcttgaacccctcggagctctgctggagaaaattgctgcctctctcaaaaccctcatcttggagggctgtcagatccactactcccaactcagtgccatcctgcctgccctgagccggtgctcccagctcaccaccttctactttggcagaaattgcatgtctattgacgccctgaaggacctgctgcgccacaccagtgggctgagcaagttaagcctggagacgtatcctgcccctgaggagagtttgaattccttggttcgtgtcaattgggagatcttcaccccacttcgggctgagctgatgtgtacactgagggaagtcaggcagcccaagaggatcttcattggccccaccccctgcccttcctgtggctcatcaccgtctgaggaactggagctccatctttgctgctagggaaggcgtgcccagtggggtagagaaatccaaagttctcttccaggcacttggacactaaaatctactatgtgggtgcaaactatttttctcttttcttatttatttcattttttaataattccaaaatttttattaaagacaatttgagacagggtttcgctgtgttgctccagctggtctcaaactgctgggcttatgggatcctcctgcctcagcttcctaaagtgctgggattactggcatgagtgactgtgtccaggccacatgcaacttaaaggaagcacaggcaagtgttcagtgtgagggaaaaaacataacagcagggggcaaggttggaggaaaatgttgaggtgacatcagtgagaacttcagggacccgtgtcctagagtcggaaagagaagctaaagttctacagtgatgagactgttatccctgcaaggatggttaccaaggaatatcagcaataaagagcacctgaatgaaaa

SEQ ID NO: 5880 - DNA, 1525 bp, Homo sapiens
ttcctgcttagttcttcctgaggtctgagcaccctccaaactgagtccagatctgagtttttcctcggagatttgtcagaatgagcctccaggccccatccagactgctggagctggcagggcagagcctgctgaggaaccagttcttgaccatcttcaccctggatgagctgcccagggaggtcttccctctgatgttcatggaggccttcagcatgagacgttttgaggccctgaagctgatggtgcaggcctggcccttcctcagcctccctctgggatccctgatgaagacacttcatctggagaccttgcaagctgtcctgaggggacttgatacactggtggcccagaaggttcgccccaggaggtggaaacttcaagtgctggatttgcgggatgttgatgagaatttctggaccatatggtctggagccagggtcctctcctgctccccagaggccatgagtaagaggcagacagtggaggactgtccaaggatgggagagcaccagcccttgaaggtgttcatagacctctgcctaaaggaaagtacactggatgaatgcctgagctacctttttgggtggatccactacagaagaggcctagtgcacctgtgttgtagtaaggtgcagaattactcaatgcccacttcaagtttcagaaatctattggaaaggatatacccagacagtatccaggagttggaagtctggaaaaagtgctctctcaataaaacgggaaagtttgccccttacctgagccagatgagcaatcttcgtgaactctttttagccttcggttatgagcgtgagttgtacgtgagcgtccagtggccgtgcattcctgacttggactctccattcctctgcctgtactacccccagatgctttatataaaaaagatcagtaatatcaaagagcacctggagcacctgctcaggtacctcaagaaccccttgggggcctttatattcagtgatgcttacctaactgatcgggacatggagtgtctgtctcagtacccaagcctcagtcagctaaaggagctgcgtctgattcatatcctaatgtggaccacccatcttgagccccttggagttctgctggagaaagttgctgctactctcaagaccctcgtcttaaaggactgtcggatccaggacccccaactcagggtcctcctgcctgccctgagccactgttcccagctcaccaccttcaactttcatggaaatgagacctccatgaatgctctgaaagacctgctgcgtcacacaggcgggctgagcaagttaggcctggagttgtatcctgcccctctggagagtcttgactacaagggtcatgtcaattgggagatcctcaccccaattcgggctgagctgatgcgtacactcagggaagtcaggcagcccaagaggatcttctttggtcccgtcccttgccctaactgtggctcatggccatctgagaaagtggacttccatctttgctcctagggaaggcctggttcgtggga

SEQ ID NO: 5881 - DNA, 1765 bp, Homo sapiens
atgaagatgagcatccggattccacccagactcctggagcttgggcggagcctgctgagggaccaagccttggccgtctccaccctggaggagctgcccacggaacttttccccccactgttcatggaggccttcagcaggagacgctgtgaggccctgaagctgatggtgcaggcctggcccttccgccgcctccctctgaggcctctgataaagatgccttgtctggaggccttccaagctgtgctcgatgggcttgatgcactgcttacccaaggggttcgtcccaggagatggaaacttcaagtgctggatttacaggatgtctgtgagaacttctggatggtttggtctgaagctatggcccatgggtgcttcctcaatgccaagaggaacaaaacaccagtgcaggactgtccaaggatgagagaacggcagcccttgactgtgtttgtagaactttggctcaagaacaggactctggatgaatacctcacctgcctccttctatgggtcaagcagaggagagatttactacacctgtgctgtaagaagctgaaaattttgggaatgcccttccgcaatatcagaagcatcctgaaaatggtgaacctagactgtatccaggaggtggaagtgaattgcaagtggatactgcccatcctgacacagtttaccccatacctgggccacttgaggaatcttcagaagctcgttctctcccacatggatgtctctcgctacgtttccccagagcagaagaaggagattgttacccagttcaccactcagttcctcaagctgcgctgcctccaaaagctttatatgaactctgtttctttcctcgaaggccacctggaccagctgctcagctgtctgaagacctcgttaaaggtcctcacaataactaactgtgtgcttttggaatcagacttgaagcatctctcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctgcatggccaccctggagaacctgctgagccacacaatcatactcaaaaacttatgcctggagctgtatcctgccccgcaggaaagttatggtgctgatggtactctctgctggagcagatttgctcaaattagggctgagctgatgaagaaagtgaggcacttaaggcaccccaagaggatcttgttctgtactgacaactgccctgaccatggcgacaggtcattttatgacctggaggcagatcaatactgctgttgaatgcctgcctatttggatgggtatgtcaaacgctttcttctggacacttggaaactaaaacctaggtcttaggtacatcctaaagggagcacagaacccatcgtttcacacatgggctctgaaagtgggaaaggaaagctgatcaagcaggggcaggacttgggggaaatgttgccatggattcgatgggactttgggaacctgtatcctgtagagtcgaaaatgggaatctgaatgtctagagtggaattcaggcttgagaatacatgagggagttactcttgcatggatggttgtaaagaaacaatcagaaataaaggaaaactgagca

SEQ ID NO: 5882 - DNA, 1502 bp, Homo sapiens
ttcctgcttggttcttcctgaggtctgagcaccttctagactacatccagatctgttttccctgcagattcatgaagatgagcatccggattccacccagactcctggagcttgcgggcggagcctgctgagggaccaagccttggccgtctccaccctggaggagctgcccacggaacttttccccccactgttcatggaggccttcagcaggagacgctgtgaggccctgaagctgatggtgcaggcctggcccttccgccgcctccctctgaggcctctgataaagatgccttgtctggaggccttccaagctgtgctcgatgggcttgatgcactgcttacccaaggggttcgtcccaggagatggaaacttcaagtgctggatttacaggatgtctgtgagaacttctggatggtttggtctgaagctatggcccatgggtgcttcctcaatgccaagaggaacaaaacaccagtgcaggactgtccaaggatgagagaacggcagcccttgactgtgtttgtagaactttggctcaagaacaggactctggatgaatacctcacctgcctccttctatgggtcaagcagaggagagatttactacacctgtgctgtaagaagctgaaaattttgggaatgcccttccgcaatatcagaagcatcctgaaaatggtgaacctagactgtatccaggaggtggaagtgaattgcaagtggatactgcccatcctgacacagtttaccccatacctgggccacttgaggaatcttcagaagctcgttctctcccacatggatgtctctcgctacgtttccccagagcagaagaaggagattgttacccagttcaccactcagttcctcaagctgcgctgcctccaaaagctttatatgaactctgtttctttcctcgaaggccacctggaccagctgctcagctgtctgaagacctcgttaaaggtcctcacaataactaactgtgtgcttttggaatcagacttgaagcatctctcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctgcatggccaccctggagaacctgctgagccacacaatcatactcaaaaacttatgcctggagctgtatcctgccccgcaggaaagttatggtgctgatggtactctctgctggagcagatttgctcaaattagggctgagctgatgaagaaagtgaggcacttaaggcaccccaagaggatcttgttctgtactgacaactgccctgaccatggcgacaggtcattttatgacctggaggcagatcaatactgct

SEQ ID NO: 5883 - DNA, 1839 bp, Homo sapiens
ttcctgcttggttcttcctgaggtctgagcaccttctagactacatccagatctgttttccctgcagattcatgaagatgagcatccggattccacccagactcctggagcttgcgggcggagcctgctgagggaccaagccttggccgtctccaccctggaggagctgcccacggaacttttccccccactgttcatggaggccttcagcaggagacgctgtgaggccctgaagctgatggtgcaggcctggcccttccgccgcctccctctgaggcctctgataaagatgccttgtctggaggccttccaagctgtgctcgatgggcttgatgcactgcttacccaaggggttcgtcccaggagatggaaacttcaagtgctggatttacaggatgtctgtgagaacttctggatggtttggtctgaagctatggcccatgggtgcttcctcaatgccaagaggaacaaaacaccagtgcaggactgtccaaggatgagagaacggcagcccttgactgtgtttgtagaactttggctcaagaacaggactctggatgaatacctcacctgcctccttctatgggtcaagcagaggagagatttactacacctgtgctgtaagaagctgaaaattttgggaatgcccttccgcaatatcagaagcatcctgaaaatggtgaacctagactgtatccaggaggtggaagtgaattgcaagtggatactgcccatcctgacacagtttaccccatacctgggccacttgaggaatcttcagaagctcgttctctcccacatggatgtctctcgctacgtttccccagagcagaagaaggagattgttacccagttcaccactcagttcctcaagctgcgctgcctccaaaagctttatatgaactctgtttctttcctcgaaggccacctggaccagctgctcagctgtctgaagacctcgttaaaggtcctcacaataactaactgtgtgcttttggaatcagacttgaagcatctctcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctgcatggccaccctggagaacctgctgagccacacaatcatactcaaaaacttatgcctggagctgtatcctgccccgcaggaaagttatggtgctgatggtactctctgctggagcagatttgctcaaattagggctgagctgatgaagaaagtgaggcacttaaggcaccccaagaggatcttgttctgtactgacaactgccctgaccatggcgacaggtcattttatgacctggaggcagatcaatactgctgttgaatgcctgcctatttggatgggtatgtcaaacgctttcttctggacacttggaaactaaaacctaggtcttaggtacatcctaaagggagcacagaacccatcgtttcacacatgggctctgaaagtgggaaaggaaagctgatcaagcaggggcaggacttgggggaaatgttgccatggattcgatgggactttgggaacctgtatcctgtagagtcgaaaatgggaatctgaatgtctagagtggaattcaggcttgagaatacatgagggagttactcttgcatggatggttgtaaagaaacaatcagaaataaaggaaaactgagcag

SEQ ID NO: 5884 - DNA, 1786 bp, Homo sapiens
gatgtttttttctctagattcatcaggatgagcctccaggccccacctagactcctggagctggctgagcagagtctgctgagagaccgggccttggccatccccaccctggaggagctgcccagggagctctttcccccactgttcatggaggcctttaccaggagatgctgcgagaccctgacaactatggtgcaggcctggcccttcacctgccttcctctagggtccctgatgaagtcatgtaatctagagatctttcgagctgtgctggaggggcttgatgcactgcttgcccagaaggttcgccccaggcggtggaaacttcaagtgttggacttgcggaatgtggatgagaacttctggggcatatggtctggagcttctgcactctccccagaggccctgagtaagagacgaacagcagggaactgtccaaggccgggtgggcagcagcccttgatggtgatcctagacctttgcttcaagaatgggatgctggatgaatgcctcacccacttcttagagtggggcaagcagagaaaaggcttactgcacgtgtgttgcaaggagctgcagatttttggaatagccatccacaggatcatagaggtcctgaacacggtggagctagactgtatccaggaggtggaagtgtgctgcccgtgggagctgtccattcttataaggttcgccccttacctgggccagatgaggaatctccgcaaacttgttctcttcaacatccatgtctctgcctgcattcccctagacaggaaggagcagtttgtcatccagttcacctctcagttcctcaagctggactacttccagaagctttacatgcactctgtctctttcctcgaaggccacctggaccagctgctcaggtgtctccaggcccccttggagacagtcgtaatgaccgaatgcctgctgtcagagtcggacctgaagcatctctcttggtgcccgagcatccgtcagctaaaagagctagacctgaggggcatcacactgacccatttcagtcctgagcccctctcagttctgctggagcaagctgaggccaccctgcagaccctggacttagaggactgtgggatcgtggattcccaactcagcgccatcctgcctgccctgagccgctgctcccagctcagcaccttcagcttctgtgggaacctcatctccatggccgccctggagaacctgctgcgccacaccgtcgggctgagcaagctaagcctggagctgtatcctgcccctctggagagttatgatgcccagggtgctctctgctggggaagattttctcaacttggggctgagctgatgaagacactgagggacttaaggcagcccaagattattgtgttcagcactgtcccctgccctcgctgtggcatcagggcctcctatgacctggagcccagtcactgtctgttgaatgcctgctgtcagggtggatttatttaaagctttcttctggtcatttggcaactgaatcctaggccatgagtgtatgtcaaagggagcacagacccatcgtttcatatgcctgctcaatgtgaacgggaaaggaaaggggatgcaggaagggagggactgggggaaaagttgagttggagtcaataggagctttagagacctgtgtcccagagaatcagaaatgggaatctgaattgctagaatgagaatcaggtaggagagacacatgagacagttacccctgcacggatggttgtaaagaaacagtcagaaataaagggaagctgagtggaaa

SEQ ID NO: 5885 - DNA, 2164 bp, Homo sapiens
acccacagcactcattcctggagctactgcttggttccctgagaggtcccagaactctgcaaagtgagtccagcgctgagatttttcttgcagatctatcaggatgagcatccaggccccacccagactcctggagctggcagggcagagcctgctgagagaccaggccttgtccatctctgccatggaggagctgcccagggtgctctatctcccactcttcatggaggccttccgcaggagacacttccagactctgacggtgatggtgcaggcctggcccttcacctgcctccctctgggatcactgatgaagacgcttcatttggagaccttaaaagcattgctggaagggcttcatatgctgcttacacagaaggatcgccccaggaggtggaaacttcaagtgctggatttgcgggatgttgatgagaatttctgggccagatggcctggagcctgggccctgtcctgcttcccagagaccatgagtaagaggcagacagcagaggactgtccaaggatgggagagcaccagcccttaaaggtgttcatagacatctgcctcaaggaaataccccaggatgaatgcctgagatacctctttcagtgggtttaccaaaggagaggtttagtacacctgtgctgtagtaagctggtcaattatctaacgccgattaaacatctcagaaagtcattgaaaataatatacctgaatagtattcaacagctggaaattcgcaacatgtcctggccacgtctgataagaaagcttcgttgttacctgaaggagatgaagaatcttcgcaaactcgttttctccaggtgccatcattccatgtcagataatgaactcgaaggacggttagtcaccaaattcagctctgtgttcctcaggctggaacacctccagttgcttaaaataaaattgatcaccttcttcagtgggcacctggaacagctgatcaggtgcctccagaaccccttggagaacttggaattaacttatggctacctattggaagaagacatgaagtgtctctcccagtacccaagcctcggttacctaaagcatctgaatctcagctacgtgctgctgttccgcatcagtcttgaacccctcggagctctgctagagaaaattgctgcctctctcgaaaccctcatcttggagggctgtcagatccactactcccaactcagtgccatcctgcctggcctgagccactgctcccagctcaccaccttctactttggcagaaattgtatgtctatgggtgccctgaaggacctgttgcgccacaccagtgggctgagcaagttaagcctggagacgtatcctgcccctgaggagagtttgaattccttggttcgtgtcgattgggagatcttcgccctacttcgggctgagctgatgtgtacactgagggaagtcaggcagcccaagaggatcttcattggtcccaccccctgcccttcctgtggctcatcaccgtctgaggaactggagctccatctttgctgctagggaaggcgtgcctagcggggtagagaaatccaaagttctcttccaggcactgggacactaaaatctactatgtaggtgcaaactatttttctcttttcttatttatttcattttttaataattccaaaatttttattaaagacaatttgagacagggtttctctgtgttgctctgggatcctcctgcctcagctgggcttatgggatcctcctgcctcagcttcctaaagtgctgggattactggcatgagtgactgtgtccaggccacatgcaacttaaaggaagcacagggaagtgctcagtgtgagggaaaaaaacataacagcagggggcaaggctggaggaaaatgttgaggtgacatcaatgagaacttcagggacccgtgtcctacagagtcggaaagagaagctaaagttctacagtgatgagaatgttatccctgcaaggatggttaccaaggaatatcagaaataaagagcacctgaatgaaaacttttaacctgttgtagcaatttatccaccagaaatatctagttattgagttactgatggaaaaataatgaaatactactttgtctgtgattgagtttcagctgtagaacatcaaagcaaccaaatagaatttgatcatttt

SEQ ID NO: 5886 - DNA, 2164 bp, Homo sapiens
acccacagcactcattcctggagctactgcttggttccctgagaggtcccagaactctgcaaagtgagtccagcgctgagatttttcttgcagatctatcaggatgagcatccaggccccacccagactcctggagctggcagggcagagcctgctgagagaccaggccttgtccatctctgccatggaggagctgcccagggtgctctatctcccactcttcatggaggccttccgcaggagacacttccagactctgacggtgatggtgcaggcctggcccttcacctgcctccctctgggatcactgatgaagacgcttcatttggagaccttaaaagcattgctggaagggcttcatatgctgcttacacagaaggatcgccccaggaggtggaaacttcaagtgctggatttgcgggatgttgatgagaatttctgggccagatggcctggagcctgggccctgtcctgcttcccagagaccatgagtaagaggcagacagcagaggactgtccaaggatgggagagcaccagcccttaaaggtgttcatagacatctgcctcaaggaaataccccaggatgaatgcctgagatacctctttcagtgggtttaccaaaggagaggtttagtacacctgtgctgtagtaagctggtcaattatctaacgccgattaaacatctcagaaagtcattgaaaataatatacctgaatagtattcaacagctggaaattcgcaacatgtcctggccacgtctgataagaaagcttcgttgttacctgaaggagatgaagaatcttcgcaaactcgttttctccaggtgccatcattccatgtcagataatgaactcgaaggacggttagtcaccaaattcagctctgtgttcctcaggctggaacacctccagttgcttaaaataaaattgatcaccttcttcagtgggcacctggaacagctgatcaggtgcctccagaaccccttggagaacttggaattaacttatggctacctattggaagaagacatgaagtgtctctcccagtacccaagcctcggttacctaaagcatctgaatctcagctacgtgctgctgttccgcatcagtcttgaacccctcggagctctgctagagaaaattgctgcctctctcgaaaccctcatcttggagggctgtcagatccactactcccaactcagtgccatcctgcctggcctgagccactgctcccagctcaccaccttctactttggcagaaattgtatgtctatgggtgccctgaaggacctgttgtgccacaccagtgggctgagcaagttaagcctggagacgtatcctgcccctgaggagagtttgaattccttggttcgtgtcgattgggagatcttcgccctacttcgggctgagctgatgtgtacactgagggaagtcaggcagcccaagaggatcttcattggtcccaccccctgcccttcctgtggctcatcaccgtctgaggaactggagctccatctttgctgctagggaaggcgtgcctagcggggtagagaaatccaaagttctcttccaggcactgggacactaaaatctactatgtaggtgcaaactatttttctcttttcttatttatttcattttttaataattccaaaatttttattaaagacaatttgagacagggtttctctgtgttgctctgggatcctcctgcctcagctgggcttatgggatcctcctgcctcagcttcctaaagtgctgggattactggcatgagtgactgtgtccaggccacatgcaacttaaaggaagcacagggaagtgctcagtgtgagggaaaaaaacataacagcagggggcaaggctggaggaaaatgttgagatgacatcaatgagaacttcagggacccgtgtcctacagagtcggaaagagaagctaaagttctacagtgatgagaatgttatccctgcaaggatggttaccaaggaatatcagaaataaagagcacctgaatgaaaacttttaacctgttgtagcaatttatccaccagaaatatctagttattgagttactgatggaaaaataatgaaatactactttgtctgtgattgagtttcagctgtagaacatcaaagcaaccaaatagaatttgatcatttt

SEQ ID NO: 5887 - DNA, 2100 bp, Homo sapiens
acccacagcactcattcctggagctactgcttggttccctgagaggtcccagaactctgcaaagtgagtccagcgctgacattcttcctggtaccagtagaagcagatgattgtgtttgccatgagagtgatacattttccctggatttgtcttctagagatttttcttgcagatctatcaggatgagcatccaggccccacccagactcctggagctggcagggcagagcctgctgagagaccaggccttgtccatctctgccatggaggagctgcccagggtgctctatctcccactcttcatggaggccttccgcaggagacacttccagactctgacggtgatggtgcaggcctggcccttcacctgcctccctctgggatcactgatgaagacgcttcatttggagaccttaaaagcattgctggaagggcttcatatgctgcttacacagaaggatcgccccaggaggtggaaacttcaagtgctggatttgcgggatgttgatgagaatttctgggccagatggcctggagcctgggccctgtcctgcttcccagagaccatgagtaagaggcagacagcagaggactgtccaaggatgggagagcaccagcccttaaaggtgttcatagacatctgcctcaaggaaataccccaggatgaatgcctgagatacctctttcagtgggtttaccaaaggagaggtttagtacacctgtgctgtagtaagctggtcaattatctaacgccgattaaacatctcagaaagtcattgaaaataatatacctgaatagtattcaacagctggaaattcgcaacatgtcctggccacgtctgataagaaagcttcgttgttacctgaaggagatgaagaatcttcgcaaactcgttttctccaggtgcctccagaaccccttggagaacttggaattaacttatggctacctattggaagaagacatgaagtgtctctcccagtacccaagcctcggttacctaaagcatctgaatctcagctacgtgctgctgttccgcatcagtcttgaacccctcggagctctgctagagaaaattgctgcctctctcgaaaccctcatcttggagggctgtcagatccactactcccaactcagtgccatcctgcctggcctgagccactgctcccagctcaccaccttctactttggcagaaattgtatgtctatgggtgccctgaaggacctgttgtgccacaccagtgggctgagcaagttaagcctggagacgtatcctgcccctgaggagagtttgaattccttggttcgtgtcgattgggagatcttcgccctacttcgggctgagctgatgtgtacactgagggaagtcaggcagcccaagaggatcttcattggtcccaccccctgcccttcctgtggctcatcaccgtctgaggaactggagctccatctttgctgctagggaaggcgtgcctagcggggtagagaaatccaaagttctcttccaggcactgggacactaaaatctactatgtaggtgcaaactatttttctcttttcttatttatttcattttttaataattccaaaatttttattaaagacaatttgagacagggtttctctgtgttgctctgggatcctcctgcctcagctgggcttatgggatcctcctgcctcagcttcctaaagtgctgggattactggcatgagtgactgtgtccaggccacatgcaacttaaaggaagcacagggaagtgctcagtgtgagggaaaaaaacataacagcagggggcaaggctggaggaaaatgttgagatgacatcaatgagaacttcagggacccgtgtcctacagagtcggaaagagaagctaaagttctacagtgatgagaatgttatccctgcaaggatggttaccaaggaatatcagaaataaagagcacctgaatgaaaacttttaacctgttgtagcaatttatccaccagaaatatctagttattgagttactgatggaaaaataatgaaatactactttgtctgtgattgagtttcagctgtagaacatcaaagcaaccaaatagaatttgatcatttt

SEQ ID NO: 5888 - DNA, 1863 bp, Homo sapiens
acccaaagtcttcaagcctggagttcctgcttggttcttcctgaggtctgagcaccttctagactacatccagatctgttttccctgcagattcatgaagatgagcatccggactccacccagactcctggagcttgcagggcggagcctgctgagggaccaagctttggccatgtccaccctggaggagctgcccacagaacttttccccccactgttcatggaggccttcagcaggagacgctgtgaggccctgaagctgatggtgcaggcctggcccttccgccgcctccctctgaggcctctgataaagatgccttgtctggaggccttccaagctgtgctcgatgggcttgatgcactgcttacccaaggggttcgtcccaggaggtggaaactccaagtgctggatttacaggatgtctgtgagaacttctggatggtttggtctgaagctatggcccatgggtgcttcctcaatgccaagaggaacaaaaaaccagtgcaggactgtccaaggatgagaggacggcagcccttgactgtgttcgtagaactttggctcaagaacaggactctggatgaatacctcacctacctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgcgctgcctccaaaagctttatatgaactctgtttctttcctcgaaggccacctggaccagctgctcagctgtctgaagacctcgttaaaagtcctcacaataactaactgtgtgcttttggaatcagacttgaagcatctatcccagtgcccgagtatcagtcaactaaagaccctggacctgagtggcatcagactgaccaattatagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctgcatggccaccctggagaacctgctgagccacacaatcatactcaaaaacttatgtgtggagctgtatcctgccccccgagagagttatggtgctgatggtactctctgctggagcagatttgctcaaattagggctgagctgatgaacagagtgagggacttaaggcaccccaagaggatcttgttctgtactgactactgccctgactgtggcaacaggtcattttatgacctggaggcagatcaatactgctgttgaatgcctgcctatttggatgggtatgtcaaacgctttcttctggacacttggaaactaaaacctaggtcttaggtacatcctaaagggagcacagaacccatcatttcacacataggctctgaaagtgggaaaggaaagctgatcaagcaggggccggacttgggggaaatgttgccatggattcgatgggactttggggacctgtgtcctgtagattcgaaaatgggaatctgaatgtctagagtggaattcaggcttgagaatacatgagggagttactcttgcatggatggttgtaaagaaacaatcagaaataaaggaaaactgagcag

SEQ ID NO: 5889 - DNA, 1847 bp, Homo sapiens
acccaaagtcttcaagcctggagttcctgcttggttcttcctgaggtctgagcaccttctagactacatccagatctgatgaagatgagcatccggactccacccagactcctggagcttgcagggcggagcctgctgagggaccaagctttggccatgtccaccctggaggagctgcccacagaacttttccccccactgttcatggaggccttcagcaggagacgctgtgaggccctgaagctgatggtgcaggcctggcccttccgccgcctccctctgaggcctctgataaagatgccttgtctggaggccttccaagctgtgctcgatgggcttgatgcactgcttacccaaggggttcgtcccaggaggtggaaactccaagtgctggatttacaggatgtctgtgagaacttctggatggtttggtctgaagctatggcccatgggtgcttcctcaatgccaagaggaacaaaaaaccagtgcaggactgtccaaggatgagaggacggcagcccttgactgtgttcgtagaactttggctcaagaacaggactctggatgaatacctcacctacctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgcgctgcctccaaaagctttatatgaactctgtttctttcctcgaaggccacctggaccagctgctcagctgtctgaagacctcgttaaaagtcctcacaataactaactgtgtgcttttggaatcagacttgaagcatctatcccagtgcccgagtatcagtcaactaaagaccctggacctgagtggcatcagactgaccaattatagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctgcatggccaccctggagaacctgctgagccacacaatcatactcaaaaacttatgtgtggagctgtatcctgccccccgagagagttatggtgctgatggtactctctgctggagcagatttgctcaaattagggctgagctgatgaacagagtgagggacttaaggcaccccaagaggatcttgttctgtactgactactgccctgactgtggcaacaggtcattttatgacctggaggcagatcaatactgctgttgaatgcctgcctatttggatgggtatgtcaaacgctttcttctggacacttggaaactaaaacctaggtcttaggtacatcctaaagggagcacagaacccatcatttcacacataggctctgaaagtgggaaaggaaagctgatcaagcaggggccggacttgggggaaatgttgccatggattcgatgggactttggggacctgtgtcctgtagattcgaaaatgggaatctgaatgtctagagtggaattcaggcttgagaatacatgagggagttactcttgcatggatggttgtaaagaaacaatcagaaataaaggaaaactgagcag

SEQ ID NO: 5890 - DNA, 1587 bp, Homo sapiens
tctagagtttttcactggagatttgtcagaatgagcctccagtccccatccagactcctggagctggcaggccagagcctgctgaggaaccagttcttgaccatcttcatcctggacgagctgcccagggaggtcttccctctgatgttcatggaggcctccagcatgagacattttgaggccctgaagctgatggtgcaggcctggcccttcctccgcctccctctgggatccctgatgaagacacctcatctggagaccttgcaagctgtgctgaagggacttgatacactgctggcccagaagcttcgccccaggaggtggaaacttcaagtgctggatttgcgggatgttgatgggaatttctggactatatggtctggagccagggccctctcctgctccccagaggccatgagaaagaggcagacagtggaggactatccaaggacgggagagcaccagcccttgaaggtgttcatagacctctgccaaaaggaaagtacactggatgaatgcctgagctacctctgcaggtggatccactacagaagaggtctagtgcacctgtgttgtaataaggtgcagaattactcaatgcccacttcaagtttcagaaatttattgaaaagggtatacccagacagtatccaggagttggaaattaagagaaagtgctctctgaataaaacaggaaagtttgccccttacttgagccagatgagcaatcttcgcaaactctttttagccttcggttatgacgatgagttatatgtaagcggccaacagcagttcgttcctgacttggactgtccattcctctgcctgtactaccctcagatgctttatataagaaagatcagtaatatcaaagagcacctggagcacctgctcaggtgcctcaagaaccccttgggaacctttatattctgtcatgcttacctagctgatcaggacatggagtgtctgtctcagtacccaagcctcagtcagctaaaggagctgcatctgattcatatcctaatgtggactaccaatcttgagccccttggagctctgctagagaaagttgctgctactctcgagatcctcacgttaaaggactgtcagatccaggactcccagctcagggtcctcctgcctgccctgagccgctgctcccagctcaccaccttctactttcgcggaaatgagacctccacgaatgctctgaaagacctgctgtgtcacacaggtgggctgagcaagttaggtctggagttgtatcctgcccctctggagtgtcttgacaacaggggtcatgtcaattgggagatcctcgccccaattcgggctgagctgatgtgtacactcagggaagtcaggcagcccaagaggatcttttttggtcccatcccctgcccttcctgtggctcatggccatctgagaaagtggacttccatctttgctcttagtgaaggcctgattagtgggatggatatgctttcttcaggacccttaggcactaaaatctaggacacaggtgggtttttttgtttttttgtttttttgttttgatggagtctcgctctgtccctcaggctaaa

SEQ ID NO: 5891 - DNA, 1557 bp, Homo sapiens
tctagagtttttcactggagatttgtcagaatgagcctccagtccccatccagactcctggagctggcaggccagagcctgctgaggaaccagttcttgaccatcttcatcctggacgagctgcccagggaggtcttccctctgatgttcatggaggcctccagcatgagacattttgaggccctgaagctgatggtgcaggcctggcccttcctccgcctccctctgggatccctgatgaagacacctcatctggagaccttgcaagctgtgctgaagggacttgatacactgctggcccagaagcttcgccccaggaggtggaaacttcaagtgctggatttgcgggatgttgatgggaatttctggactatatggtctggagccagggccctctcctgctccccagaggccatgagtaagaggcagacagtggaggactatccaaggacgggagagcaccagcccttgaaggtgttcatagacctctgccaaaaggaaagtacactggatgaatgcctgagctacctctgcaggtggatccactacagaagaggtctagtgcacctgtgttgtaataaggtgcagaattactcaatgcccacttcaagtttcagaaatttattgaaaagggtatacccagacagtatccaggagttggaaattaagagaaagtgctctctgaataaaacaggaaagtttgccccttacttgagccagatgagcaatcttcgcaaactctttttagccttcggttatgacgatgagttatatgtaagcggccaacagcagttcgttcctgacttggactgtccattcctctgcctgtactaccctcagatgctttatataagaaagatcagtaatatcaaagagcacctggagcacctgctcaggtgcctcaagaaccccttgggaacctttatattctgtcatgcttacctagctgatcaggacatggagtgtctgtctcagtacccaagcctcagtcagctaaaggagctgcatctgattcatatcctaatgtggaccaccaatcttgagccccttggagctctgctagagaaagttgctgctactctcgagatcctcacgttaaaggactgtcagatccaggactcccagctcagggtcctcctgcctgccctgagccgctgctcccagctcaccaccttctactttcgcggaaatgagacctccacgaatgctctgaaagacctgctgtgtcacacaggtgggctgagcaagttaggtctggagttgtatcctgcccctctggagtgtcttgacaacaggggtcatgtcaattgggagatcctcgccccaattcgggctgagctgatgtgtacactcagggaagtcaggcagcccaagaggatcttttttggtcccatcccctgcccttcctgtggctcatggccatctgagaaagtggacttccatctttgctcttagtgaaggcctgattagtgggatggatatgctttcttcaggacccttaggcactaaaatctaggacacaggtgggtttttttgtttttttgttttttttttgat

SEQ ID NO: 5892 - DNA, 2123 bp, Homo sapiens
ctgataagtttgtcttttctctggatttttcttgcagatttatcaggatgagcttccaggccccacgcagactcctggagctggcagggcagagcctgctgagggaccaggccttggccatctccgtcctggatgagctgcccagggagctcttcccccgactgttcgtggaggccttcactagcagacgctgcgaggttctgaaggtgatggtgcaggcctggcccttcccctgcctccctctggggtccctgatgaagacgcctgatctggagatcttacattatgtagtggatgggattgattgcctgcttgcccaaaaggttcgccccaggaggtggaaacttcaagtgctggaaatgcgggatgttgatgagaatttttggaccatatggtctggagccaggcccctgtcctgctccccagaggccatgagtaagagacagacagtggaggactgtccaaggacaggagagaagcagcccttgaaggtgttcatggatgtttgcctcaaggaaaaatccgtggatgaagatctgagcttcttctctgggtgggtgcagcacagaagacgttcagtacacctgtgctgtactaaggtggtaaattattcaatgaacattctaaatttcagaaacatattagaaacagtatacccagacagtatccaagtattggaaatttggaacatgtgctggccgtgtatggtagcagaggttagccgttacctgagccagatgaagaatcttcgaaaactcttcatctccgatggctgtggttacctgccaagctttgagagccaaggacagttagttgctgaattcagctctgtgttcctcaggctggagtacctccagatgctttatatgagaaggatccgcttcttcgaaggctacctggaccagctgatcaggtgcctcaagagcccgttggagacattggcattaacttatggctccctagatgaagaggacttgaaatgtctgccctggtacccaagtctcagtcaactgaagcagctgaatctgagtcatggtacactgcgcttcatccgtcttgagcccctccgagctctgctagagaaagttgctgccactcttcagaccctcttcttagtggactgtgggattggggactccaaactcagggtcatcctgcctgccctgagccgctgctccaacctcaccactttctgctttcacggcaatgacacgtccatggatggtctgaaggacctgctgcgccacacaggcaggctgagcaatttgagcctggaaacatatcctgcccctcgggagagtcttgacaacaggggtcgtgtcatttcggagctcctcaccccacttcaggctgagctgatgcgtatactgagggaagtaagggagcccaacaggatcttctttggtcccgtctcctgcccttgctgtggcatgtcacccactgagcaactggagttcaatttttgcttgcggggaaggcctgcctagtggggtggaggtataaaaagctttttctccaggcacttggaaactaaaatctaggacatagatatcttttatttttctttttccttattttacaattttacagcttttatttaaaaatttgagacagggtttccctatgttgtccaggctggtctcaaactcttacgcttaagggagccccctgcttggcctcccaagattctgggattacaggcataagcagctgtgccgggtctataggtgtattataaagggagcagagaaacctctgtttcaggcatgtgctttctgtgagtgggaaaaaaaacacaaaaaaacccagcagggggcagcactggggaaaaggttgaatggagtcactgagactcagggatctgtgtcctagacagtcagaaatagaacctgaagttctagagtgaaggagttatctcagcaaggatggatacaaagaaacgtcggaagtaaagggaacctaaatggaaactctctgctgtccttcatgattgattagcctgtttcagcaatttatacatcagaaatctttagttcctgatgaattaaaaaaagaggtactagttcatctgtgatttaagttcatccgcaggaaataaaggaatcaaaataaacttcattttg

SEQ ID NO: 5893 - DNA, 2123 bp, Homo sapiens
ctgataagtttgtcttttctctggatttttcttgcagatttatcaggatgagcttccaggccccacgcagactcctggagctggcagggcagagcctgctgagggaccaggccttggccatctccgtcctggatgagctgcccagggagctcttcccccgactgttcgtggaggccttcactagcagacgctgcgaggttctgaaggtgatggtgcaggcctggcccttcccctgcctccctctggggtccctgatgaagacgcctgatctggagatcttacattatgtagtggatgggattgattgcctgcttgcccaaaaggttcgccccaggaggtggaaacttcaagtgctggaaatgcgggatgttgatgagaatttttggaccatatggtctggagccaggcccctgtcctgctccccagaggccatgagtaagagacagacagtggaggactgtccaaggacaggagagaagcagcccttgaaggtgttcatggatgtttgcctcaaggaaaaatccgtggatgaagatctgagcttcttctctgggtgggtgcagcacagaagacgttcagtacacctgtgctgtactaaggtggtaaattattcaatgaacattctaaatttcagaaacatattagaaacagtatacccagacagtatccaagtattggaaatttggaacatgtgctggccgtgtatggtagcagaggttagccgttacctgagccagatgaagaatcttcgaaaactcttcatctccgatggctgtggttacctgccaagctttgagagccaaggacagttagttgctgaattcagctctgtgttcctcaggctggagtacctccagatgctttatatgagaaggatccgcttcttcgaaggctacctggaccagctgatcaggtgcctcaagagcccgttggagacattggcattaacttatggctccctagatgaagaggacttgaaatgtctgccctggtacccaagtctcagtcaactgaagcagctgaatctgagtcatggtacactgcgcttcatccgtcttgagcccctccgagctctgctagagaaagttgctgccactcttcagaccctcttcttagtggactgtgggattgggtactccaaactcagggtcatcctgcctgccctgagccgctgctccaacctcaccactttctgctttcacggcaatgacacgtccatggatggtctgaaggacctgctgcgccacacaggcaggctgagcaatttgagcctggaaacatatcctgcccctcgggagagtcttgacaacaggggtcgtgtcatttcggagctcctcaccccacttcaggctgagctgatgcgtatactgagggaagtaagggagcccaacaggatcttctttggtcccgtctcctgcccttgctgtggcatgtcacccactgagcaactggagttcaatttttgcttgcggggaaggcctgcctagtggggtggaggtataaaaagctttttctccaggcacttggaaactaaaatctaggacatagatatcttttatttttctttttccttattttacaattttacagcttttatttaaaaatttgagacagggtttccctatgttgtccaggctggtctcaaactcttacgcttaagggagccccctgcttggcctcccaagattctgggattacaggcataagcagctgtgccgggtctataggtgtattataaagggagcagagaaacctctgtttcaggcatgtgctttctgtgagtgggaaaaaaaacacaaaaaaacccagcagggggcagcactggggaaaaggttgaatggagtcactgagactcagggatctgtgtcctagacagtcagaaatagaacctgaagttctagagtgaaggagttatctcagcaaggatggatacaaagaaacgtcggaagtaaagggaacctaaatggaaactctctgctgtccttcatgattgattagcctgtttcagcaatttatacatcagaaatctttagttcctgatgaattaaaaaaagaggtactagttcatctgtgatttaagttcatccgcaggaaataaaggaatcaaaataaacttcattttg

SEQ ID NO: 5894 - DNA, 2123 bp, Homo sapiens; identical to SEQ ID NO: 5893

SEQ ID NO: 5895 - DNA, 1642 bp, Homo sapiens
cctgaagctactggttggttccctgagaggtcccagaactctgcaaagtgagtccagcgctgagatttttcttgcagatccatcaggatgagcatccaggccccaccgagactactggagctggcggggcagagcctgctgagagaccaggccttgtccatctctgccatggaggagctgcccagggtgctctatctcccactcttcagggaggccttcagcaggagacacttccagactctgacggtgatggtgcaggcctggcctttcacctgcctccctctggtatcgctgatgaagacgcttcatctggagccattgaaagcattgctggaagggcttcatatgctgcttacacagaaggatcgccccaggaggtggaaacttcaagtgctggatttgcgggatgttgatgagaatttctgggccagatggcctggagcctgggccctgtcctgcttcccagaggccatgagtaagaggcagacagcagaggactgtccaaggacgggagagcaccagcccttaaaggtgttcatagacatctgcctcaaggaaataccccaggatgaatgcctgagatacctcttccagtgggtttaccaaaggagaggtttagtacacctgtgctgtagtaagctggtcaattatctaacgccaattaaatatctcagaaagtcattgaaaataatatacattaatagtattggggagctggaaattcacaacacgtgctggccacatctgataagaaagctttattgttacctgaaggagatgaagactctttgcaaactcgttttctccaggtgccatcattacacgtcagataatgaactcgagggatggttagtcaccagattcacctctgtgttcctcaggctggaacacctccagttgcttaaaataaaattgatcaccttcttcagtgggcacctggaacagctgatcaggtgcctccagaaccccttggagaacttggaattaacttgtggcaacctattagaagaggacttgaagtgtctctcccagttcccaagcctcggttacctaaagcatctgaatctcagctacgtgctgctgttccgcatcagtcttgaacccctaggagctctgctagagaaaattgctgcctctctcgagaccctcgtgttagagggctgtcagatccactactcccaactcagtgccatcctgcctggcctgagctgctgctcccagctcaccaccttctactttggcagcaattgcatgtctattgacgccctgaaggacctgctgcgccacaccagtgggctgagcaagttaagcctggagacgtatcctgcccctgaggagagtttgaattccttggttcgtgtcaattgggagatcttcaccccacttcgggctgagctgatgtgtacactgagggaattcaggcagcccaagaggatcttcattggccccaccccctgcccttcctgtggctcatcaccgtctgaggaactggagctccatctttgctgctagggaaggcgtgcccagtggggtagagaaatccaaagttctcttccaggcacttggacactaaaatctactatgtaggtgcaaactatttttctcttttcttatttatttcattttttaataattccaaaat

SEQ ID NO: 5896 - DNA, 1597 bp, Homo sapiens
acccaaagtcttcaagcctggagtttctgcttggtttttcctgaggtctgagcaccctgcaaactgagtccagatctggtaagtccctaatctctgaagatgagcatccggactccacccagactcctggagctggcggggcggagcctgctgagggacgaggccttggccatctccaccctggaggagctgcccacggaactttttcccccattgttcatggaggccttcagcaggagacactgtgaggccctgaagctgatggtgcaggcctggcctttcctccgccttcctctggggtctctgatgaaaaggccttgcccagagaccttccaagctgtgctcgatgggcttgatgcactgcttacccacagggttcgtctcaggaggtggaaacttcaagtgctggatttacaggatgtcagtgagaacttctggatggtttggtctgaagccatggcccgtaggtgcttaccaaatgccatgatgaacagaaaaccagtgcaggactgtccaaggatgagaggacagcagcccttgactgtgttcatagacctttgcctcaagaacaggactctggatgaatacttcacctgcctctttctatgggtcaagcagagggaaggtttagtacacctgtgctgtaagaagctgaaaatgttgggaatgctcttccacaatatcagaaacatcctgaaaacagtcaacctagactgtatccaggaggtggaagtgaattgcaattggacactgcccgtcctggcagagtttaccccatacctcggccagatgaggaatcttcggaagctcgttctctctgacatagattctcgctacatttccccagagcagaagaaggagtttgttacccagttcaccactcagttcctcaagctgcgctgcctccaaaagctttatatgaactctgtttctttcctcgaaggccacctggaccagatgctcagctgtctaaagacctcgttaaacatcctcgcaataactaactgtgtgcttttggaatcagacttgaagcatctgtccaagtacccgagcattggtcaactaaagaccctggacctgagtggcaccagactggccaatttcagccttgtgccgctccaagttctcctagaaaaagttgcagccacccttgagtacctggacttagatgactgtggcatcgtagactcccaagtcaacgccatcctgcctgccctgagccgctgctttgagctcaccaccttcagcttccgtggaaatcccatctccacggccaccctggagaacctgctgtgccacacaatcagactcaacaacttatgcctggagctgtatcctgccccgcgggagagttatgatgttcgtggtatcgtctgccggagcagatttgcccaacttggggctgagctgatggggagagtgagggccttaagggagcccgagaggatcttgttctgtaccgactactgccctcagtgtggcaacaggtcactttacgacctggaggtagatcggtgttgctgttgaatgcctgcctatttgggtggatatatcaaactcttttttctgaacacttgaaaactaaaacctaggtctt

SEQ ID NO: 5897 - DNA, 1508 bp, Homo sapiens
attcaggaagatgagcatccggactccacccagactcctggagctggcggggcggagcctgctgagggacgaggccttggccatctccaccctggaggagctgcccacggaactttttcccccattgttcatggaggccttcagcaggagacactgtgaggccctgaagctgatggtgcaggcctggcctttcctccgccttcctctggggtctctgatgaaaaggccttgcccagagaccttccaagctgtgcttgatgggcttgatgcactgcttacccacagggttcgtctcaggaggtggaaacttcaagtgctggatttacaggatgtcagtgagaacttctggatggtttggtctgaagccatggcccgtaggtgcttaccaaatgccatgatgaacagaaaaccagtgcaggactgtccaaggatgagaggacagcagcccttgactgtgttcatagacctttgcctcaagaacaggactctggatgaatacttcacctgcctctttctatgggtcaagcagagggaaggtttagtacacctgtgctgtaagaagctgaaaatgttgggaatgctcttccacaatatcagaaacatcctgaaaacagtcaacctagactgtatccaggaggtggaagtgaattgcaattggacactgcccgtcctggcagagtttaccccatacctcggccagatgaggaatcttcggaagctcgttctctctgacatagattctcgctacatttccccagagcagaagaaggagtttgttacccagttcaccactcagttcctcaagctgcgctgcctccaaaagctttatatgaactctgtttctttcctcgaaggccacctggaccagatgctcagctgtctaaagacctcgttaaacatcctcgcaataactaactgtgtgcttttggaatcagacttgaagcatctgtccaagtacccgagcattggtcaactaaagaccctggacctgagtggcaccagactggccaatttcagccttgtgccgctccaagttctcctagaaaaagttgcagccacccttgagtacctggacttagatgactgtggcatcgtagactcccaagtcaacgccatcctgcctgccctgagccgctgctttgagctcaccaccttcagcttccgtggaaatcccatctccacggccaccctggagaacctgctgtgccacacaatcagactcaacaacttatgcctggagctgtatcctgccccgcgggagagttatgatgttcgtggtatcgtctgccggagcagatttgcccaacttggggctgagctgatggggagagtgagggccttaagggagcccgagaggatcttgttctgtaccgactactgccctcagtgtggcaacaggtcactttacgacctggaggtagatcggtgttgctgttgaatgcctgcctatttgggtggatatatcaaactcttttttctgaacacttgaaaactaaaacctaggtctt

SEQ ID NO: 5898 - DNA, 1597 bp, Homo sapiens
acccaaagtcttcaagcctggagtttctgcttggtttttcctgaggtctgagcaccctgcaaactgagtccagatctggtaagtccctaatctctgaagatgagcatccggactccacccagactcctggagctggcggggcggagcctgctgagggacgaggccttggccatctccaccctggaggagctgcccacggaactttttcccccattgttcatggaggccttcagcaggagacactgtgaggccctgaagctgatggtgcaggcctggcctttcctccgccttcctctggggtctctgatgaaaaggccttgcccagagaccttccaagctgtgcttgatgggcttgatgcactgcttacccacagggttcgtctcaggaggtggaaacttcaagtgctggatttacaggatgtcagtgagaacttctggatggtttggtctgaagccatggcccgtaggtgcttaccaaatgccatgatgaacagaaaaccagtgcaggactgtccaaggatgagaggacagcagcccttgactgtgttcatagacctttgcctcaagaacaggactctggatgaatacttcacctgcctctttctatgggtcaagcagagggaaggtttagtacacctgtgctgtaagaagctgaaaatgttgggaatgctcttccacaatatcagaaacatcctgaaaacagtcaacctagactgtatccaggaggtggaagtgaattgcaattggacactgcccgtcctggcagagtttaccccatacctcggccagatgaggaatcttcggaagctcgttctctctgacatagattctcgctacatttccccagagcagaagaaggagtttgttacccagttcaccactcagttcctcaagctgcgctgcctccaaaagctttatatgaactctgtttctttcctcgaaggccacctggaccagatgctcagctgtctaaagacctcgttaaacatcctcgcaataactaactgtgtgcttttggaatcagacttgaagcatctgtccaagtacccgagcattggtcaactaaagaccctggacctgagtggcaccagactggccaatttcagccttgtgccgctccaagttctcctagaaaaagttgcagccacccttgagtacctggacttagatgactgtggcatcgtagactcccaagtcaacgccatcctgcctgccctgagccgctgctttgagctcaccaccttcagcttccgtggaaatcccatctccacggccaccctggagaacctgctgtgccacacaatcagactcaacaacttatgcctggagctgtatcctgccccgcgggagagttatgatgttcgtggtatcgtctgccggagcagatttgcccaacttggggctgagctgatggggagagtgagggccttaagggagcccgagaggatcttgttctgtaccgactactgccctcagtgtggcaacaggtcactttacgacctggaggtagatcggtgttgctgttgaatgcctgcctatttgggtggatatatcaaactcttttttctgaacacttgaaaactaaaacctaggtctt

SEQ ID NO: 5899 - DNA, 1446 bp, Homo sapiens
atgaggatgagcctacaggccccacgcagactcctggagctggcagggcagagcctgctgggggaccaggccttggccatctccatcttggatgagctgcccagggagctcttccccccactgttcgtggaggccttcactagcagacgctgcgaggttctgaaggtgatggtgcaggcctggcccttcccctgcctccctctggggtccctgatgaagacgcctgatctggagatcttacattatgtagtggatgggattgattgcctgcttgcccaaaaggttcgccccaggaggtggaaacttcaagtgctggaattgcgggatgttgatgagaatttttggaccatatggtctggagccaggcccctgtcctgctccccagaggccatgagtaagaggcagacagtggaggactgtccaaggacaggagagaagcagcccttgaaggtgttcatggatgtttgcctcaaggaaaaattcatggatgaagatctgagcttcttctctgggtgggtccagcacagaagaggttcagtacacctgtgctgtactaaggtggtgaattattcaatgagcattctaaatttcagaaacatattggaaacagtatacccagacagtatccaagtgttggaaatttggaacatgtgctggccgtgtatgatagtagagtttagccgttacctgagccagatgaggaatcttcgcaaactcttcatctccgatggctgtcgttacctgctaagctctgacagccaagaacagttagttgctgaattcagctctgtgctcctcaggctggagtacctccagatgctttatgtaagaagggtctgcttcttcagaggccacctggaccagctgatcaggtgcctcaggagcccattggagacattggcattaacttatggcttcctagaaaaagtggacttgaaatgtctgccccggtacccaagtctcagtcaactgaagcagctgaatctgagtcatggtgcactgcgcttcatccgtcttgagcccctccgagctctgctagagaaagttgctgccactcttcagaccctcttcttagtggactgtgggattcgggactccaaactcagggtcatcctgcctgccctgagctgctgctccaacctcaccactttctgttttcacggcaatgacacgtccatggatggtctgaaggacctgctgcgccacacaggcaggctgagcaatttgagcctggaaacatatcctgcccctcgggagagtcttgatgacaggggtcgtgtcatttcggagctcctcaccccacttcaggctgagctgatgcgtatactgagggaagtaagggagcccaaaaggatcttctttggtccggtgtcctgcccttgctgtggcacgtcgcccactgagcaactggagttcaatttttgcttgtggggaaggcctgcctag

SEQ ID NO: 5900 - DNA, 2104 bp, Homo sapiens
gatttgttttcttgcagatttatgaggatgagcctacaggccccacgcagactcctggagctggcagggcagagcctgctgggggaccaggccttggccatctccatcttggatgagctgcccagggagctcttccccccactgttcgtggaggccttcactagcagacgctgcgaggttctgaaggtgatggtgcaggcctggcccttcccctgcctccctctggggtccctgatgaagacgcctgatctggagatcttacattatgtagtggatgggattgattgcctgcttgcccaaaaggttcgccccaggaggcggaaacttcaagtgctggaattgcgggatgttgatgagaatttttggaccatatggtctggagccaggcccctgtcctgctccccagaggccatgagtaagaggcagacagtggaggactgtccaaggacaggagagaagcagcccttgaaggtgttcatggatgtttgcctcaaggaaaaattcatggatgaagatctgagcttcttctctgggtgggtccagcacagaagaggttcagtacacctgtgctgtactaaggtggtgaattattcaatgagcattctaaatttcagaaacatattggaaacagtatacccagacagtatccaagtgttggaaatttggaacatgtgctggccgtgtatgatagtagagtttatccgttacctgagccagatgaggaatcttcgcaaactcttcatctccgatggctgtcgttacctgctaagctctgacagccaagaacagttagttgctgaattcagctctgtgctcctcaggctggagtacctccagatgctttatgtaagaagggtctgcttcttcagaggccacctggaccagctgatcaggtgcctcaggagcccattggagacattggcattaacttatggcttcctagaaaaagtggacttgaaatgtctgccccggtacccaagtctcagtcaactgaagcagctgaatctgagtcatggtgcactgcgcttcatccgtcttgagcccctccgagctctgctagagaaagttgctgccactcttcagaccctcttcttagtggactgtgggattcgggactccaaactcagggtcatcctgcctgccctgagctgctgctccaacctcaccactttctgttttcacggcaatgacacgtccatggatggtctgaaggacctgctgcgccacacaggcaggctgagcaatttgagcctggaaacatatcctgcccctcgggagagtcttgatgacaggggtcgtgtcatttcggagctcctcaccccacttcaggctgagctgatgcgtatactgagggaagtaagggagcccaaaaggatcttctttggtccggtgtcctgcccttgctgtggcacgtcgcccactgagcaactggagttcaatttttgcttgtggggaaggcctgcctagtggggtggaggtataaaaagctttttctccaggcacttggaaactaaaatctgggacatagatgtcttttatttttctttttccttattttacaattttacagtttttatttaaaaatttgagacagggtttccctatgttgtccaggctggtctcaaactcttacgcttaagggagccacctgcttggcctcccaagattctgggattacaggcataagcagctgtgccgggtctataggtgtattataaagggagcagagaaacctctgtttcaggcatgtgctttctgtgagtgggaaaaaaaacacaaaaaaacccagcagggggcagcactggggaaaaggttgaatggagtcactgagactcagggatctgtgtcctagacagtcagaaatagaaagctgaagttctagagtgaaggagttatctcagcaaggatggatacaaagaaacgtcggaagtagagggaacctaaatggaaactctctgctgtccttcatgattgattagcctgtttcagcaatttatacatcagaaatctttagttcctgatgaattaaaaaaagaggtactagttcatctgtgatttaggttcatctgcaggaaataaaggaatcaaaataaacttcattttg

SEQ ID NO: 5901 - DNA, 2104 bp, Homo sapiens; identical to SEQ ID NO: 5900

SEQ ID NO: 5902 - DNA, 1828 bp, Homo sapiens
ttcctgcttggttcttcctgagatctgagcaccttctagactacatccagatctgttttccctgcagattcatgaagatgagcatctggactccacccagactcctggagcttgcagggcggagcctgctaagggaccaagctttggccatgtccaccctggaggagctgcccacagaacttttccccccactgttcatggaggccttcagcaggagacgctgtgaggccctgaagctgatggtgcagtcctggcccttccgccgcctccctctgaggcctctgataaagatgccttgtctggaggccttccaagctgtgctcgatgggctggatgcactgcttaacctaggggttcgtcccaggaggtggaaacttcaagtgctggatttacaggatgtctgtgagaacttctggatggtttggtctgaagctatggcccatgggtgcttcctcaatgccaagaggaacaaaaaaccagtggaggactgtccaaggatgagaggacggcagcccttgactgtgttcgtagaactttggctcaagaacaggactctggatgaatacctcacctgcctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaaactcattctctcccacatggatgtctctcgctacgtttccccagagcagaagaaggagattgttacccagttcaccactcagttcctcaagctgcgctgcctccaaaagctttatatgaactctgtttctttcctcgaaggccacctggaccagctgctcagctgtctgaagacctcgttaaagttcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcttgcctgccctgagccgctgctttgagctcaacaccttcagcttctgtggaaatcccatctgcatggccaccctggagaacctgctgagccacacaatcatactcaaaaacttatgcgtggagctgtatcctgccccccgggagagttatggtgctgatggtactctctgctggagcagatttgctcaaattagggctgagctgatgaacagagtgagggacttaaggcaccccaagaggatcttgttctgtactgactactgccctgactgtggcaacaggtcattttatgacctggaggcagatcaatactgctgttgaatgcctgcctatttggatgggtatgtcaaacgctttcttctggacacttggaaactaaaacctaggtcttaggtacatcctaaagggagcacagaacccatcatttcacacataggctctgaaagtgggaaaggaaagctgatcaagcaggggccggacttgggggaaatgttgccatggattcgatgggactttggggacctgtgtcctgtagagtcgaaaatgggaatctgaatgtctagagtggaattcaggcttgagaatacatgagggagttactcttgcatggatggttgtaaagaaacaatcagaaataaagg

SEQ ID NO: 5903 - DNA, 1855 bp, Homo sapiens
acccaaagtcttcaagcctggagttcctgcttggttcttcctgaggactgagcaccttctagactacatccagatctgttttccctgcagattcgtgaagatgagcatccggactccacccagactcctggagcttgcagggcggagcctgctgagggaccaagccttggccatgtccaccctggaggagctgcccacagaacttttccccccactgttcatggaggccttcagcaggagacgctgtgaggccctgaagctgatggtgcaggcctggcccttccgccgcctccctctgaggcctctgataaagatgccttgtctggaggccttccaagctgtgctcgatgggctggatgcactgcttacccaaggggttcatcccaggaggtggaaacttcaagtgctggatttacaggatgtctgtgagaacttctggatggtttggtctgaagctatggcccatgggtgcttcctcaatgccaagaggaacaaaaaaccagtgcaggactgtccaaggatgagaggacagcagcccttgactgtgttcgtagaactttggctcaagaacaggactctggatgaatacctcacctgcctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgtgctgcctccaaaagctttctatgaactctgtttctttcctcgaaggccacctggaccagctgctcagctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctccatggccaccctggagaacctgctgagccacacaatcatactcaaaaacttatgcgtggagctgtatcctgccccccgggagagttatgatgctgatggtactctctgctggagcagatttgctcaaattagggctgagctgatgaagagagtgagggacttaaggcaccccaagaggatcttgttctgtactgactgctgccctgactgtggcaacaggtcattttatgacctggaggcagatcaatgctgctgttgaatgcctgcctatttgggtggatatgtcaaacgctttcttctggacacttggaaactaaaacctaggtcttaggtacatcctatagggagcacagaacccatcatttcacacatgggctctgaaagtgggaaaggaaaggtgatcaagcaggggcaggacttgggggaagtgttgccatggattcgatgggactttggggacctgtgtcctgtagagtggaaaatgggaatttgaatgtctagagtggaggcttgagaatacttgagggagttactcttggatgcatggttgtaaagaaacaatcagaaataaaggaaaactgag

SEQ ID NO: 5904 - DNA, 1431 bp, Homo sapiens
atgagcatccggactccacccagactcctggagcttgcagggcggagcctgctgagggaccaagccttggccatgtccaccctggaggagctgcccacagaacttttccccccactgttcatggaggccttcagcaggagacgctgtgaggccctgaagctgatggtgcaggcctggcccttccgccgcctccctctgaggcctctgataaagatgccttgtctggaggccttccaagctgtgctcgatgggctggatgcactgcttacccaaggggttcatcccaggaggtggaaacttcaagtgctggatttacaggatgtctgtgagaacttctggatggtttggtctgaagctatggcccgtgggtgcttcctcaatgccaagaggaacaaaacaccagtgcaggactgtccaaggatgagaggacagcagcccttgactgtgttcgtagaactttggctcaagaacaggactctggatgaatacctcacctgcctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgtgctgcctccaaaagctttctatgaactctgtttctttcctcgaaggccacctggaccagctgctcagctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctccatggccaccctggagaacctgctgagccacacaatcatactcaaaaacttatgcgtggagctgtatcctgccccccgggagagttatgatgctgatggtactctctgctggagcagatttgctcaaattagggctgagctgatgaagagagtgagggacttaaggcaccccaagaggatcttgttctgtactgactgctgccctgactgtggcaacaggtcattttatgacctggaggcagatcaatgctgctgttga

SEQ ID NO: 5905 - DNA, 1855 bp, Homo sapiens
acccaaagtcttcaagcctggagttcctgcttggttcttcctgaggactgagcaccttctagactacatccagatctgttttccctgcagattcgtgaagatgagcatccggactccacccagactcctggagcttgcagggcggagcctgctgagggaccaagccttggccatgtccaccctggaggagctgcccacagaacttttccccccactgttcatggaggccttcagcaggagacgctgtgaggccctgaagctgatggtgcaggcctggcccttccgccgcctccctctgaggcctctgataaagatgccttgtctggaggccttccaagctgtgctcgatgggctggatgcactgcttacccaaggggttcatcccaggaggtggaaacttcaagtgctggatttacaggatgtctgtgagaacttctggatggtttggtctgaagctatggcccatgggtgcttcctcaatgccaagaggaacaaaaaaccagtgcaggactgtccaaggatgagaggacagcagcccttgactgtgttcgtagaactttggctcaagaacaggactctggatgaatacctcacctgcctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgtgctgcctccaaaagctttctatgaactctgtttctttcctcgaaggccacctggaccagctgctcagctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagctgctgctttgagctcaacaccttcagcttctgtggaaatcccatctccatggccaccctggagaacctgctgagccacacaatcatactcaaaaacttatgcgtggagctgtatcctgccccccgggagagttatgatgctgatggtactctctgctggagcagatttcctcaaattagggctgagctgatgaagagagtgagggacttaaggcaccccaagaggatcttgttctgtactgactgctgccctgactgtggcaacaggtcattttatgacctggaggcagatcaatgctgctgttgaatgcctgcctatttgggtggatatgtcaaacgctttcttctggacacttggaaactaaaacctaggtcttaggtacatcctatagggagcacagaacccatcatttcacacatgggctctgaaagtgggaaaggaaaggtgatcaagcaggggcaggacttgggggaagtgttgccatggattcgatgggactttggggacctgtgtcctgtagagtggaaaatgggaatttgaatgtctagagtggaggcttgagaatacttgagggagttactcttggatgcatggttgtaaagaaacaatcagaaataaaggaaaactgag

SEQ ID NO: 5906 - DNA, 1855 bp, Homo sapiens
acccaaagtcttcaagcctggagttcctgcttggttcttcctgaggactgagcaccttctagactacatccagatctgttttccctgcagattcgtgaagatgagcatccggactccacccagactcctggagcttgcagggcggagcctgctgagggaccaagccttggccatgtccaccctggaggagctgcccacagaacttttccccccactgttcatggaggccttcagcaggagacgctgtgaggccctgaagctgatggtgcaggcctggcccttccgccgcctccctctgaggcctctgataaagatgccttgtctggaggccttccaagctgtgctcgatgggctggatgcactgcttacccaaggggttcatcccaggaggtggaaacttcaagtgctggatttacaggatgtctgtgagaacttctggatggtttggtctgaagctatggcccgtgggtgcttcctcaatgccaagaggaacaaaacaccagtgcaggactgtccaaggatgagaggacagcagcccttgactgtgttcgtagaactttggctcaagaacaggactctggatgaatacctcacctgcctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgtgctgcctccaaaagctttctatgaactctgtttctttcctcgaaggccacctggaccagctgctcagctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctccatggccaccctggagaacctgctgagccacacaatcatactcaaaaacttatgcgtggagctgtatcctgccccccgggagagttatgatgctgatggtactctctgctggagcagatttgctcaaattagggctgagctgatgaagagagtgagggacttaaggcaccccaagaggatcttgttctgtactgactgctgccctgactgtggcaacaggtcattttatgacctggaggcagatcaatgctgctgttgaatgcctgcctatttgggtggatatgtcaaacgctttcttctggacacttggaaactaaaacctaggtcttaggtacatcctatagggagcacagaacccatcatttcacacatgggctctgaaagtgggaaagggaaggtgatcaagcaggggcaggacttgggggaagtgttgccatggattcgatgggactttggggacctgtgtcctgtagagtggaaaatgggaatttgaatgtctagagtggaggcttgagaatacatgagggagttactcttgcatggatggttgtaaagaaacaatcagaaataaaggaaaactgag

SEQ ID NO: 5907 - DNA, 1537 bp, Homo sapiens
gcctggagttcctgcttggttcttcctgaggactgagcaccttctagactacatccagatctgttttccctgcagattcgtgaagatgagcatccggactccacccagactcctggagcttgcagggcggagcctgctgagggaccaagccttggccatgtccaccctggaggagctgcccacagaacttttccccccactgttcatggaggccttcagcaggagacgctgtgaggccctgaagctgatggtgcaggcctggcccttccgccgcctccctctgaggcctctgataaagatgccttgtctggaggccttccaagctgtgctcgatgggctggatgcactgcttacccaaggggttcatcccaggaggtggaaacttcaagtgctggatttacaggatgtctgtgagaacttctggatggtttggtctgaagctatggcccatgggtgcttcctcaatgccaagaggaacaaaaaaccagtgcaggactgtccaaggatgagaggacagcagcccttgactgtgttcgtagaactttggctcaagaacaggactctggatgaatacctcacctgcctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgtgctgcctccaaaagctttctatgaactctgtttctttcctcgaaggccacctggaccagctgctcagctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctccatggccaccctggagaacctgctgagccacacaatcatactcaaaaacttatgcgtggagctgtatcctgccccccgggagagttatgatgctgatggtactctctgctggagcagatttgctcaaattagggctgagctgatgaagagagtgagggacttaaggcaccccaagaggatcttgttctgtactgactgctgccctgactgtggcaacaggtcattttatgacctggaggcagatcaatgctgctgttgaatgcctgcctatttgggtgga

SEQ ID NO: 5908 - DNA, 1720 bp, Homo sapiens
agcctagagttcctgcttggttcttcctgaggactgagcaccttctagactacatccagatctgttttccctgcagattcgtgaagatgagcatccggactccacccagactcctggagcttgcagggcggagcctgctgagggaccaagccttggccatgtccaccctggaggagctgcccacagaacttttccccccactgttcatggaggccttcagcaggagacgctgtgaggccctgaagctgatggtgcaggcctggcccttccgccgcctccctctgaggcctctgataaagatgccttgtctggaggccttccaagctgtgctcgatgggctggatgcactgcttacccaaggggttcatcccaggaggtggaaacttcaagtgctggatttacaggatgtctgtgagaacttctggatggtttggtctgaagctatggcccatgggtgcttcctcaatgccaagaggaacaaaaaaccagtgcaggactgtccaaggatgagaggacagcagcccttgactgtgttcgtagaactttggctcaagaacaggactctggatgaatacctcacctgcctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgtgctgcctccaaaagctttctatgaactctgtttctttcctcgaaggccacctggaccagctgctcagctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagctgctgctttgagctcaacaccttcagcttctgtggaaatcccatctccatggccaccctggagaacctgctgagccacacaatcatactcaaaaacttatgcgtggagctgtatcctgccccccgggagagttatgatgctgatggtactctctgctggagcagatttcctcaaattagggctgagctgatgaagagagtgagggacttaaggcaccccaagaggatcttgttctgtactgactgctgccctgactgtggcaacaggtcattttatgacctggaggcagatcaatgctgctgttgaatgcctgcctatttgggtggatatgtcaaacgctttcttctggacacttggaaactaaaacctaggtcttaggtacatcctatagggagcacagaacccatcatttcacacatgggctctgaaagtgggaaaggaaaggtgatcaagcaggggcaggacttgggggaagtgttgccatggattcgatgggactttggggacct

SEQ ID NO: 5909 - DNA, 1720 bp, Homo sapiens
agcctagagttcctgcttggttcttcctgaggactgagcaccttctagactacatccagatctgttttccctgcagattcgtgaagatgagcatccggactccacccagactcctggagcttgcagggcggagcctgctgagggaccaagccttggccatgtccaccctggaggagctgcccacagaacttttccccccactgttcatggaggccttcagcaggagacgctgtgaggccctgaagctgatggtgcaggcctggcccttccgccgcctccctctgaggcctctgataaagatgccttgtctggaggccttccaagctgtgctcgatgggctggatgcactgcttacccaaggggttcatcccaggaggtggaaacttcaagtgctggatttacaggatgtctgtgagaacttctggatggtttggtctgaagctatggcccgtgggtgcttcctcaatgccaagaggaacaaaacaccagtgcaggactgtccaaggatgagaggacagcagcccttgactgtgttcgtagaactttggctcaagaacaggactctggatgaatacctcacctgcctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgtgctgcctccaaaagctttctatgaactctgtttctttcctcgaaggccacctggaccagctgctcagctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctccatggccaccctggagaacctgctgagccacacaatcatactcaaaaacttatgcgtggagctgtatcctgccccccgggagagttatgatgctgatggtactctctgctggagcagatttgctcaaattagggctgagctgatgaagagagtgagggacttaaggcaccccaagaggatcttgttctgtactgactgctgccctgactgtggcaacaggtcattttatgacctggaggcagatcaatgctgctgttgaatgcctgcctatttgggtggatatgtcaaacgctttcttctggacacttggaaactaaaacctaggtcttaggtacatcctatagggagcacagaacccatcatttcacacatgggctctgaaagtgggaaagggaaggtgatcaagcaggggcaggacttgggggaagtgttgccatggattcgatgggactttggggacct

SEQ ID NO: 5910 - DNA, 1425 bp, Homo sapiens
atgagcatcagggccccacccagactcctggagctggcaaggcagaggctgctgagggaccaggccttggccatctccaccatggaggagctgcccagggagctcttccccacactgttcatggaggccttcagcaggagacgctgtgaaaccctgaaaacaatggtgcaggcctggcctttcacccgcctccctctagggtccctgatgaagtcgcctcatctggagtcattaaaatctgtgctggaaggggttgatgtgctgttgacccaagaggttcgccccaggcagtcaaaacttcaagtgctggacttgaggaatgtggatgagaacttctgcgacatattttctggagctactgcatccttcccggaggctctgagtcagaagcaaacagcagataactgtccagggacaggcaggcagcagccattcatggtgttcatagacctttgtctcaagaacaggacactagatgaatgcctcacccacctcttagagtggggcaagcagagaaaaggcttactgcatgtgtgttgcaaggagctgcaggtttttggaatgcccatccacagtatcatagaggtcctgaacatggtggagcttgactgtatccaggaggtggaagtgtgctgcccctgggagctgtccactcttgtgaagtttgccccttacctgggccagatgaggaatctccgcaaacttgttctcttcaacatccgtgcatctgcctgcattcccccagacaacaaggggcagttcattgcccgattcacctctcagttcctcaagctggactatttccagaatctgtctatgcactccgtctctttcctcgaaggccacctggaccagctgctcaggtgtctccaggcctccttggagatggtcgttatgaccgactgcctgctgtcagagtcggacttgaagcatctctcttggtgcccgagcatccgtcaattaaaggagctggacctgaggggtgtcacgctgacccatttcagccctgagcccctcacaggtctgctggagcaagttgtggccaccctgcagaccctggacttagaggactgtgggatcatggattcccaactcagcgccatcctgcctgtcctgagccgctgctcccagctcagcaccttcagcttctgtgggaacctcatctccatggctgcccttgagaacctgctgcgccacaccgtcgggctgagcaagctaagcctggagctgtatcctgcccctctggagagttatgacacccagggtgctctctgctgggggagatttgctgaacttggggctgagctgatgaagacaccgagggacttaaggcagcccaagatcattgtgttctgcaccgtcccctgccctcgctgtggcatcagggcctcctatgacctggagcccagtcactgcctctgttga

SEQ ID NO: 5911 - DNA, 1844 bp, Homo sapiens
gaactactgcttgattctctgagagatcccagcaccctacaaactgagtccagatctgagttttcccttgcagattcatcaagatgagcatcagggccccacccagactcctggagctggcaaggcagaggctgctgagggaccaggccttggccatctccaccatggaggagctgcccagggagctcttccccacactgttcatggaggccttcagcaggagacgctgtgaaaccctgaaaacaatggtgcaggcctggcctttcacccgcctccctctagggtccctgatgaagtcgcctcatctggagtcattaaaatctgtgctggaaggggttgatgtgctgttgacccaagaggttcgccccaggcagtcaaaacttcaagtgctggacttgaggaatgtggatgagaacttctgcgacatattttctggagctactgcatccttcccggaggctctgagtcagaagcaaacagcagataactgtccagggacaggcaggcagcagccattcatggtgttcatagacctttgtctcaagaacaggacactagatgaatgcctcacccacctcttagagtggggcaagcagagaaaaggcttactgcatgtgtgttgcaaggagctgcaggtttttggaatgcccatccacagtatcatagaggtcctgaacatggtggagcttgactgtatccaggaggtggaagtgtgctgcccctgggagctgtccactcttgtgaagtttgccccttacctgggccagatgaggaatctccgcaaacttgttctcttcaacatccgtgcatctgcctgcattcccccagacaacaaggggcagttcattgcccgattcacctctcagttcctcaagctggactatttccagaatctgtctatgcactccgtctctttcctcgaaggccacctggaccagctgctcaggtgtctccaggcctccttggagatggtcgttatgaccgactgcctgctgtcagagtcggacttgaagcatctctcttggtgcccgagcatccgtcaattaaaggagctggacctgaggggtgtcacgctgacccatttcagccctgagcccctcacaggtctgctggagcaagttgtggccaccctgcagaccctggacttagaggactgtgggatcatggattcccaactcagcgccatcctgcctgtcctgagccgctgctcccagctcagcaccttcagcttctgtgggaacctcatctccatggctgcccttgagaacctgctgcgccacaccgtcgggctgagcaagctaagcctggagctgtatcctgcccctctggagagttatgacacccagggtgctctctgctgggggagatttgctgaacttggggctgagctgatgaagacaccgagggacttaaggcagcccaagatcattgtgttctgcaccgtcccctgccctcgctgtggcatcagggcctcctatgacctggagcccagtcactgcctctgttgaatgcctgccatcagggtggatatatttcaagctttcttctggtcatttcggagctgaaacctaggccatgagtgcatgttaaagggagcacagacccatcgtttcaaatgcctcctcagtgtgaatgggaaaggaatgaggatgcaggaggggcaggactgggggaaaagttgacttggagtggatgggctctttagagacctgtgtcccagagaatcagaaatgggaatctgaattgctagagtgagaatcagggaggagagacacatgagagggttacccctgcacagatggttgtaaagtaacagtcagaaataaagggaaactgagtggaaa

SEQ ID NO: 5912 - DNA, 1844 bp, Homo sapiens
gaactactgcttgattctctgagagatcccagcaccctacaaactgagtccagatctgagttttcccttgcagattcatcaagatgagcatcagggccccacccagactcctggagctggcaaggcagaggctgctgagggaccaggccttggccatctccaccatggaggagctgcccagggagctcttccccacactgttcatggaggccttcagcaggagacgctgtgaaaccctgaaaacaatggtgcaggcctggcctttcacccgcctccctctagggtccctgatgaagtcgcctcatctggagtcattaaaatctgtgctggaaggggttgatgtgctgttgacccaagaggttcgccccaggcagtcaaaacttcaagtgctggacttgaggaatgtggatgagaacttctgcgacatattttctggagctactgcatccttcccggaggctctgagtcagaagcaaacagcagataactgtccagggacaggcaggcagcagccattcatggtgttcatagacctttgtctcaagaacaggacactagatgaatgcctcacccacctcttagagtggggcaagcagagaaaaggcttactgcatgtgtgttgccaggagctgcaggtttttggaatgcccatccacagtatcatagaggtcctgaacatggtggagcttgactgtatccaggaggtggaagtgtgctgcccctgggagctgtccactcttgtgaagtttgccccttacctgggccagatgaggaatctccgcaaacttgttctcttcaacatccgtgcatctgcctgcattcccccagacaacaaggggcagttcattgcccgattcacctctcagttcctcaagctggactatttccagaatctgtctatgcactccgtctctttcctcgaaggccacctggaccagctgctcaggtgtctccaggcctccttggagatggtcgttatgaccgactgcctgctgtcagagtcggacttgaagcatctctcttggtgcccgagcatccgtcaattaaaggagctggacctgaggggtgtcacactgacccatttcagccctgagcccctcacaggtctgctggagcaagttgtggccaccctgcagaccctggacttagaggactgtgggatcatggattcccaactcagcgccatcctgcctgtcctgagccgctgctcccagctcagcaccttcagcttctgtgggaacctcatctccatggctgcccttgagaacctgctgcgccacaccgtcgggctgagcaagctaagcctggagctgtatcctgcccctctggagagttatgacacccagggtgctctctgctgggggagatttgctgaacttggggctgagctgatgaagacactgagggacttaaggcagcccaagatcattgtgttctgcaccgtcccctgccctcgctgtggcatcagggcctcctatgacctggagcccagtcactgcctctgttgaatgcctgccatcagggtggatatatttcaagctttcttctggtcatttcggagctgaaacctaggccatgagtgcatgttaaagggagcacagacccatcgtttcaaatgcctcctcagtgtgaatgggaaaggaatgaggatgcaggaggggcaggactgggggaaaagttgacttggagtggatgggctctttagagacctgtgtcccagagaatcagaaatgggaatctgaattgctagagtgagaatcagggaggagagacacatgagagggttacccctgcacagatggttgtaaagtaacagtcagaaataaagggaaactgagtggaaa

SEQ ID NO: 5913 - DNA, 1863 bp, Homo sapiens; identical to SEQ ID NO: 5888

SEQ ID NO: 5914 - DNA, 806 bp, Homo sapiens
accgagttcccaggccggacgcgcggtggcctgacggtcgcaaggattacattcgcctgacccggcccggcttgaccctgcccgggcgcgccatgttcgcgcgtgggtcccggaggcgccgctccgggcgtgcgcctccagaggcagaggacccagaccggggccagccctgcaactcctgtagggagcagtgccctggcttcctgctccacggctggagaaagatctgccagcattgcaaatgcccgcgggaggagcatgcagtgcacgcggtgcctgtggacctggaacgcatcatgtgtcggctaatctcggacttccagcgccactccatctccgacgacgactcaggctgtgcatcggaggagtatgcctgggtgcccccaggccttaagccggagcaggtatatcaatttttcagctgcctcccagaggacaaggtcccctacgtcaacagtcctggggagaaatacaggatcaagcagctgctgcaccagctgcccccacacgacagtgaggtgaggagagagaagacaggaagggcatgccaggcacagcacacagcctgggccaatgcagggcagggtcagaggaggaaaggtgagctgatctgaggtgagtggtccagacaggcaggggtcatcaggggacattccttggcaaaaccacagctgggccttggaagaagaggtggttacttcaggcaggaggcaccatctatagaaagacctagaagtaaacttgcggggcatggatgaagtctggaagaggggcagggacaggcatcaagggaggagcctgggaga

SEQ ID NO: 5915 - DNA, 2814 bp, Homo sapiens
ggaaccgagttcccaggccggacgcgcggtggcctgacggtcgcaaggattacattcgcctgacccggcccggcttgaccctgcccgggcgcgccatgttcgcgcgtgggtcccggaggcgccgctccgggcgtgcgcctccagaggcagaggacccagaccggggccagccctgcaactcctgtagggagcagtgccctggcttcctgctccacggctggagaaagatctgccagcattgcaaatgcccgcgggaggagcatgcagtgcacgcggtgcctgtggacctggaacgcatcatgtgtcggctaatctcggacttccagcgccactccatctccgacgacgactcaggctgtgcatcggaggagtatgcctgggtgcccccaggccttaagccggagcaggtatatcaatttttcagctgcctcccagaggacaaggtcccctacgtcaacagtcctggggagaaatacaggatcaagcagctgctgcaccagctgcccccacacgacagtgaggcacagtactgcacagcactggaagaggaggaaaagaaagagctccgagcctttagccagcagcggaagcgggagaatctggggcgtggcatcgtgcgcatcttcccggtgaccatcactggggccatctgtgaggagtgcggaaagcagattggaggtggggacatcgcagtgtttgccagccgtgcaggcctgggtgcctgctggcacccacagtgcttcgtgtgtaccacgtgccaggaactgctggttgacctcatctacttctaccatgttggcaaggtctactgcgggcgtcaccatgccgaatgcctgcgtccacgctgccaagcctgtgacgagatcatcttctcccctgagtgcacggaggctgagggccgccactggcacatggatcacttctgctgctttgagtgtgaagcttcactaggagggcagcgctatgtcatgcgtcagagccgcccccactgctgcgcctgctacgaggcccgccacgcggagtactgtgatggctgtggggagcacatcggcctggaccaaggccagatggcttacgagggccagcactggcatgcctcagaccgctgcttctgctgtagtcgctgtgggcgggccctgctgggccgcccattcctgccacgccgaggcctaatcttctgctctcgagcctgcagccttgggtccgagcccacagctccagggccgagccgccgcagctggagtgccggccctgtcacagccccacttgcagcctccacagcctctttctctgctgtgaagggggcatcagagaccaccaccaaaggcaccagcacagagttagcgccagctacaggccctgaggagccctcccgctttctgagaggggctccccaccgccactccatgccggaactggggctccgcagtgtccccgagccgcccccagagtcccccggccagcctaacctgcgcccagatgatagtgccttcggtcgtcagagcaccccacgcgtcagcttccgcgaccctctggtgtctgaaggaggcccgcgccggaccctgagtgcacccccggcccagcgccgcaggccacgcagtcccccacccagggcccccagccgtcgccgccaccatcatcataatcaccatcaccatcacaaccgccacccaagcagacgtcgccactatcaatgtgacgcgggatcagggtcagactcggaatcttgctccagctcgccctccagttccagttccgaatcatcagaggatgatggcttcttcctaggagagcgcatccctctgcccccgcatttgtgcaggcccatgcctgctcaggacactgcaatggagaccttcaactccccatctttatcgctccccagggactctcgcgcagggatgcctcgtcaggcccgagacaagaactgcatcgtggcttgaaggcaggccgtcctggagggggctccattctccagtcagagtagatgatgaggcccatgcccctcacccccacgccccgcccctacaacctaagtcataaatcctcttcctccctcctttatcagtttgtttctatttttgtttctgttttagagacttggtctaccctattgcccaggctggagtgcagtggtgtgatcagggctcactgcagcctcaaaagttttgggctcaagctatcctcccacctcagcctcccaagtagctgggactccaggctcgtgtcagcgttcccagctaattttttaattttttggtagagatggggttttgccatgttgcccaggctggtctagaactcctgggctcaagcaatcctcccgcagcctcccaaaggactgggattacaggcatgagccaccgcaccgggcctctcgtttgtattattgaagtaatttaatatttgttgtaaaacaggcctggcttctttgcctccttgccccagctgtttccactccatttccccctcctgatgcttgaaatttacccacatttgatgaaaggattactttattcattatcgtatattttaacaatgtttattattcatttatccctctatagaaccaccacccacaccgaggagattatttggagtgggtcccaacctagggcctggactctgaaatctaactccccacttccctcattttgtgacttaggtgggggcatggttcagtcagaactggtgtctcctattggatcgtgcagaaggaggacctaggcacacacatatggtggccacacccaggagggttgattggcaggctggaagacaaaagtctcccaataaaggcacttttacctcaaa

SEQ ID NO: 5916 - DNA, 545 bp, Homo sapiens
ggaaccgagttcccaggccggacgcgcggtggcctgacggtcgcaaggattacattcgcctgacccggcccggcttgaccctgcccgggcgcgccatgttcgcgcgtgggtcccggaggcgccgctccgggcgtgcgcctccagaggcagaggacccagaccggggccagccctgcaactcctgtagggagcagtgccctggcttcctgctccacggctggagaaagatctgccagcattgcaaatgcccgcgggaggagcatgcagtgcacgcggtgcctgtggacctggaacgcatcatgtgtcggctaatctcggacttccagcgccactccatctccgacgacgactcaggctgtgcatcggaggagtatgcctgggtgcccccaggccttaagccggagcaggtgaccagaggccagccctccactcttgctgtccagtgggtgcacactaatgctcacacacacacacacactcaggtgggaacctatttctggggctacgctagagtgtgcagtcagaccgagggtccttctggcccc

SEQ ID NO: 5917 - DNA, 990 bp, Homo sapiens
cccgcctctgcctcggttgtgtcccgctcccccgcactctgggcgctgtcccagcctgcccagcgctgcccagcctccagaggcagaggacccagaccggggccagccctgcaactcctgtagggagcagtgccctggcttcctgctccacggctggagaaagatctgccagcattgcaaatgcccgcgggaggagcatgcagtgcacgcggtgcctgtggacctggaacgcatcatgtgtcggctaatctcggacttccagcgccactccatctccgacgacgactcaggctgtgcatcggaggagtatgcctgggtgcccccaggccttaagccggagcaggtatatcaatttttcagctgcctcccagaggacaaggtcccctacgtcaacagtcctggggagaaatacaggatcaagcagctgctgcaccagctgcccccacacgacagtgaggcacagtactgcacagcactggaagaggaggaaaagaaagagctccgagcctttagccagcagcggaagcgggagaatctggggcgtggcatcgtgcgcatcttcccggtgaccatcactggggccatctgtgaggagtgcggaaagcagattggaggtggggacatcgcagtgtttgccagccgtgcaggcctgggtgcctgctggcacccacagtgcttcgtgtgtaccacgtgccaggaactgctggttgacctcatctacttctaccatgttggcaaggtctactgcgggcgtcaccatgccgaatgcctgcgtccacgctgccaagcctgtgacgagatcatcttctcccctgagtgcacggaggctgagggccgccactggcacatggatcacttctgctgctttgagtgtgaagcttcactaggagggcagcgctatgtcatgcgtcagagccgcccccactgctgcgcctgctacgaggcccgccacgcggagtactgtgatggctgtggggagcacatcggtgg

SEQ ID NO: 5918 - DNA, 1937 bp, Homo sapiens
agtggaggggcgggcgttgacttctccttccctgcttccgcgcctcacccggccctgcatctgcccccgcccactgcagcctccagaggcagaggacccagaccggggccagccctgcaactcctgtagggagcagtgccctggcttcctgctccacggctggagaaagatctgccagcattgcaaatgcccgcgggaggagcatgcagtgcacgcggtgcctgtggacctggaacgcatcatgtgtcggctaatctcggacttccagcgccactccatctccgacgacgactcaggctgtgcatcggaggagtatgcctgggtgcccccaggccttaagccggagcaggtatatcaatttttcagctgcctcccagaggacaaggtcccctacgtcaacagtcctggggagaaatacaggatcaagcagctgctgcaccagctgcccccacacgacagtgaggcacagtactgcacagcactggaagaggaggaaaagaaagagctccgagcctttagccagcagcggaagcgggagaatctggggcgtggcatcgtgcgcatcttcccggtgaccatcactggggccatctgtgaggagtgcggaaagcagattggaggtggggacatcgcagtgtttgccagccgtgcaggcctgggtgcctgctggcacccacagtgcttcgtgtgtaccacgtgccaggaactgctggttgacctcatctacttctaccatgttggcaaggtctactgcgggcgtcaccatgccgaatgcctgcgtccacgctgccaagcctgtgacgagatcatcttctcccctgagtgcacggaggctgagggccgccactggcacatggatcacttctgctgctttgagtgtgaagcttcactaggagggcagcgctatgtcatgcgtcagagccgcccccactgctgcgcctgctacgaggcccgccacgcggagtactgtgatggctgtggggagcacatcggcctggaccaaggccagatggcttacgagggccagcactggcatgcctcagaccgctgcttctgctgtagtcgctgtgggcgggccctgctgggccgcccattcctgccacgccgaggcctaatcttctgctctcgagcctgcagccttgggtccgagcccacagctccagggccgagccgccgcagctggagtgccggccctgtcacagccccacttgcagcctccacagcctctttctctgctgtgaagggggcatcagagaccaccaccaaaggcaccagcacagagttagcgccagctacaggccctgaggagccctcccgctttctgagaggggctccccaccgccactccatgccggaactggggctccgcagtgtccccgagccgcccccagagtcccccggccagcctaacctgcgcccagatgatagtgccttcggtcgtcagagcaccccacgcgtcagcttccgcgaccctctggtgtctgaaggaggcccgcgccggaccctgagtgcacccccggcccagcgccgcaggccacgcagtcccccacccagggcccccagccgtcgccgccaccatcatcataatcaccatcaccatcacaaccgccacccaagcagacgtcgccactatcaatgtgacgcgggatcagggtcagactcggaatcttgctccagctcgccctccagttccagttccgaatcatcagaggatgatggcttcttcctaggagagcgcatccctctgcccccgcatttgtgcaggcccatgcctgctcaggacactgcaatggagaccttcaactccccatctttatcgctccccagggactctcgcgcagggatgcctcgtcaggcccgagacaagaactgcatcgtggcttgaaggcaggccgtcctggagggggctccattctccagtcagagtagatgatgag

SEQ ID NO: 5919 - DNA, 2244 bp, Homo sapiens
ctctgcctcggttgtgtcccgctcccccgcactctgggcgctgtcccagcctgcccagcgctgcccagcctccagaggcagaggacccagaccggggccagccctgcaactcctgtagggagcagtgccctggcttcctgctccacggctggagaaagatctgccagcattgcaaatgcccgcgggaggagcatgcagtgcacgcggtgcctgtggacctggaacgcatcatgtgtcggctaatctcggacttccagcgccactccatctccgacgacgactcaggctgtgcatcggaggagtatgcctgggtgcccccaggccttaagccggagcaggtgaccagaggccagccctccactcttgctgtccagtgggtgcacactaatgctcacacacacacacacactcaggcacagtactgcacagcactggaagaggaggaaaagaaagagctccgagcctttagccagcagcggaagcgggagaatctggggcgtggcatcgtgcgcatcttcccggtgaccatcactggggccatctgtgaggagtgcggaaagcagattggaggtggggacatcgcagtgtttgccagccgtgcaggcctgggtgcctgctggcacccacagtgcttcgtgtgtaccacgtgccaggaactgctggttgacctcatctacttctaccatgttggcaaggtctactgcgggcgtcaccatgccgaatgcctgcgtccacgctgccaagcctgtgacgagatcatcttctcccctgagtgcacggaggctgagggccgccactggcacatggatcacttctgctgctttgagtgtgaagcttcactaggagggcagcgctatgtcatgcgtcagagccgcccccactgctgcgcctgctacgaggcccgccacgcggagtactgtgatggctgtggggagcacatcggcctggaccaaggccagatggcttacgagggccagcactggcatgcctcagaccgctgcttctgctgtagtcgctgtgggcgggccctgctgggccgcccattcctgccacgccgaggcctaatcttctgctctcgagcctgcagccttgggtccgagcccacagctccagggccgagccgccgcagctggagtgccggccctgtcacagccccacttgcagcctccacagcctctttctctgctgtgaagggggcatcagagaccaccaccaaaggcaccagcacagagttagcgccagctacaggccctgaggagccctcccgctttctgagaggggctccccaccgccactccatgccggaactggggctccgcagtgtccccgagccgcccccagagtcccccggccagcctaacctgcgcccagatgatagtgccttcggtcgtcagagcaccccacgcgtcagcttccgcgaccctctggtgtctgaaggaggcccgcgccggaccctgagtgcacccccggcccagcgccgcaggccacgcagtcccccacccagggcccccagccgtcgccgccaccatcatcataatcaccatcaccatcacaaccgccacccaagcagacgtcgccactatcaatgtgacgcgggatcagggtcagactcggaatcttgctccagctcgccctccagttccagttccgaatcatcagaggatgatggcttcttcctaggagagcgcatccctctgcccccgcatttgtgcaggcccatgcctgctcaggacactgcaatggagaccttcaactccccatctttatcgctccccagggactctcgcgcagggatgcctcgtcaggcccgagacaagaactgcatcgtggcttgaaggcaggccgtcctggagggggctccattctccagtcagagtagatgatgaggcccatgcccctcacccccacgccccgcccctacaacctaagtcataaatcctcttcctccctcctttatcagtttgtttctatttttgtttctgttttagagacttggtctaccctattgcccaggctggagtgcagtggtgtgatcagggctcactgcagcctcaaaagttttgggctcaagctatcctcccacctcagcctcccaagtagctgggactccaggctcgtgtcagcgttcccagctaattttttaattttttggtagagatggggttttgccatgttgcccaggctggtctagaactcctgggctcaagcaatcctcccgcagcctcccaaaggactgggattaca

SEQ ID NO: 5920 - DNA, 1392 bp, Homo sapiens
gcgcggtggcctgacggtcgcaaggattacattcgcctgacccggcccggcttgaccctgcccgggcgcgccatgttcgcgcgtgggtcccggaggcgccgctccgggcgtgcgcctccagaggcagaggacccagaccggggccagccctgcaactcctgtagggagcagtgccctggcttcctgctccacggctggagaaagatctgccagcattgcaaatgcccgcgggaggagcatgcagtgcacgcggtgcctgtggacctggaacgcatcatgtgtcggctaatctcggacttccagcgccactccatctccgacgacgactcaggctgtgcatcggaggagtatgcctgggtgcccccaggccttaagccggagcaggtgaccagaggccagccctccactcttgctgtccagtgggtgcacactaatgctcacacacacacacacactcaggcacagtactgcacagcactggaagaggaggaaaagaaagagctccgagcctttagccagcagcggaagcgggagaatctggggcgtggcatcgtgcgcatcttcccggtgaccatcactggggccatctgtgaggagtgcggaaagcagattggaggtggggacatcgcagtgtttgccagccgtgcaggcctgggtgcctgctggcacccacagtgcttcgtgtgtaccacgtgccaggaactgctggttgacctcatctacttctaccatgttggcaaggtctactgcgggcgtcaccatgccgaatgcctgcgtccacgctgccaagcctgtgacgagatcatcttctcccctgagtgcacgcctggaccaaggccaggccctgaggagccctcccgctttctgagaggggctccccaccgccactccatgccggaactggggctccgcagtgtccccgagccgcccccagagtcccccggccagcctaacctgcgcccagatgatagtgccttcggtcgtcagagcaccccacgcgtcagcttccgcgaccctctggtgtctgaaggaggcccgcgccggaccctgagtgcacccccggcccagcgccgtcgccgccaccatcatcataatcaccatcaccatcacaaccgccacccaagcagacgtcgccactatcaatgtgacgcgggatcagggtcagactcggaatcttgctccagctcgccctccagttccagttccgaatcatcagaggatgatggcttcttcctaggagagcgcatccctctgcccccgcatttgtgcaggcccatgcctgctcaggacactgcaatggagaccttcaactccccatctttatcgctccccagggactctcgcgcagggatgcctcgtcaggcccgagacaagaactgcatcgtggcttga

SEQ ID NO: 5921 - DNA, 2148 bp, Homo sapiens
cccgctcccccgcactctgggcgctgtcccagcctgcccagcgctgcccagcctccagaggcagaggacccagaccggggccagccctgcaactcctgtagggagcagtgccctggcttcctgctccacggctggagaaagatctgccagcattgcaaatgcccgcgggaggagcatgcagtgcacgcggtgcctgtggacctggaacgcatcatgtgtcggctaatctcggacttccagcgccactccatctccgacgacgactcaggctgtgcatcggaggagtatgcctgggtgcccccaggccttaagccggagcaggtatatcaatttttcagctgcctcccagaggacaaggtcccctacgtcaacagtcctggggagaaatacaggatcaagcagctgctgcaccagctgcccccacacgacagtgaggcacagtactgcacagcactggaagaggaggaaaagaaagagctccgagcctttagccagcagcggaagcgggagaatctggggcgtggcatcgtgcgcatcttcccggtgaccatcactggggccatctgtgaggagtgcggaaagcagattggaggtggggacatcgcagtgtttgccagccgtgcaggcctgggtgcctgctggcacccacagtgcttcgtgtgtaccacgtgccaggaactgctggttgacctcatctacttctaccatgttggcaaggtctactgcgggcgtcaccatgccgaatgcctgcgtccacgctgccaagcctgtgacgagatcatcttctcccctgagtgcacggaggctgagggccgccactggcacatggatcacttctgctgctttgagtgtgaagcttcactaggagggcagcgctatgtcatgcgtcagagccgcccccactgctgcgcctgctacgaggcccgccacgcggagtactgtgatggctgtggggagcacatcggcctggaccaaggccagatggcttacgagggccagcactggcatgcctcagaccgctgcttctgctgtagtcgctgtgggcgggccctgctgggccgcccattcctgccacgccgaggcctaatcttctgctctcgagcctgcagccttgggtccgagcccacagctccagggccgagccgccgcagctggagtgccggccctgtcacagccccacttgcagcctccacagcctctttctctgctgtgaagggggcatcagagaccaccaccaaaggcaccagcacagagttagcgccagctacaggccctgaggagccctcccgctttctgagaggggctccccaccgccactccatgccggaactggggctccgcagtgtccccgagccgcccccagagtcccccggccagcctaacctgcgcccagatgatagtgccttcggtcgtcagagcaccccacgcgtcagcttccgcgaccctctggtgtctgaaggaggcccgcgccggaccctgagtgcacccccggcccagcgccgcaggccacgcagtcccccacccagggcccccagccgtcgccgccaccatcatcataatcaccatcaccatcacaaccgccacccaagcagacgtcgccactatcaatgtgacgcgggatcagggtcagactcggaatcttgctccagctcgccctccagttccagttccgaatcatcagaggatgatggcttcttcctaggagagcgcatccctctgcccccgcatttgtgcaggcccatgcctgctcaggacactgcaatggagaccttcaactccccatctttatcgctccccagggactctcgcgcagggatgcctcgtcaggcccgagacaagaactgcatcgtggcttgaaggcaggccgtcctggagggggctccattctccagtcagagtagatgatgaggcccatgcccctcacccccacgccccgcccctacaacctaagtcataaatcctcttcctccctcctttatcagtttgtttctatttttgtttctgttttagagacttggtctaccctattgcccaggctggagtgcagtggtgtgatcagggctcactgcagcctcaaaagttttgggctcaagctatcctcccacctcagcctcccaagtagctgggactccaggctcgtgtcagcgt

SEQ ID NO: 5922 - DNA, 2985 bp, Homo sapiens
gtccgcgtcgtcatggcgacgctccgagcgggcgccggcgctggcgccggccgaatccggcccgggaaccacctccagggacatgacctttggctctaaaaagaagactccatttttcatgataaaatggcagtggtgaaaacccccagcagaggactaaagaatgctaaagaaccctttaataatgcatcaccccatctcttgaagaacctagtggaggagccgaaaaaaagaaaagaagtacctaatcacctcctagaatcaaaggtttatgcaaaacttgtgaataataaggtcatacaggcaagacctggcataatacattttggaggctatcaagtagaaaaacaacaccaacagattctgcatctggtcaatgtttccaatgaagacacacgtgttcatattttacccccgcaaaccaaatactttgagatcaattatgtaagaaaggaacaccacctggtccctggcttgtccctcacggtcaccgttacattttctccagatgagtggcgatactattatgactgcatccgtgttcactgtaagggagatgacactttgcttgttcctattcatgcctatccagtcatgaactcactagactttccttcatttataaatctgtcaaatgttctacttggtgaaagcaaaacttatgttattcctttgcagtgcagctgccctgtagattttgagttttatatcaccttgattcagtctcatcaagcctttgctattgagccaacatcaggaataattccggctaatgggaagatgactgtgactattaagtttacaccctttcagtatgggactgcacaaataaaaatgcagttatggatttcgcagttcaactctcaaccatacgaatgtgtcttcaccggaacatgctatcccaacatggccttacccagcctaagtcaactgtaggatattagtgtggcctgctgaacccaaatcctgcaaataaccatcattgaaatcactcgggcaacaaacaagtagaactgaacacaaattttaaaactgctgatttttctggtggcaaataagcagattagaagagtttgaaaggttgaataccctttctaagaaagtaaacgttcctccagaaaaagcaatgatgcatataaattttcaccgaccgccagcgaagccgaagcctcagaaggtgaaggaaattgagtaccagaacctcagatttccagtagatttatcgaatccatttgctgtggcaactgttttaaaccaagaaccaggaaaattgaagattaaagaattaagagaagttttggaccagggcactgaaatttcaaaaacgagacagatgaaggaggcactctttgaacagaaagtcagacaggacattcacgaagagatggaaaatcatcttaagtggcaggtgcaccttggtaaagatcctatgtcttttaaacttaaaaaagagcttactgaagagtggcaaaaagcatgtgccaaatataagctagacagaggagatcctattttggatgaggaatttcagcgacttaaaacagaagttagccataaacgggttgttcgcaatcaagaagagaaaatcaaggaatttcatcctacttttgatccactcattaataacacttggctcagcaggtccagggcacaaaaacggtttcaacaagtagcacgcaaggtcatgattcagggacgattattcaatatgctgagtgctgttcgtgaaatggacaaagagagtatactgagaaagattggccaagcaaaacaatcgatagcacaagaggcgaatttcttcaaattcttcctgaggcggatcagtcaggatgattataccagccggttctctgtgtcgcccaaggaggtgctgcccttcgctttcccagactgcagcccaccccaggactccaacgagttggctcctgatggccttggactggtcccaattaagtcttcagaagttcaaatcaagcagagttattccttcttcaatctgcaggttcctcaactgtacaaaattaagagatatcagccattctctgtccacaagtcttcaacaagttacagacctcaaaagcttgcccgagccctaaagcaaggagctgaggatgaagtcaccaccatcacagcccttccgaaacaggactccacaactcagctctctggcaaaacatcagtcttgagcatgaaaccacctgaggccttagccatgtctctagattatgatcctctgtatgtttttaatcccaacccaggattatttgctgtaatgcatcctctgacctatgcagaaacgttgatagattaccatctatgctctcaccccaagtacaaattcaccaaagagtcccgccacgggtccagcattcctgtcacccaaaagcagtttctccatcacacggacattattcccggaataatgcactggaaaagcttccagtccctggttctctcctccctgccggacccctccaagatggagaccacaaagagctgcgattccttcaattcatttatgcttccgatagacgtccctgccatccttgatgccttaccagaagaggacagactagaaacagtagaacgtgagctctgtgagcagaatgtagaagttatgttgactccagaaatgatcaaagtggaattccctatgttgaactacaaggacatcaggaaggagaaagaagtgaaagatcaagcacaaccagcagagaaggccggagagaagctgctcgaggagatgaggaacctgcggggcaaagcactcaacacatacctgattctagaatgaaagtcaccagtaggtcagtcccttccatttgctttccgtgggccactgtggccccttgcgtccatttacatgccagccatctctgcaattaaagtttctggataaaaaaatgaaatgtagaggatgtatatatcttttaagtgataattataaatcttatatttaaaaataaaatggagttaggatgatga

SEQ ID NO: 5923 - DNA, 2822 bp, Homo sapiens
gacgctccgagcgggcgccggcgctggcgccggccgaatccggcccgggaaccacctccagggacatgacctttggctctaaaaagaagactccatttttcatgataaaatggcagtggtgaaaacccccagcagaggactaaagaatgctaaagaaccctttaataatgcatcaccccatctcttgaagaacctagtggaggagccgaaaaaaagaaaagaagtacctaatcacctcctagaatcaaaggtttatgcaaaacttgtgaataataaggtcatacaggcaagacctggcataatacattttggaggctatcaagtagaaaaacaacaccaacagattctgcatctggtcaatgtttccaatgaagacacacgtgttcatattttacccccgcaaaccaaatactttgagatcaattatgtaagaaaggaacaccacctggtccctggcttgtccctcacggtcaccgttacattttctccagatgagtggcgatactattatgactgcatccgtgttcactgtaagggagatgacactttgcttgttcctattcatgcctatccagtcatgaactcactagactttccttcatttataaatctgtcaaatgttctacttggtgaaagcaaaacttatgttattcctttgcagtgcagctgccctgtagattttgagttttatatcaccttgattcagtctcatcaagcctttgctattgagccaacatcaggaataattccggctaatgggaagatgactgtgactattaagtttacaccctttcagtatgggactgcacaaataaaaatgcagttatggatttcgcagttcaactctcaaccatacgaatgtgtcttcaccggaacatgctatcccaacatggccttaccattagaagagtttgaaaggttgaataccctttctaagaaagtaaacgttcctccagaaaaagcaatgatgcatataaattttcaccgaccgccagcgaagccgaagcctcagaaggtgaaggaaattgagtaccagaacctcagatttccagtagatttatcgaatccatttgctgtggcaactgttttaaaccaagaaccaggaaaattgaagattaaagaattaagagaagttttggaccagggcactgaaatttcaaaaacgagacagatgaaggaggcactctttgaacagaaagtcagacaggacattcacgaagagatggaaaatcatcttaagtggcaggtgcaccttggtaaagatcctatgtcttttaaacttaaaaaagagcttactgaagagtggcaaaaagcatgtgccaaatataagctagacagaggagatcctattttggatgaggaatttcagcgacttaaaacagaagttagccataaacgggttgttcgcaatcaagaagagaaaatcaaggaatttcatcctacttttgatccactcattaataacacttggctcagcaggtccagggcacaaaaacggtttcaacaagtagcacgcaaggtcatgattcagggacgattattcaatatgctgagtgctgttcgtgaaatggacaaagagagtatactgagaaagattggccaagcaaaacaatcgatagcacaagaggcgaatttcttcaaattcttcctgaggcggatcagtcaggatgattataccagccggttctctgtgtcgcccaaggaggtgctgcccttcgctttcccagactgcagcccaccccaggactccaacgagttggctcctgatggccttggactggtcccaattaagtcttcagaagttcaaatcaagcagagttattccttcttcaatctgcaggttcctcaactgtacaaaattaagagatatcagccattctctgtccacaagtcttcaacaagttacagacctcaaaagcttgcccgagccctaaagcaaggagctgaggatgaagtcaccaccatcacagcccttccgaaacaggactccacaactcagctctctggcaaaacatcagtcttgagcatgaaaccacctgaggccttagccatgtctctagattatgatcctctgtatgtttttaatcccaacccaggattatttgctgtaatgcatcctctgacctatgcagaaacgttgatagattaccatctatgctctcaccccaagtacaaattcaccaaagagtcccgccacgggtccagcattcctgtcacccaaaagcagtttctccatcacacggacattattcccggaataatgcactggaaaagcttccagtccctggttctctcctccctgccggacccctccaagatggagaccacaaagagctgcgattccttcaattcatttatgcttccgatagacgtccctgccatccttgatgccttaccagaagaggacagactagaaacagtagaacgtgagctctgtgagcagaatgtagaagttatgttgactccagaaatgatcaaagtggaattccctatgttgaactacaaggacatcaggaaggagaaagaagtgaaagatcaagcacaaccagcagagaaggccggagagaagctgctcgaggagatgaggaacctgcggggcaaagcactcaacacatacctgattctagaatgaaagtcaccagtaggtcagtcccttccatttgctttccgtgggccactgtggccccttgcgtccatttacatgccagccatctctgcaattaaagtttctggataaaaaaatgaaatgtagaggatgtatatatcttttaagtgataattataaatcttatatttaaaaataaaatggagttaggatgatg

SEQ ID NO: 5924 - DNA, 673 bp, Homo sapiens
gacgctccgagcgggcgccggcgctggcgccggccgaatccggcccgggaaccacctccagggacatgacctttggctctaaaaagaagactccatttttcatgataaaatggcagtggtgaaaacccccagcagaggactaaagaatgctaaagaaccctttaataatgcatcaccccatctcttgaagaacctagtggaggagccgaaaaaaagaaaagaagtacctaatcacctcctagaatcaaaggtttatgcaaaacttgtgaataataaggtcatacaggcaagacctggcataatacattttggaggctatcaagtagaaaaacaacaccaacagattctgcatctggtcaatgtttccaatgaagacacacgtgttcatattttacccccgcaaaccaaatactttgagatcaattatgtaagaaaggaacaccacctggtccctggcttgtccctcacggtcaccgttacattttctccagatgagtggcgatactattatgactgcatccgtgttcactgtaagggagatgacactttgcttgttcctattcatgcctatccagtcatgaactcactagactttccttcatttataaatctgtcaaatgttctacttggtgaaagtttacccaacagcgtcttcctggtaccagataactag

SEQ ID NO: 5925 - DNA, 3294 bp, Homo sapiens
ttcatcctacttttgatccactcattaataacacttggctcagcaggtccagggcacaaaaacggtttcaacaagtagcacgcaaggtcatgattcagggacgattattcaatatgctgagtgctgttcgtgaaatggacaaagagagtatactgagaaagattggccaagcaaaacaatcgatagcacaagaggcgaatttcttcaaattcttcctgaggcggatcagtcaggatgattataccagccggttctctgtgtcgcccaaggaggtgctgcccttcgctttcccagactgcagcccaccccaggactccaacgagttggctcctgatggccttggactggtcccaattaagtcttcagaagttcaaatcaagcagagttattccttcttcaatctgcaggttcctcaactgtacaaaattaagagatatcagccattctctgtccacaagtcttcaacaagttacagacctcaaaagcttgcccgagccctaaagcaaggagctgaggatgaagtcaccaccatcacagcccttccgaaacaggactccacaactcagctctctggcaaaacatcagtcttgagcatgaaaccacctgaggccttagccatgtctctagattatgatcctctgtatgtttttaatcccaacccaggattatttgctgtaatgcatcctctgacctatgcagaaacgttgatagattaccatctatgctctcaccccaagtacaaattcaccaaagagtcccgccacgggtccagcattcctgtcacccaaaagcagtttctccatcacacggacattattcccggaataatgcactggaaaagcttccagtccctggttctctcctccctgccggacccctccaagatggagaccacaaagagctgcgattccttcaattcatttatgcttccgatagacgtccctgccatccttgatgccttaccagaagaggacagactagaaacagtagaacgtgagctctgtgagcagaatgtagaagttatgttgactccagaaatgatcaaagtggaattccctatgttgaactacaaggacatcaggaaggagaaagaagtgaaagatcaagcacaaccagcagagaaggccggagagaagctgctcgaggagatgaggaacctgcggggcaaagcactcaacacatacctgattctagaatgaaagtcaccagtaggttgaaaaggtcgtggccccttggaaagattgtattgactgtgttggggatctggtgccacctggtggttgccacaagaaaggcctctcctgactcccaagttgtaacccgtttccaccaaatcgacttccaaataatatttatcagatcatcatctgtgcttttcttccttgtttcagaccacttttaggtggaaaaggcaaagaaggcttatatgtattttcttccataatgagtccatcagaaaaagttccttcggtgaaatcgttgaccacgtgatgtttggggactccctatgggatcaatcatccgggttccttagagaccatggccataatcaggggctggccaagggaatgagtatccctgggttcaacagctgtttctgaagacctgccagttcccctgtcttgcattaactcgggttatcatgccattctccttctaaggccaaagatacctgtaaccgaagaatcgggatacttcactgcagtcacttcatttttttttcttttgaggcagagtcttgctctgtcacctaggctggagtgcagtggcacaatctcggctcactgcaacctctgcctcccaggttccagcgattctcctgcctcagcctctcaagtagctgggattacagggacccgccaccacgcccggctaatttttctatttttagtacagatggggtttcaccatattggccaggcttgtctcaaactcctgacttcaagtgatccacccgcctcagcctctcaaagtgctgggattacaggcatgagccaccatgcctggccaagcagcttcattttagaagtgattattattgctttcctttctagaacttccggtttgtgaagtattttctcaatgatcctcaaaacattctaagacataaagtagctgttattagtgtgattttatgcagaaactcaggcccagaaagcttcatggacttacccaattagcagaagagccaggtttgggcaggatcttggtttcctgcaaaggtttcgttgcctagccaggcgtggtggtgtgtacctgtagtcccagctacctggggggctggggtgggaggctcacctgagcccaggtagtcaaggctgcagtgagccatgatcctggtacccagtccactcttctctctactacatggtaatcaatgaaaatattacagatttacattttttaactttttatttaaactttcagctttggagtctctaagagtaaagatattatgtgatgatatttgtattttacttaattgcttattctttaaaacatgtaatatagaaaaaaatacaaattagcaaatgtcctttgctctaaagaaatcagctggcaagtttgccccacccagcagcagccatgtcttactcatttctgtatccccagcatgcagcaagatgtttggcacaatgcaggctctcaataaatgttttttgaggctgggtatggtggctcacacctgtagtccctgcactttgggaggctgaggcaggtagatcccttgagcccaggagttcaagaccaccctgggcaacatggtgaaaacctgcctctacaaaaaacacaaaaattggccgggcatggtggcccatgcccagctacttgggaggctgaggtggaaggatcacttgagcctgagaggtcaaggctgcagtaagccgacattatgccaccacactccagcctgggcaacagagcaagaccctgtctcaattttttaaaaattggctaggtgcagtggctcatgtctgtaatcccagcaccttaggagaccgaggtggacggattgcttgagctcaggcattcaagaccagcctgggcaacatggcaaaaccccatctctacaaaaaatacaaaaaagattagccaggtgtgttggtgcacatctgtggtcccagctactggggagggtaagatggaaggatcacttgaccccaggaggctgaggctgcagtgagccaagattgtgccactgcactccagcctgggcaacagagcaagaccctgtctcaaaacaatagcaataatgtttgttgaattaaggaatataaaagaaatgtgaaaact

SEQ ID NO: 5926 - DNA, 2967 bp, Homo sapiens
gacgctccgagcgggcgccggcgctggcgccggccgaatccggcccgggaaccacctccagggacatgacctttggctctaaaaagaagactccatttttcatgataaaatggcagtggtgaaaacccccagcagaggactaaagaatgctaaagaaccctttaataatgcatcaccccatctcttgaagaacctagtggaggagccgaaaaaaagaaaagaagtacctaatcacctcctagaatcaaaggtttatgcaaaacttgtgaataataaggtcatacaggcaagacctggcataatacattttggaggctatcaagtagaaaaacaacaccaacagattctgcatctggtcaatgtttccaatgaagacacacgtgttcatattttacccccgcaaaccaaatactttgagatcaattatgtaagaaaggaacaccacctggtccctggcttgtccctcacggtcaccgttacattttctccagatgagtggcgatactattatgactgcatccgtgttcactgtaagggagatgacactttgcttgttcctattcatgcctatccagtcatgaactcactagactttccttcatttataaatctgtcaaatgttctacttggtgaaagcaaaacttatgttattcctttgcagtgcagctgccctgtagattttgagttttatatcaccttgattcagtctcatcaagcctttgctattgagccaacatcaggaataattccggctaatgggaagatgactgtgactattaagtttacaccctttcagtatgggactgcacaaataaaaatgcagttatggatttcgcagttcaactctcaaccatacgaatgtgtcttcaccggaacatgctatcccaacatggccttacccagcctaagtcaactgtaggatattagtgtggcctgctgaacccaaatcctgcaaataaccatcattgaaatcactcgggcaacaaacaagtagaactgaacacaaattttaaaactgctgatttttctggtggcaaataagcagattagaagagtttgaaaggttgaataccctttctaagaaagtaaacgttcctccagaaaaagcaatgatgcatataaattttcaccgaccgccagcgaagccgaagcctcagaaggtgaaggaaattgagtaccagaacctcagatttccagtagatttatcgaatccatttgctgtggcaactgttttaaaccaagaaccaggaaaattgaagattaaagaattaagagaagttttggaccagggcactgaaatttcaaaaacgagacagatgaaggaggcactctttgaacagaaagtcagacaggacattcacgaagagatggaaaatcatcttaagtggcaggtgcaccttggtaaagatcctatgtcttttaaacttaaaaaagagcttactgaagagtggcaaaaagcatgtgccaaatataagctagacagaggagatcctattttggatgaggaatttcagcgacttaaaacagaagttagccataaacgggttgttcgcaatcaagaagagaaaatcaaggaatttcatcctacttttgatccactcattaataacacttggctcagcaggtccagggcacaaaaacggtttcaacaagtagcacgcaaggtcatgattcagggacgattattcaatatgctgagtgctgttcgtgaaatggacaaagagagtatactgagaaagattggccaagcaaaacaatcgatagcacaagaggcgaatttcttcaaattcttcctgaggcggatcagtcaggatgattataccagccggttctctgtgtcgcccaaggaggtgctgcccttcgctttcccagactgcagcccaccccaggactccaacgagttggctcctgatggccttggactggtcccaattaagtcttcagaagttcaaatcaagcagagttattccttcttcaatctgcaggttcctcaactgtacaaaattaagagatatcagccattctctgtccacaagtcttcaacaagttacagacctcaaaagcttgcccgagccctaaagcaaggagctgaggatgaagtcaccaccatcacagcccttccgaaacaggactccacaactcagctctctggcaaaacatcagtcttgagcatgaaaccacctgaggccttagccatgtctctagattatgatcctctgtatgtttttaatcccaacccaggattatttgctgtaatgcatcctctgacctatgcagaaacgttgatagattaccatctatgctctcaccccaagtacaaattcaccaaagagtcccgccacgggtccagcattcctgtcacccaaaagcagtttctccatcacacggacattattcccggaataatgcactggaaaagcttccagtccctggttctctcctccctgccggacccctccaagatggagaccacaaagagctgcgattccttcaattcatttatgcttccgatagacgtccctgccatccttgatgccttaccagaagaggacagactagaaacagtagaacgtgagctctgtgagcagaatgtagaagttatgttgactccagaaatgatcaaagtggaattccctatgttgaactacaaggacatcaggaaggagaaagaagtgaaagatcaagcacaaccagcagagaaggccggagagaagctgctcgaggagatgaggaacctgcggggcaaagcactcaacacatacctgattctagaatgaaagtcaccagtaggtcagtcccttccatttgctttccgtgggccactgtggccccttgcgtccatttacatgccagccatctctgcaattaaagtttctggataaaaaaatgaaatgtagaggatgtatatatcttttaagtgataattataaatcttatatttaaaaataaaatggagttaggatgatg

SEQ ID NO: 5927 - DNA, 3430 bp, Homo sapiens
ctgcgcctcttcaggtcatcgcttgctctcgttcccaggctttggcctctagtggacgagaatcaccgagtctgcggggctggacgctgactgcccgggccagcacctaggcgggcgggagctgtgcggcccagggttcacgcgggccgggtagaggctcgagccgggacccccgagcgtgaaccccggagccggcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacccccgcctggatttgccccgtaggcccggcccgggcccctcgggagcagaacagctttggtgaggtggacaggaggtgacctcgcgagcagacgcgcgcgccagcgacagcagcccgccccggcctctcgggagccgtggggcagaggctgcggagccccaggagggtgatttctgcctttgcaggccggagccctcatgacttcagtgacctgcttctgcccctctaggtctatcagccacagtctctgcaagtttccaagagcagcagaaaatgaacacattgcaggggccagtgtcattcaaagatgtggctgtggatttcacccaggaggagtggcagcaactggaccctgatgagaagatagcatacggggatgtgatgttggagaactacagccatctagtttctgtggggtatgattatcaccaagccaaacatcatcatggagtggaggtgaaggaagtggagcagggagaggagccgtggataatggaaggtgaatttccatgtcaacatagtccaggagattgtcagaaatggaggagggggcaccagatccaaggaagtgcccggacaaagccgggaggcgaggagagccgacggggaggaggtgccgagagcatcagcggggctgctcggtggcacgaagacgcccgcggggactggagaggtcggctagggccaggctactcaggcacggagggccacctccccttcagggacgtgagcatctagctgcactgatttgttgttcaggaacaggaaatgaaaccccgcagctttgaacacaataacccacgccagcctcaggctcatgaatattcagcaggctgcttgcgccttgcaaccccgcctccgttcccctctgcggagactgcgtatgcgtcgccggcgcgcggctgtgtcgtcatacttgcgcgccgacgccgccgctcgcttgtgaaactggaaggctgccatggctagcccagccgcctcctcggtgcgaccaccgaggcccaagaaagagccgcagacgctcgtcatccccaagaatgcggcggaggagcagaagctcaagctggagcggctcatgaagaacccggacaaagcagttccaattccagagaaaatgagtgaatgggcacctcgacctcccccagaatttgtccgagatgtcatgggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcgccggaagaagcgccagaagttaaaagagaagaaattactggcaaagaagatgaaacttgaacagaagaaacaagaaggacccggtcagcccaaggagcaggggtccagcagctctgcggaggcatctggaacagaggaggaggaggaagtgcccagtttcaccatggggcgatgacaatgtttgccacagcctctgcctggaacctggctcgtgctgtgaccagaagggaaaggcggctgtttggctctttctcccccgcaaggacccgctgacccgctggatggagagcaaaggagacccctcccgagccgctcacagtcctgtatttggcaggtttgggagcctgaggggccatctccctgacactcagaggcactgccttgcagacaccatccgtgctcctggtaaagggggacagagagcctcaccttgccacatatttgaacagtgatgagtttggggctggtttctgggaagggaacgtttatttagtaaagagcagaacacccttgcgttttgttgggacatgtggaccgtgagtcgcaaacactctggagaaggctgagatgccaccattcccacggggactgaagacacattacgtggacctggtcccaggctcagtgaggagatggcctcagctgtggggctggtccatgttgcccactcactccagtgggaagtggggaccacgccatagagggtctgctcccactgcagctcccggtgctctcgtgttctgggaaggcctgggtgtgtgcacaaggaggcccgggccagggacttcaccaggggctgggtcacaagggcacagggtgtgtggaaagcgctgtgggggaagagccggtcaccggagagtgagcaggcggagactccaagctgggctgagccagagcagaaggcgagggattcccagccggacgggggttctctcaccaacagctgtgatttcatcccgaagtggaagggggtctaaacagaacaggctgagagaggcgggactgggtcaagtgggtggagctcctccttgcatgactgcaactgtcggggctttccgccggctcacagcagttggggccagcggggagaagagaggcggaactgctgtgtcctcatgtggcgcagcctcaaactggcatccaggcactgggcccatgcagagaaggcacctgcagagagcagggcagcccggcgcaggggcatgcgcctagaatcccagctactcggaaggccaaggcaggaggaccgcttgagtccagggattcaaggccaacctgggcaatagagcgagaccctgtctcttaaaaaacgatgatgatgaacacagaggacggggcactgtgctgggagccagggggcctgggaggagccgagaccagccttttacctcggggttttgaggccaacagggacgacagagacagtttctagttagagccttggctccatttttggatgatttagccccgagttcctgagtctattttatgccccttacgtactttgatagaactaaggaaatagtggttttgagtgaagggaaaggaaacccagaaacattttacgttgcttttacttctgtagtgtagattgccccggcccctctctgagccctgtagcatctgtgatagcttctgtcccttcatcggttcatgtcacagggattttctttcccaggaagcggacacggagagtcagccctaataaatgagcacatgccctggctgtacattttgaaa

SEQ ID NO: 5928 - DNA, 902 bp, Homo sapiens
gccagccttacgggcccgaaccctcgtgtgaagggtgcagtacctaagccggagcggggtagaggcgggccggcacccccttctgacctccagtgccgccggcctcaagatcagacatggcccagaacttgaaggacttggcgggacggctgcccgccgggccccggggcatgggcacggccctgaagctgttgctgggggccggcgccgtggcctacggtgtgcgcgaatctgtgttcaccgtggaaggcgggcacagagccatcttcttcaatcggatcggtggagtgcagcaggacactatcctggccgagggccttcacttcaggatcccttggttccagtaccccattatctatgacattcgggccagacctcgaaaaatctcctcccctacaggctccaaagacctacagatggtgaatatctccctgcgagtgttgtctcgacccaatgctcaggagcttcctagcatgtaccagcgcctagggctggactacgaggaacgagtgttgccgtccattgtcaacgaggtgctcaagagtgtggtggccaagttcaatgcctcacagctgatcacccagcgggcccaggtatccctgttgatccgccgggagctgacagagagggccaaggacttcagcctcatcctggatgatgtggccatcacagagctgagctttagccgagagtacacagctgctgtagaagccaaacaagtggcactgagcaagaaccctggctacatcaaacttcgcaagattcgagcagcccagaatatctccaagacgatcgccacatcacagaatcgtatctatctcacagctgacaaccttgtgctgaacctacaggatgaaagtttcaccaggggaagtgacagcctcatcaagggtaagaaatga

SEQ ID NO: 5929 - DNA, 5141 bp, Homo sapiens
acaccaggaccccacctctggctttcaggaaagaggggcccaagctggcggcgcagtgttgagtttacttgggcgcgactggctttattgtaggtccccatgagctggtgggggctgtaggggtaaccaggcagggcgtctggcgctgttggggctgcgtttttccggagtccccctatgcgaggccgtgcccctcttcgcccggctcctggtgctccccagccgccggcccgctcccggaagctgcagcagctggtaacaaagagcctgccgggccgcctgctgccggggccgaggtatccaggagtcgggcggagcggctggggatgagcgcgagccggaccatgcgtccgggttcgcggcggtgagggtcgcggccggcggccgaggcgcaggtgcgggtcgagagaccggcgcctccctccccgccgcccgtggactctgagcgcaggtgtttctactctgccggccgctccacctgggaaagcgccttcaagagctacctctggcggcacctggccctcagctgcagggaaaccgcactcaaacctgccgccgagcccgggtttttctgcaaaactcagaggacctggctcttgcccgaggtgccctgaaccattgtgtgaataagctggggaagcctgactggagtgttttttctttttaataaaaagagtttttctgaatctcaatttttagaaattttttttgcgaagtttgcaatactctctacctcttcgcatcctctcttgctcgtggagtctttttcctcctcagctataaatattttttactatcggcggagcagaccagggatgaacgtcttttaattgcaagtataactgttaaaaccacgtcgggatagtagtcaagatggataaaaagtcctttgaaatggtgctggatgaaattagaaaggtggttgatttgctgagatatttttcctgggccgagccccagttgaaggcaatgaaagcattacagcataaaatggtggctgtccagccaacagaagtggtcaatatactcaactgtttcactttcagtaaagacaaactagttgctcttgaactgttagcctcgaacattattgatgcacagaattctcgtcctattgaagatttattcagggtaaatatgtctgagaagaaacggtgcaagagaatacttgaacaggctttcaaggggggctgcaaagctcctcatgctatgatatcttcttgtggaacaatcccaggaaatccatatcccaaaggaagacctagccgcataaatggaattttcccaggaactcctttgaaaaaagatggtgaagaatgtactaacgaaggcaaaggaatagctgcacgaattcttgggccatccaaaccacctccttcaacatataatccacataaacctgttccttatccgatacctccatgccgaccacatgcaactattgcaccaagtgcttataacaatgcaggtctggtaccattagcgaatgtcatagctccacctccacctccatatactcctaatcctgtaggaacagagaatgaagacctttcgaatccgtcaaaacctatacagaatcaaacattttccaccccagcaagtcaactcttttctcctcatggttctaatccttcaacacctgctgcaactcctgttcctactgcatccccagtcaaggcaattaatcatccatcagcatcagcagctgccaccgtttctggaatgaacctgctgaatactgtccttcctgtgttcccagggcaggtctcctcagccgttcacacacctcagccatcaataccaaacccaacagttatcagaaccccttcattgcccactgcacctgttacatccatccacagtacaaccaccactcctgttccttccattttttctggcctagtgtcactgccaggtccttctgccactcctaccgcagccactcctaccccaggacctacaccacggtccactcttggttccagtgaagcatttgcttctacttctgcacctttcactagcctccccttttccaccagctcttctgctgcttctaccagcaacccaaattctgcttcattgtcatcagtttttgcagggctccctttgcccttaccaccaacatcccaaggcctatccaacccgactcctgtaattgctggtggctctactcccagcgttgccggtccacttggtgtgaacagtcctcttttgtctgcgttaaaaggttttctgacatccaatgacaccaatttaatcaactcctctgctttatcctctgctgtcacaagtgggctggcttcactatcttctcttactcttcagaactctgactcttctgcttcagcccctaacaagtgctatgccccatcagccatccctaccccacagaggacttccactccagggttggccctgttcccaggcctgccgtctcccgtggctaactcaacttccactcccctgacattgcctgtacagtctcctttagccactgctgcatcagcttccacgtcagtgccagttagctgtggctcctcagcctcccttttgcgtggcccccacccaggtacctcagatctgcatatttcatctacccctgctgcaacaactcttcctgttatgatcaaaactgagcccacaagtcctactccctcggccttcaaaggtccatctcattctgggaatccctctcatggcactttaggtttgtcagggacattgggccgtgcatatacttcaacatccgtgcccatcagtttatctgcttgccttaatcctgcattgtcaggtctctccagcttgagtactcctttaaatggttcaaatcctctttcctctatttcccttccaccacatggttcctccactcccattgcaccagtattcactgctcttccttcttttacttctttgaccaacaattttcctttaactggcaacccatctcttaatccgtcagtatctctcccagggtcattaatagccacctcatctaccgctgccacctccacatctctccctcatcctagctcaacggcagctgttctctcagggctttctgcttcagcaccagtctcagcagcacctttccccctcaacctgtccactgctgttccctcacttttctctgttactcaaggacctctgtcatcttcaaatccctcctatccaggcttttctgtctctaataccccaagcgttacccctgctcttccctcattcccggggctgcaggcgccctctacagtcgcagctgtcacaccactacctgtggctgccacagccccatccccagctccagtcctcccaggattcgcctcagcattcagttccaatttcaactccgctcttgttgcacaagccggtttatcatctggacttcaagctgcaggcagttctgtttttccaggccttttgtccctcccgggtatccctgggtttcctcagaatccttcacaatcatccttgcaagaattacagcataatgcggctgcgcagtcagcattgttacagcaggtccattcagcttcggctctggaaagctatccagctcagcctgatgggtttcctagttatccttcagcgccaggaacaccattttctttgcaaccaagcctgtcccagagtgggtggcagtgaatacttttaacttttattctccttcagagcaacatcagaattgcctgagaactgcaatgaacaatctgacaaatgtgaagctggccaaaagtcggaaaatgagaatgagggtaatcctggagaaattgtgacaacaatttgaaaattgtggttgcattttaaagtgtgaacactcccctatgtaaatatgctgacaataaattgtatggagaatggtatttaaaaagtgtttggagacttttcacctgtcctataaaattttgaattgtgtatgtgatctacatagaaagaatattaaagagtaggttgaactctttatagccgaatacagccttaaatatgcttgtatagcatccactggcagaagtaatagttgtgcctcagacttgggggttgcatgtggccctgggggagttactacccttggtatgcatgagcggttcctattagcatcagtgggaactcagtactctgtatgtatccacaaaagggaacttgagacccacagttattcttaatttctgatattaacaaccgtacatactgctgaatttaactcaaaatatttcaggtaagtgaaagtggtgcttaatgtagactatagaatgactttcaggtgttttcaactgaaagtatatatccagaactgcatccttatagaaatacaagtaagacttaggataatttgccttcaaaacagttttcctaatctcagcagtatccagtgagtgaagaacacttgactgactcttgggccacctctgttacttactgtactatggaagctcctggtgaatgtttacaattatgggatgtagtatttctatttgtactttaagtcaaatgcttatatgaaatatgtgacaacaaatagagaagactggctctgttagtaattatgcagtatgtactctatttaaggatctgtggtagtataacatgagtgaatgtcattaattttgaagtaataactgccacatgtgggaagtaggggagtaaggagaatgaattccaatctgtgattaaaagtgtaaactatagactctactgtagtacatttcaggatctagaagttttacttttataaagatggtgtccggaagatgttgctaatgtattttacttcaacatagggaacaaactttttaagtatattaataaacctgtatggttagtttttaacagttttttaaaataaactatggatatgacaaatattctgtgttttactaagtgcttggataggctttctaattttgtatacgtgctagagttaattattgaacatttttatccaaatttagttgtaactctgtttatactactgattgctcattcgtttaaatgatattttaatgtaaaagtcataaccaacatatgaacagacagatttatgtctttaaacacagaatgtaagctatagtttaatctgataccagttgctggaagttgccatttgtttttcttaaatctatacccataaaacttcttttaagatt

SEQ ID NO: 5930 - DNA, 5168 bp, Homo sapiens
ccaagctggcggcgcagtgttgagtttacttgggcgcgactggctttattgtaggtccccatgagctggtgggggctgtaggggtaaccaggcagggcgtctggcgctgttggggctgcgtttttccggagtccccctatgcgaggccgtgcccctcttcgcccggctcctggtgctccccagccgccggcccgctcccggaagctgcagcagctggtaacaaagagcctgccgggccgcctgctgccggggccgaggtatccaggagtcgggcggagcggctggggatgagcgcgagccggaccatgcgtccgggttcgcggcggtgagggtcgcggccggcggccgaggcgcaggtgcgggtcgagagaccggcgcctccctccccgccgcccgtggactctgagcgcaggtgtttctactctgccggccgctccacctgggaaagcgccttcaagagctacctctggcggcacctggccctcagctgcagggaaaccgcactcaaacctgccgccgagcccgggtttttctgcaaaactcagaggacctggctcttgcccgaggtgccctgaaccattgtgtgaataagctggggaagcctgactggagtgttttttctttttaataaaaagagtttttctgaatctcaatttttagaaattttttttgcgaagtttgcaatactctctacctcttcgcatcctctcttgctcgtggagtctttttcctcctcagctataaatattttttactatcggcggagcagaccagggatgaacgtcttttaattgcaagtataactgttaaaaccacgtcgggatagtagtcaagatggataaaaagtcctttgaaatggtgctggatgaaattagaaaggctgttttgacagaatacaaattaaaagcaattgaatatgtgcatggatacttttctagtgaacaggtggttgatttgctgagatatttttcctgggccgagccccagttgaaggcaatgaaagcattacagcataaaatggtggctgtccagccaacagaagtggtcaatatactcaactgtttcactttcagtaaagacaaactagttgctcttgaactgttagcctcgaacattattgatgcacagaattctcgtcctattgaagatttattcagggtaaatatgtctgagaagaaacggtgcaagagaatacttgaacaggctttcaaggggggctgcaaagctcctcatgctatgatatcttcttgtggaacaatcccaggaaatccatatcccaaaggaagacctagccgcataaatggaattttcccaggaactcctttgaaaaaagatggtgaagaatgtactaacgaaggcaaaggaatagctgcacgaattcttgggccatccaaaccacctccttcaacatataatccacataaacctgttccttatccgatacctccatgccgaccacatgcaactattgcaccaagtgcttataacaatgcaggtctggtaccattagcgaatgtcatagctccacctccacctccatatactcctaatcctgtaggaacagagaatgaagacctttcgaatccgtcaaaacctatacagaatcaaacattttccaccccagcaagtcaactcttttctcctcatggttctaatccttcaacacctgctgcaactcctgttcctactgcatccccagtcaaggcaattaatcatccatcagcatcagcagctgccaccgtttctggaatgaacctgctgaatactgtccttcctgtgttcccagggcaggtctcctcagccgttcacacacctcagccatcaataccaaacccaacagttatcagaaccccttcattgcccactgcacctgttacatccatccacagtacaaccaccactcctgttccttccattttttctggcctagtgtcactgccaggtccttctgccactcctaccgcagccactcctaccccaggacctacaccacggtccactcttggttccagtgaagcatttgcttctacttctgcacctttcactagcctccccttttccaccagctcttctgctgcttctaccagcaacccaaattctgcttcattgtcatcagtttttgcagggctccctttgcccttaccaccaacatcccaaggcctatccaacccgactcctgtaattgctggtggctctactcccagcgttgccggtccacttggtgtgaacagtcctcttttgtctgcgttaaaaggttttctgacatccaatgacaccaatttaatcaactcctctgctttatcctctgctgtcacaagtgggctggcttcactatcttctcttactcttcagaactctgactcttctgcttcagcccctaacaagtgctatgccccatcagccatccctaccccacagaggacttccactccagggttggccctgttcccaggcctgccgtctcccgtggctaactcaacttccactcccctgacattgcctgtacagtctcctttagccactgctgcatcagcttccacgtcagtgccagttagctgtggctcctcagcctcccttttgcgtggcccccacccaggtacctcagatctgcatatttcatctacccctgctgcaacaactcttcctgttatgatcaaaactgagcccacaagtcctactccctcggccttcaaaggtccatctcattctgggaatccctctcatggcactttaggtttgtcagggacattgggccgtgcatatacttcaacatccgtgcccatcagtttatctgcttgccttaatcctgcattgtcaggtctctccagcttgagtactcctttaaatggttcaaatcctctttcctctatttcccttccaccacatggttcctccactcccattgcaccagtattcactgctcttccttcttttacttctttgaccaacaattttcctttaactggcaacccatctcttaatccgtcagtatctctcccagggtcattaatagccacctcatctaccgctgccacctccacatctctccctcatcctagctcaacggcagctgttctctcagggctttctgcttcagcaccagtctcagcagcacctttccccctcaacctgtccactgctgttccctcacttttctctgttactcaaggacctctgtcatcttcaaatccctcctatccaggcttttctgtctctaataccccaagcgttacccctgctcttccctcattcccggggctgcaggcgccctctacagtcgcagctgtcacaccactacctgtggctgccacagccccatccccagctccagtcctcccaggattcgcctcagcattcagttccaatttcaactccgctcttgttgcacaagccggtttatcatctggacttcaagctgcaggcagttctgtttttccaggccttttgtccctcccgggtatccctgggtttcctcagaatccttcacaatcatccttgcaagaattacagcataatgcggctgcgcagtcagcattgttacagcaggtccattcagcttcggctctggaaagctatccagctcagcctgatgggtttcctagttatccttcagcgccaggaacaccattttctttgcaaccaagcctgtcccagagtgggtggcagtgaatacttttaacttttattctccttcagagcaacatcagaattgcctgagaactgcaatgaacaatctgacaaatgtgaagctggccaaaagtcggaaaatgagaatgagggtaatcctggagaaattgtgacaacaatttgaaaattgtggttgcattttaaagtgtgaacactcccctatgtaaatatgctgacaataaattgtatggagaatggtatttaaaaagtgtttggagacttttcacctgtcctataaaattttgaattgtgtatgtgatctacatagaaagaatattaaagagtaggttgaactctttatagccgaatacagccttaaatatgcttgtatagcatccactggcagaagtaatagttgtgcctcagacttgggggttgcatgtggccctgggggagttactacccttggtatgcatgagcggttcctattagcatcagtgggaactcagtactctgtatgtatccacaaaagggaacttgagacccacagttattcttaatttctgatattaacaaccgtacatactgctgaatttaactcaaaatatttcaggtaagtgaaagtggtgcttaatgtagactatagaatgactttcaggtgttttcaactgaaagtatatatccagaactgcatccttatagaaatacaagtaagacttaggataatttgccttcaaaacagttttcctaatctcagcagtatccagtgagtgaagaacacttgactgactcttgggccacctctgttacttactgtactatggaagctcctggtgaatgtttacaattatgggatgtagtatttctatttgtactttaagtcaaatgcttatatgaaatatgtgacaacaaatagagaagactggctctgttagtaattatgcagtatgtactctatttaaggatctgtggtagtataacatgagtgaatgtcattaattttgaagtaataactgccacatgtgggaagtaggggagtaaggagaatgaattccaatctgtgattaaaagtgtaaactatagactctactgtagtacatttcaggatctagaagttttacttttataaagatggtgtccggaagatgttgctaatgtattttacttcaacatagggaacaaactttttaagtatattaataaacctgtatggttagtttttaacagttttttaaaataaactatggatatgacaaatattctgtgttttactaagtgcttggataggctttctaattttgtatacgtgctagagttaattattgaacatttttatccaaatttagttgtaactctgtttatactactgattgctcattcgtttaaatgatattttaatgtaaaagtcataaccaacatatgaacagacagatttatgtctttaaacacagaatgtaagctatagtttaatctgataccagttgctggaagttgccatttgtttttcttaaatctatacccataaaacttcttttaagatt

SEQ ID NO: 5931 - DNA, 3403 bp, Homo sapiens
acaggcagcctcatccgccatcactccgggaaccgagcaccccgctgcctcggcgcccaggctgctctctccgcgcatgctccttcccagcttgagcccgcgagtccagcctgccttcactcagtgcgcaagaccgcagccccctccccacgccccctccccagtaggcggccgtcgcggtgtgtttgcgtcatcgcgccacgccaccactggaacccgggggaagatggcggcagccgttctgagtgggccctctgcgggctccgcggctggggttcctggcgggaccgggggtctctcggcagtgagctcgggcccgcggctccgcctgctgctgctggagagtgtttctggtttgctgcaacctcgaacggggtctgccgttgctccggtgcatcccccaaaccgctcggccccacatttgcccgggctcatgtgcctattgcggctgcatgggtcggtgggcggggcccagaacctttcagctcttggggcattggtgagtctcagtaatgcacgtctcagttccatcaaaactcggtttgagggcctgtgtctgctgtccctgctggtaggggagagccccacagagctattccagcagcactgtgtgtcttggcttcggagcattcagcaggtgttacagacccaggacccgcctgccacaatggagctggccgtggctgtcctgagggacctcctccgatatgcagcccagctgcctgcactgttccgggacatctccatgaaccacctccctggccttctcacctccctgctgggcctcaggccagagtgtgagcagtcagcattggaaggaatgaaggcttgtatgacctatttccctcgggcttgtggttctctcaaaggcaagctggcctcattttttctgtctagggtggatgccttgagccctcagctccaacagttggcctgtgagtgttattcccggctgccctctttaggggctggcttttcccaaggcctgaagcacaccgagagctgggagcaggagctacacagtctgctggcctcactgcacaccctgctgggggccctgtacgagggagcagagactgctcctgtgcagaatgaaggccctggggtggagatgctgctgtcctcagaagatggtgatgcccatgtccttctccagcttcggcagaggttttcgggactggcccgctgcctagggctcatgctcagctctgagtttggagctcccgtgtccgtccctgtgcaggaaatcctggatttcatctgccggaccctcagcgtcagtagcaagaatattagcttgcatggagatccctgcggctgctgctgctgccctctatccaccttggccttggacctgctgtctgcactcatcctcgcgtgtggaagccggctcttgcgctttgggatcctgatcggccgcctgcttccccaggtcctcaattcctggagcatcggtagagattccctctctccaggccaggagaggccttacagcacggttcggaccaaggtgtatgcgatattagagctgtgggtgcaggtttgtggggcctcggcgggaatgcttcagggaggagcctctggagaggccctgctcacccacctgctcagcgacatctccccgccagctgatgcccttaagctgcgtagcccgcgggggagccctgatgggagtttgcagactgggaagcctagcgcccccaagaagctaaagctggatgtgggggaagctatggccccgccaagccaccgcctcttgcctgtgccctgcaagccttctccctcggccagcgagaagatagccttgaggtctcctctttgctcagaagcactggtgacctgtgctgctctgacccacccccgggttcctcccctgcagcccatgggccccacctgccccacacctgctccagttcccctgaggccccatcgcccttcagggccccaccgttccatcctccgggccccatgccctcagtgggctccatgccctcagcaggccccatgctcagcaggccccatgccctcagcaggccctgtgccctcggcacgccctggacctcccaccacagccaaccacctaggcctttctgtcccaggcctagtgtctgtccctccccggcttcttcctggccctgagaaccaccgggcaggctcaaatgaggaccccatccttgcccctagtgggactcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggaagaagaggaagaagaagaagaggaagaagaggaagaggaggaagactttgaggaagaggaagaggatgaagaggaatattttgaagaggaagaagaggaggaagaagagtttgaggaagaatttgaggaagaagaaggtgagttagaggaagaagaagaagaggaggatgaggaggaggaagaagaactggaagaggtggaagacctggagtttggcacagcaggaggggaggtagaagaaggtgcacctccacccccaaccctgcctccagctctgcctccccctgagtctcccccaaaggtgcagccagaacccgaacctgaacccgggctgcttttggaagtggaggagccagggacggaggaggagcgtggggctgacacagctcccaccctggcccctgaagcgctcccctcccagggagaggtggagagggaaggggaaagccctgcggcagggccccctccccaggagcttgttgaagaagagccctctgctcccccaaccctgttggaagaggagactgaggatgggagtgacaaggtgcagcccccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactctttgtttccaataaagttatgtccttagatagcg

SEQ ID NO: 5932 - DNA, 4105 bp, Homo sapiens
acaggcagcctcatccgccatcactccgggaaccgagcaccccgctgcctcggcgcccaggctgctctctccgcgcatgctccttcccagcttgagcccgcgagtccagcctgccttcactcagtgcgcaagaccgcagccccctccccacgccccctccccagtaggcggccgtcgcggtgtgtttgcgtcatcgcgccacgccaccactggaacccgggggaagatggcggcagccgttctgagtgggccctctgcgggctccgcggctggggttcctggcgggaccgggggtctctcggcagtgagctcgggcccgcggctccgcctgctgctgctggagagtgtttctggtttgctgcaacctcgaacggggtctgccgttgctccggtgcatcccccaaaccgctcggccccacatttgcccgggctcatgtgcctattgcggctgcatgggtcggtgggcggggcccagaacctttcagctcttggggcattggtgagtctcagtaatgcacgtctcagttccatcaaaactcggtttgagggcctgtgtctgctgtccctgctggtaggggagagccccacagagctattccagcagcactgtgtgtcttggcttcggagcattcagcaggtgttacagacccaggacccgcctgccacaatggagctggccgtggctgtcctgagggacctcctccgatatgcagcccagctgcctgcactgttccgggacatctccatgaaccacctccctggccttctcacctccctgctgggcctcaggccagagtgtgagcagtcagcattggaaggaatgaaggcttgtatgacctatttccctcgggcttgtggttctctcaaaggcaagctggcctcattttttctgtctagggtggatgccttgagccctcagctccaacagttggcctgtgagtgttattcccggctgccctctttaggggctggcttttcccaaggcctgaagcacaccgagagctgggagcaggagctacacagtctgctggcctcactgcacaccctgctgggggccctgtacgagggagcagagactgctcctgtgcagaatgaaggccctggggtggagatgctgctgtcctcagaagatggtgatgcccatgtccttctccagcttcggcagaggttttcgggactggcccgctgcctagggctcatgctcagctctgagtttggagctcccgtgtccgtccctgtgcaggaaatcctggatttcatctgccggaccctcagcgtcagtagcaagaatattgtaagtgggatttgtcatctcttcagagcccttgctcaggataccaggcaaccaggaaagtactggggacctgagtctccccaaacagtgtcatcctggagtcgtcccagagagcttcctacttttgtccaaataacatcacttcctatgtgtcgtgacacaggagcacagtgtcagagtgtagcaaatgcttccttgggggagggtgaatttggggatgctgagtcattgctgagaggcccagccatccttcttaccttccatccagggtctattttagaggataggggtttgattttgttgggagagctgagatcaggggttgggtttcttacctatgtgtacatatgtaaatggtcattccctgtttctgtctctctctggctctcactttcttcctccactctttatctctgccccttttttctccagagcttgcatggagatggtcccctgcggctgctgctgctgccctctatccaccttgaggccttggacctgctgtctgcactcatcctcgcgtgtggaagccggctcttgcgctttgggatcctgatcggccgcctgcttccccaggtcctcaattcctggagcatcggtagagattccctctctccaggccaggagaggccttacagcacggttcggaccaaggtgtatgcgatattagagctgtgggtgcaggtttgtggggcctcggcgggaatgcttcagggaggagcctctggagaggccctgctcacccacctgctcagcgacatctccccgccagctgatgcccttaagctgcgtagcccgcgggggagccctgatgggagtttgcagactgggaagcctagcgcccccaagaagctaaagctggatgtgggggaagctatggccccgccaagccaccggaaaggggatagcaatgccaacagcgacgtgtgtgcggctgcactcagaggcctcagccggaccatcctcatgtgtgggcctctcatcaaggaggagactcacaggagactgcatgacctggtcctccccctggtcatgggtgtacagcagggtgaggtcctaggcagctccccgtacacgagctcccgctgccgccgtgaactctactgcctgctgctggcgctgctgctggccccgtctcctcgctgcccacctcctcttgcctgtgccctgcaagccttctccctcggccagcgagaagatagccttgaggtctcctctttctgctcagaagcactggtgacctgtgctgctctgacccacccccgggttcctcccctgcagcccatgggccccacctgccccacacctgctccagttccccctcctgaggccccatcgcccttcagggccccaccgttccatcctccgggccccatgccctcagtgggctccatgccctcagcaggccccatgccttcagcaggccccatgccctcagcaggccctgtgccctcggcacgccctggacctcccaccacagccaaccacctaggcctttctgtcccaggcctagtgtctgtccctccccggcttcttcctggccctgagaaccaccgggcaggctcaaatgaggaccccatccttgcccctagtgggactcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggaagaagaggaagaagaagaagaggaagaagaggaagaggaggaagactttgaggaagaggaagaggatgaagaggaatattttgaagaggaagaagaggaggaagaagagtttgaggaagaatttgaggaagaagaaggtgagttagaggaagaagaagaagaggaggatgaggaggaggaagaagaactggaagaggtggaagacctggagtttggcacagcaggaggggaggtagaagaaggtgcacctccacccccaaccctgcctccagctctgcctccccctgagtctcccccaaaggtgcagccagaacccgaacctgaacccgggctgcttttggaagtggaggagccagggacggaggaggagcgtggggctgacacagctcccaccctggcccctgaagcgctcccctcccagggagaggtggagagggaaggggaaagccctgcggcagggccccctccccaggagcttgttgaagaagagccctctgctcccccaaccctgttggaagaggagactgaggatgggagtgacaaggtgcagcccccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactctttgtttccaataaagttatgtccttagatagcg

SEQ ID NO: 5933 - DNA, 3280 bp, Homo sapiens
aacccgggggaagatggcggcagccgttctgagtgggccctctgcgggctccgcggctggggttcctggcgggaccgggggtctctcggcagtgagctcgggcccgcggctccgcctgctgctgctggagagtgtttctggtttgctgcaacctcgaacggggtctgccgttgctccggtgcatcccccaaaccgctcggccccacatttgcccgggctcatgtgcctattgcggctgcatgggtcggtgggcggggcccagaacctttcagctcttggggcattggtgagtctcagtaatgcacgtctcagttccatcaaaactcggtttgagggcctgtgtctgctgtccctgctggtaggggagagccccacagagctattccagcagcactgtgtgtcttggcttcggagcattcagcaggtgttacagtatccgtgtctccacaccctcttttctgccaggtagtggcttggatggtcagactgacattaaccgtggcattcctcagaagacccaggacccgcctgccacaatggagctggccgtggctgtcctgagggacctcctccgatatgcagcccagctgcctgcactgttccgggacatctccatgaaccacctccctggccttctcacctccctgctgggcctcaggccagagtgtgagcagtcagcattggaaggaatgaaggcttgtatgacctatttccctcgggcttgtggttctctcaaaggcaagctggcctcattttttctgtctagggtggatgccttgagccctcagctccaacagttggcctgtgagtgttattcccggctgccctctttaggggctggcttttcccaaggcctgaagcacaccgagagctgggagcaggagctacacagtctgctggcctcactgcacaccctgctgggggccctgtacgagggagcagagactgctcctgtgcagaatgaaggccctggggtggagatgctgctgtcctcagaagatggtgatgcccatgtccttctccagcttcggcagaggttttcgggactggcccgctgcctagggctcatgctcagctctgagtttggagctcccgtgtccgtccctgtgcaggaaatcctggatttcatctgccggaccctcagcgtcagtagcaagaatattagcttgcatggagatggtcccctgcggctgctgctgctgccctctatccaccttgaggccttggacctgctgtctgcactcatcctcgcgtgtggaagccggctcttgcgctttgggatcctgatcggccgcctgcttccccaggtcctcaattcctggagcatcggtagagattccctctctccaggccaggagaggccttacagcacggttcggaccaaggtgtatgcgatattagagctgtgggtgcaggtttgtggggcctcggcgggaatgcttcagggaggagcctctggagaggccctgctcacccacctgctcagcgacatctccccgccagctgatgcccttaagctgcgtagcccgcgggggagccctgatgggagtttgcagactgggaagcctagcgcccccaagaagctaaagctggatgtgggggaagctatggccccgccaagccaccggaaaggggatagcaatgccaacagcgacgtgtgtgcggctgcactcagaggcctcagccggaccatcctcatgtgtgggcctctcatcaaggaggagactcacaggagactgcatgacctggtcctccccctggtcatgggtgtacagcagggtgaggtcctaggcagctccccgtacacgagctcccgctgccgccgtgaactctactgcctgctgctggcgctgctgctggccccgtctcctcgctgcccacctcctcttgcctgtgccctgcaagccttctccctcggccagcgagaagatagccttgaggtctcctctttctgctcagaagcactggtgacctgtgctgctctgacccacccccgggttcctcccctgcagcccatgggccccacctgccccacacctgctccagttccccctcctgaggccccatcgcccttcagggccccaccgttccatcctccgggccccatgccctcagtgggctccatgccctcagcaggccccatgccttcagcaggccccatgccctcagcaggccctgtgccctcggcacgccctggacctcccaccacagccaaccacctaggcctttctgtcccaggcctagtgtctgtccctccccggcttcttcctggccctgagaaccaccgggcaggctcaaatgaggaccccatccttgcccctagtgggactcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggaagaagaggaagaagaagaagaggaagaagaggaagaggaggaagactttgaggaagaggaagaggatgaagaggaatattttgaagaggaagaagaggaggaagaagagtttgaggaagaatttgaggaagaagaaggtgagttagaggaagaagaagaagaggaggatgaggaggaggaagaagaactggaagaggtggagagggaaggggaaagccctgcggcagggccccctccccaggagcttgttgaagaagagccctctgctcccccaaccctgttggaagaggagactgaggatgggagtgacaaggtgcagcccccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactcttt

SEQ ID NO: 5934 - DNA, 3661 bp, Homo sapiens
atccgccatcactccgggaaccgagcaccccgctgcctcggcgcccaggctgctctctccgcgcatgctccttcccagcttgagcccgcgagtccagcctgccttcactcagtgcgcaagaccgcagccccctccccacgccccctccccagtaggcggccgtcgcggtgtgtttgcgtcatcgcgccacgccaccactggaacccgggggaagatggcggcagccgttctgagtgggccctctgcgggctccgcggctggggttcctggcgggaccgggggtctctcggcagtgagctcgggcccgcggctccgcctgctgctgctggagagtgtttctggtttgctgcaacctcgaacggggtctgccgttgctccggtgcatcccccaaaccgctcggccccacatttgcccgggctcatgtgcctattgcggctgcatgggtcggtgggcggggcccagaacctttcagctcttggggcattggtgagtctcagtaatgcacgtctcagttccatcaaaactcggtttgagggcctgtgtctgctgtccctgctggtaggggagagccccacagagctattccagcagcactgtgtgtcttggcttcggagcattcagcaggtgttacagacccaggacccgcctgccacaatggagctggccgtggctgtcctgagggacctcctccgatatgcagcccagctgcctgcactgttccgggacatctccatgaaccacctccctggccttctcacctccctgctgggcctcaggccagagtgtgagcagtcagcattggaaggaatgaaggcttgtatgacctatttccctcgggcttgtggttctctcaaaggcaagctggcctcattttttctgtctagggtggatgccttgagccctcagctccaacagttggcctgtgagtgttattcccggctgccctctttaggggctggcttttcccaaggcctgaagcacaccgagagctgggagcaggagctacacagtctgctggcctcactgcacaccctgctgggggccctgtacgagggagcagagactgctcctgtgcagaatgaaggccctggggtggagatgctgctgtcctcagaagatggtgatgcccatgtccttctccagcttcggcagaggttttcgggactggcccgctgcctagggctcatgctcagctctgagtttggagctcccgtgtccgtccctgtgcaggaaatcctggatttcatctgccggaccctcagcgtcagtagcaagaatattagcttgcatggagatggtcccctgcggctgctgctgctgccctctatccaccttgaggccttggacctgctgtctgcactcatcctcgcgtgtggaagccggctcttgcgctttgggatcctgatcggccgcctgcttccccaggtcctcaattcctggagcatcggtagagattccctctctccaggccaggagaggccttacagcacggttcggaccaaggtgtatgcgatattagagctgtgggtgcaggtttgtggggcctcggcgggaatgcttcagggaggagcctctggagaggccctgctcacccacctgctcagcgacatctccccgccagctgatgcccttaagctgcgtagcccgcgggggagccctgatgggagtttgcagactgggaagcctagcgcccccaagaagctaaagctggatgtgggggaagctatggccccgccaagccaccggaaaggggatagcaatgccaacagcgacgtgtgtgcggctgcactcagaggcctcagccggaccatcctcatgtgtgggcctctcatcaaggaggagactcacaggagactgcatgacctggtcctccccctggtcatgggtgtacagcagggtgaggtcctaggcagctccccgtacacgagctcccgctgccgccgtgaactctactgcctgctgctggcgctgctgctggccccgtctcctcgctgcccacctcctcttgcctgtgccctgcaagccttctccctcggccagcgagaagatagccttgaggtctcctctttctgctcagaagcactggtgacctgtgctgctctgacccacccccgggttcctcccctgcagcccatgggccccacctgccccacacctgctccagttccccctcctgaggccccatcgcccttcagggccccaccgttccatcctccgggccccatgccctcagtgggctccatgccctcagcaggccccatgccttcagcaggccccatgccctcagcaggccctgtgccctcggcacgccctggacctcccaccacagccaaccacctaggcctttctgtcccaggcctagtgtctgtccctccccggcttcttcctggccctgagaaccaccgggcaggctcaaatgaggaccccatccttgcccctagtgggactcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggaagaagaggaagaagaagaagaggaagaagaggaagaggaggaagactttgaggaagaggaagaggatgaagaggaatattttgaagaggaagaagaggaggaagaagagtttgaggaagaatttgaggaagaagaaggtgagttagaggaagaagaagaagaggaggatgaggaggaggaagaagaactggaagaggtggaagacctggagtttggcacagcaggaggggaggtagaagaaggtgcacctccacccccaaccctgcctccagctctgcctccccctgagtctcccccaaaggtgcagccagaacccgaacctgaacccgggctgcttttggaagtggaggagccagggacggaggaggagcgtggggctgacacagctcccaccctggcccctgaagcgctcccctcccagggagaggtggagagggaaggggaaagccctgcggcagggccccctccccaggagcttgttgaagaagagccctctgctcccccaaccctgttggaagaggagactgaggatgggagtgacaaggtgcagcccccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactctttgtttccaataaagttatgtccttagatagcg

SEQ ID NO: 5935 - DNA, 2086 bp, Homo sapiens
atttttctttatggcgtgggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggagcccaggtggaacccctcttaccaataaggaaaatatggaaacaggaacaggactgactccagtgatgacgcaggccttaaggagaaagtttcagctggctcaccctagaagcccaactccaactctgccactttctacaagcagctttgatgaacaaaactgatgccaactctgcctcactccatgagatgatccataacaaatacagataaaaacacccagctgggtgcagtggctcacacctgtaatcccagcactttgggaggctgaggcaggtggatcacctgaggtcaggagtttgagaccagcctggccaacatggtgaaactccttccccactaaaaatacagaaattagctgggcatagtggcgggtgcctgtaatcccagctatgcgggaggctaaggcaggagaattgcttgaacccaagaggcagaggttgcagtgagccaagatcgcgtcattgcactccagcctgagcaacaagagcaaaacaaaaacaaacaaacaaacaaaaaaaacccacccaaatccttttttttaatgtagtagggtttatatagatatactaatataattgcatttggagaattagagtatgtatggagcccacacatactgtgatataaagtgtatatacagatatttggatattttctagtttgcatgatgattaagagaaccagatgggaaaatacaatctccaaagtgatgtttatcctggaattacccaatttagattagagaggttgttcaaatttaactagataactctagtttgtactgtataggtgcagttatgacagtaaaaaaatagcctcttggctcatacctgtaatcccaccactttgggaggccaaggtgggaggattgcttgagcccaggaattcaagactagcctgggcaacataatacagggagaccccgtttctattaaaaatacaaaaatcagccagctgtggtgacacatgcctatagtcccagctacttaggaagctgagaagggaggatcacttgaggctgtagtgcactataattatgcctgtgaatagccactctactccagcctgggcaacatagcaagaccccatctct

SEQ ID NO: 5936 - DNA, 4482 bp, Homo sapiens
atggagcagctgccgggggtgccaccaggccccccccaccccgttcgaccgccacccccaaatcctccaccacccatgcccctgcagctcgaggcccacctccgcagccatggcctggagcccgcggcccccagcccccgcctgcgacccgaggagagcctggatccgccaggcgccatgcaggaattgctcggggctctggagccgctgcccccggcgcctggggatactggcgtaggcccaccaaactcggagggcaaggatcccgcaggcgcctaccgcagccccagcccgcaaggcaccaaggcgccgcgtttcgtgccgctcacctccatctgcttccctgactccttgctccaagacgaggagcgcagcttcttccccaccatggaggagatgttcggtggaggggccgcggacgactacggcaaggccgggccacctgaggacgagggggaccccaaggctggcgctgggccaccccccggcccccctgcttatgatccctatgggccctactgtcctggccgggcgtcgggagccgggcccgagacaccgggcctgggcctggaccccaacaaaccgcctgaactgccctccacggtcaacgccgagccgctgggcctgatccagagtggcccccaccaggcggcgccaccacccccgcctccgccaccgccgcctcccgcgccggcctccgaacccaagggtggcctcacctcgcccatcttctgctctaccaagccaaagaagctgctcaagacatcctccttccacctgctgcggcgccgcgacccacccttccagacccccaagaagctgtacgcccaggagtacgagttcgaggcggacgaggacaaggccgatgttcccgccgacatccgcctcaacccccggcgcttgcctgacctggtctccagctgccgctcccgtccggccctctcgccactgggggacatcgacttctgcccacccaacccaggacccgatggcccccggcgccgtggccgcaagcccacgaaggcgaaacgtgatgggccaccccggccacgggggaggccccggatccgccccctggaggtcccgaccactgcggggcccgcctcggcctccacgcccaccgatggcgccaagaaaccccggggccggggccgaggccggggtcgaaaggctgaggaggcagggggcacccggttggagcccctgaagccacttaagatcaagctgtctgtgcccaaggctggcgagggtctgggaacctcatcgggtgatgccatatcaggcactgaccacaacagcctggactcgagcctgactcgggagaagatcgaggccaagattaaggaggtggaggagaagcagccggagatgaagtcgggtttcatggcctccttcttggacttcctcaagtcaggcaagcgccacccaccactctaccaggcgggcctgacgcctccgctcagccctcccaagagtgtgccaccctctgtgccagcccgaggcctgcagccccagccccctgccacccctgctgtgccacatcccccaccttccggagcctttgggcttgggggcgccctggaggctgcagagagtgagggtctggggcttggctgcccttcaccctgcaagcggcttgatgaggagctgaagcggaacctcgagacgctgccctccttctcctcggatgaggaagactctgtcgccaagaaccgagacctgcaggagagcatctcctccgccatctctgccctcgatgacccaccccttgctgggccaaaagacacttccaccccagatgggccgcccttggcccccgcggctgcagttccagggccaccccctcttccggggctccccagtgccaacagcaatggcactcccgagcccccgctgctggaggagaaacccccacccactccacctcctgccccgactcctcagcctcagcctccgccaccccctccgccgccacagccagccctgccctcgccacccccgctggtggcccccacgcccagctcaccaccgccaccgccgctgccgccgccacctccaccagccatgccctcgcctccaccaccacccccaccagccgctgccccactggctgctcctcctgaggagcccgccgccccgtctcccgaagaccccgagctgccggacacccggcccctgcatctggccaaaaagcaggagacggcggcagtgtgtggggagacggacgaggaggccggcgagagtggcggagagggcatcttccgggaacgggacgagttcgtcatccgtgctgaggacatcccttccctcaagctggcgttgcagacggggcgtgaacccccacccatctggcgagtccagaaggcccttctgcagaaattcactccggagatcaaggacggccagaggcagttttgtgccaccagtaattatttggggtattttggggatgcaaaaaatcggtaccagcgcctctatgtaaagttcctggaaaatgtcaataagaaggactacgtgagggtctgtgctcggaaaccctggcatcggcccccagtgccagtcagacgctctgggcaggccaagaaccccgtatctgctgggggtagctctgcacctccccctaaggccccagcaccacctcccaagcctgagacccctgaaaagacgacatctgagaagcccccagagcagactcctgagacggccatgcctgagccccctgcccccgagaagccctccctcctgcggcctgttgagaaggaaaaggagaaggagaaggtgacacgtggagagcggccattgcggggtgagcgggccaccagcggacggcagacacggccagagcggagtctcgccacgggacaacctgccacatcccggctgcccaaagcccggcctaccaaggtgaaggctgaaccgccccctaagaagaggaagaaatggctgaaggaggcaggcggcaacgctacagcaggcgggggcccaccaggcagctcctcggactcggagtcctcccctggagcccccagcgaggacgagcgggcagtacctgggcgtctgctcaaaaccagggcgatgcgggagatgtaccggagctacgtggagatgttggtgagcacagcacttgacccagacatgatccaggccctggaggacacgcatgacgagctgtacctgccccccatgcggaagatagacggcctgctgaatgagcacaagaagaaagtcctgaagcggctgtcgctaagcccagccctgcaggatgctctgcacacgttcccacagctgcaagtggagcagagtggggagggctctccggaagagggggctgtgcggctgcggcctgctggggaaccctacaaccgcaagacgctcagcaagctcaagaggagcgtggtcagagcccaggagttcaaggttgagctggaaaagtcgggatactatacactctaccattcgctccaccactataaataccacaccttcctgcgctgccgggaccagaccctggccatcgagggcggcgccgaggacctgggccaggaggaggtggtccagcagtgcatgcggaaccagccgtggctggaacagctctttgactccttcagtgacctgctggcccaagcacaggcccacagccgctgcgggtgaccccgccccagcttgtgaggggggcgcctcctccatgaaccgagaattgggacagaaccgtgtcctcaggagctaacacctgggctccatcgccggggaaagggggtcatgggtcagggtgtgtctgtgctgccccctccagggcagggttcaaagtccgactccccccctctcccaagccccctccactccctccccattcctcccactgttcggtgtacagagaaattatttatatatatgtataaatgtctatttagtaacggtttccctctccccttgccccgaccccccctccacagccacagcccccgccccctccaccttgtacataatgtataggaaaagtctatgtatggctggggggggtggggtggcttcagagagctgggggaccccttccccccaagtcccccctgcaggccaagatctttgctaaaggccattccctccgcagggcatttggcgtcgggtgggaggggaaaacgcatcttgttaattatttttaatcttatttattgtacatacctggggcaggggcttggggaggtggaggggggagaagggtcccctctctctgcccctcccactccttttctacggcgatttgtctgtgtctggcccccacccactgcccatcccccattgttgtctggatgtggttctattttttatcggtctcctttcccctcctccccgttctcgcccccgccccaccccctgctcccactaccctttgtctcttgctctttcttgggcttctgtacaactcaacttgtatacactgtgtacacacaaccagccaaacgaaaacccaacggcaaacacttt

SEQ ID NO: 5937 - DNA, 4266 bp, Homo sapiens
atggagcagctgccgggggtgccaccaggccccccccaccccgttcgaccgccacccccaaatcctccaccacccatgcccctgcagctcgaggcccacctccgcagccatggcctggagcccgcggcccccagcccccgcctgcgacccgaggagagcctggatccgccaggcgccatgcaggaattgctcggggctctggagccgctgcccccggcgcctggggatactggcgtaggcccaccaaactcggagggcaaggatcccgcaggcgcctaccgcagccccagcccgcaaggcaccaaggcgccgcgtttcgtgccgctcacctccatctgcttccctgactccttgctccaagacgaggagcgcagcttcttccccaccatggaggagatgttcggtggaggggccgcggacgactacggcaaggccgggccacctgaggacgagggggaccccaaggctggcgctgggccaccccccggcccccctgcttatgatccctatgggccctactgtcctggccgggcgtcgggagccgggcccgagacaccgggcctgggcctggaccccaacaaaccgcctgaactgccctccacggtcaacgccgagccgctgggcctgatccagagtggcccccaccaggcggcgccaccacccccgcctccgccaccgccgcctcccgcgccggcctccgaacccaagggtggcctcacctcgcccatcttctgctctaccaagccaaagaagctgctcaagacatcctccttccacctgctgcggcgccgcgacccacccttccagacccccaagaagctgtacgcccaggagtacgagttcgaggcggacgaggacaaggccgatgttcccgccgacatccgcctcaacccccggcgcttgcctgacctggtctccagctgccgctcccgtccggccctctcgccactgggggacatcgacttctgcccacccaacccaggacccgatggcccccggcgccgtggccgcaagcccacgaaggcgaaacgtgatgggccaccccggccacgggggaggccccggatccgccccctggaggtcccgaccactgcggggcccgcctcggcctccacgcccaccgatggcgccaagaaaccccggggccggggccgaggccggggtcgaaaggctgaggaggcagggggcacccggttggagcccctgaagccacttaagatcaagctgtctgtgcccaaggctggcgagggtctgggaacctcatcgggtgatgccatatcaggcactgaccacaacagcctggactcgagcctgactcgggagaagatcgaggccaagattaaggaggtggaggagaagcagccggagatgaagtcgggtttcatggcctccttcttggacttcctcaagtcaggcaagcgccacccaccactctaccaggcgggcctgacgcctccgctcagccctcccaagagtgtgccaccctctgtgccagcccgaggcctgcagccccagccccctgccacccctgctgtgccacatcccccaccttccggagcctttgggcttgggggcgccctggaggctgcagagagtgagggtctggggcttggctgcccttcaccctgcaagcggcttgatgaggagctgaagcggaacctcgagacgctgccctccttctcctcggatgaggaagactctgtcgccaagaaccgagacctgcaggagagcatctcctccgccatctctgccctcgatgacccaccccttgctgggccaaaagacacttccaccccagatgggccgcccttggcccccgcggctgcagttccagggccaccccctcttccggggctccccagtgccaacagcaatggcactcccgagcccccgctgctggaggagaaacccccacccactccacctcctgccccgactcctcagcctcagcctccgccaccccctccgccgccacagccagccctgccctcgccacccccgctggtggcccccacgcccagctcaccaccgccaccgccgctgccgccgccacctccaccagccatgccctcgcctccaccaccacccccaccagccgctgccccactggctgctcctcctgaggagcccgccgccccgtctcccgaagaccccgagctgccggacacccggcccctgcatctggccaaaaagcaggagacggcggcagtgtgtggggagacggacgaggaggccggcgagagtggcggagagggcatcttccgggaacgggacgagttcgtcatccgtgctgaggacatcccttccctcaagctggcgttgcagacggggcgtgaacccccacccatctggcgagtccagaaggcccttctgcagaaattcactccggagatcaaggacggccagaggcagttttgtgccaccagtaattatttggggtattttggggatgcaaaaaatcggtaccagcgcctctatgtaaagttcctggaaaatgtcaataagaaggactacgtgagggtctgtgctcggaaaccctggcatcggcccccagtgccagtcagacgctctgggcaggccaagaaccccgtatctgctgggggtagctctgcacctccccctaaggccccagcaccacctcccaagcctgagacccctgaaaagacgacatctgagaagcccccagagcagactcctgagacggccatgcctgagccccctgcccccgagaagccctccctcctgcggcctgttgagaaggaaaaggagaaggagaaggtgacacgtggagagcggccattgcggggtgagcgggccaccagcggacggcagacacggccagagcggagtctcgccacgggacaacctgccacatcccggctgcccaaagcccggcctaccaaggtgaaggctgaaccgccccctaagaagaggaagaaatggctgaaggaggcaggcggcaacgctacagcaggcgggggcccaccaggcagctcctcggactcggagtcctcccctggagcccccagcgaggacgagcgggcagtacctgggcgtctgctcaaaaccagggcgatgcgggagatgtaccggagctacgtggagatgttggtgagcacagcacttgacccagacatgatccaggccctggaggacacgcatgagctcaagaggagcgtggtcagagcccaggagttcaaggttgagctggaaaagtcgggatactatacactctaccattcgctccaccactataaataccacaccttcctgcgctgccgggaccagaccctggccatcgagggcggcgccgaggacctgggccaggaggaggtggtccagcagtgcatgcggaaccagccgtggctggaacagctctttgactccttcagtgacctgctggcccaagcacaggcccacagccgctgcgggtgaccccgccccagcttgtgaggggggcgcctcctccatgaaccgagaattgggacagaaccgtgtcctcaggagctaacacctgggctccatcgccggggaaagggggtcatgggtcagggtgtgtctgtgctgccccctccagggcagggttcaaagtccgactccccccctctcccaagccccctccactccctccccattcctcccactgttcggtgtacagagaaattatttatatatatgtataaatgtctatttagtaacggtttccctctccccttgccccgaccccccctccacagccacagcccccgccccctccaccttgtacataatgtataggaaaagtctatgtatggctggggggggtggggtggcttcagagagctgggggaccccttccccccaagtcccccctgcaggccaagatctttgctaaaggccattccctccgcagggcatttggcgtcgggtgggaggggaaaacgcatcttgttaattatttttaatcttatttattgtacatacctggggcaggggcttggggaggtggaggggggagaagggtcccctctctctgcccctcccactccttttctacggcgatttgtctgtgtctggcccccacccactgcccatcccccattgttgtctggatgtggttctattttttatcggtctcctttcccctcctccccgttctcgcccccgccccaccccctgctcccactaccctttgtctcttgctctttcttgggcttctgtacaactcaacttgtatacactgtgtacacacaaccagccaaacgaaaacccaacggcaaacacttt

SEQ ID NO: 5938 - DNA, 6942 bp, Homo sapiens
atggacaggaactaccccagcgccggcttcggggacccgctcggcgccggggcgggatggagttacgagaggtcagcgaaagctagcttggtttatggcagctccaggacctcgcaccccgagacggacatcttacaccgccaggcctatgcggccccccacccactgcaaagctatgccaccaaccaccacccggcaggcctctctggactcttcgacactggcctccaccacgcgggctcagcagggcccgacgcctccgtcatgaaccttatctcggccctggaatcccggggcccccagcctggcccctccgcctcctctctcctctcccagttccgcagtccttcctggcaaacagccatgcacacgccaggccccacggagctcttcatctcgggtgccctgccgggttccagcacctttccgtcctcatctgccctgtcggcttaccaacacccggcttccttcggcagccgccccttcccagtgccctcgtccctcagcctccaggaccccccattcagccctccagctaacgggctcctgtcccctcatgacgtgctgcacctgaagccctcgcaggcacccacggtgccctcttcactgggcttcgagcgcctggcagggggcggtgtcttggggccagctggtctcggtccagcccagacccccccttaccgccctggccccccagacccaccaccacctcctcgccacctcccaactcagttcaacctgctggcttcctcttccgctgccgccgccgctgccgagcagtcctccccacagctctataacttctcgggtgctgccccgggcccaccgccgcctgagcgggccctgccacgccaggacacggtcatcaagcactaccagcggccagccagtgcccagcccccaccacccccgccaccagcccatgcgctccagcactatctgagctgtggaggcagctacccctccatgggccaccgggccaacctggcctgcagccccctgggtggtggggagccctccccgggtgctggggagcctagcaaggctggtcccagcggagccacggctggggcatctggccgggccacgggccctgaggcagcagggggcggtggggctgggggtggtggtggaggttaccgccccatcattcagtcgcctgggtacaagacgggcaaaggtggttatggagcagctgccgggggtgccaccaggccccccccaccccgttcgaccgccacccccaaatgtcagagcctgggtgggccagcagccgcctatgccactgggaaggcctctggggctggaggggcagggggccaggcttattcccccggtcagcctcaagggcttctgggaccccaggcctacgggcaagggtttggaggggggcaggcacaggacttgagcaaagcccccagctactcagggggccccccacagccccccagcggcccccctcctcctggcctggccacatgtcagagctactccccggaccagctgcaggggcagctgtatggggtgcagggcgagccatacccagggccagccgcccactcccaggggctgcccacagccagcccctcgctcagctacagtaccggccattccccagcgctctcgggccatgggggtggctggggacccagctccctgggaggcggcggtgaggccagcccatctcacatcattcgtccgctccagtcaccgcctgccaccggccgtccacctggagtcggctctccaggagcccctggcaaatacctgagctcagtcttggcctcagcgcctttcctggcacctccgggagctggcagctatgcagccggagcaggtggctacaagggcaagggggatggctcggagctgctggcgggcccaggtgggcctcctgcggagcgcacagaggatgaggagttccttatccagcacctcttgcaggcgcccagccctcctcggacctcaggggcggacggcttggtgggcgaggacggggcagcagatgcctctaagggacttggggggagtggcggggccgggggaccaccgggtacaccctacgagttggccaaggaagacccccagaggtaccacctgcagagtgtcatccgcaccagtgccagcctggatgagggtgccactgcggcactggagctgggcctggggaggctgaaggagaagaagaaagggccagagcggggtggcgagacccccgaggggctggccacctctgttgtccactacggggcaggcgccaaggagctgggggccttcttgcaaaagagccctccgcccccacctcccacggcccagtctacccagcccactccccatggcctccttctggaggccgggggccctgacctcccactggtgctgcctccgcctcccccccagctgctcccctcggtcctcagccatgcccccagtccctctcccagcgcctccaaagtcggcgtccacctccttgagccagccacccgcgatggggcaccccagccacctccaccgccacccccgcctccaccacccatgcccctgcagctcgaggcccacctccgcagccatggcctggagcccgcggcccccagcccccgcctgcgacccgaggagagcctggatccgccaggcgccatgcaggaattgctcggggctctggagccgctgcccccggcgcctggggatactggcgtaggcccaccaaactcggagggcaaggatcccgcaggcgcctaccgcagccccagcccgcaaggcaccaaggcgccgcgtttcgtgccgctcacctccatctgcttccctgactccttgctccaagacgaggagcgcagcttcttccccaccatggaggagatgttcggtggaggggccgcggacgactacggcaaggccgggccacctgaggacgagggggaccccaaggctggcgctgggccaccccccggcccccctgcttatgatccctatgggccctactgtcctggccgggcgtcgggagccgggcccgagacaccgggcctgggcctggaccccaacaaaccgcctgaactgccctccacggtcaacgccgagccgctgggcctgatccagagtggcccccaccaggcggcgccaccacccccgcctccgccaccgccgcctcccgcgccggcctccgaacccaagggtggcctcacctcgcccatcttctgctctaccaagccaaagaagctgctcaagacatcctccttccacctgctgcggcgccgcgacccacccttccagacccccaagaagctgtacgcccaggagtacgagttcgaggcggacgaggacaaggccgatgttcccgccgacatccgcctcaacccccggcgcttgcctgacctggtctccagctgccgctcccgtccggccctctcgccactgggggacatcgacttctgcccacccaacccaggacccgatggcccccggcgccgtggccgcaagcccacgaaggcgaaacgtgatgggccaccccggccacgggggaggccccggatccgccccctggaggtcccgaccactgcggggcccgcctcggcctccacgcccaccgatggcgccaagaaaccccggggccggggccgaggccggggtcgaaaggctgaggaggcagggggcacccggttggagcccctgaagccacttaagatcaagctgtctgtgcccaaggctggcgagggtctgggaacctcatcgggtgatgccatatcaggcactgaccacaacagcctggactcgagcctgactcgggagaagatcgaggccaagattaaggaggtggaggagaagcagccggagatgaagtcgggtttcatggcctccttcttggacttcctcaagtcaggcaagcgccacccaccactctaccaggcgggcctgacgcctccgctcagccctcccaagagtgtgccaccctctgtgccagcccgaggcctgcagccccagccccctgccacccctgctgtgccacatcccccaccttccggagcctttgggcttgggggcgccctggaggctgcagagagtgagggtctggggcttggctgcccttcaccctgcaagcggcttgatgaggagctgaagcggaacctcgagacgctgccctccttctcctcggatgaggaagactctgtcgccaagaaccgagacctgcaggagagcatctcctccgccatctctgccctcgatgacccaccccttgctgggccaaaagacacttccaccccagatgggccgcccttggcccccgcggctgcagttccagggccaccccctcttccggggctccccagtgccaacagcaatggcactcccgagcccccgctgctggaggagaaacccccacccactccacctcctgccccgactcctcagcctcagcctccgccaccccctccgccgccacagccagccctgccctcgccacccccgctggtggcccccacgcccagctcaccaccgccaccgccgctgccgccgccacctccaccagccatgccctcgcctccaccaccacccccaccagccgctgccccactggctgctcctcctgaggagcccgccgccccgtctcccgaagaccccgagctgccggacacccggcccctgcatctggccaaaaagcaggagacggcggcagtgtgtggggagacggacgaggaggccggcgagagtggcggagagggcatcttccgggaacgggacgagttcgtcatccgtgctgaggacatcccttccctcaagctggcgttgcagacggggcgtgaacccccacccatctggcgagtccagaaggcccttctgcagaaattcactccggagatcaaggacggccagaggcagttttgtgccaccagtaattatttggggtattttggggatgcaaaaaatcggtaccagcgcctctatgtaaagttcctggaaaatgtcaataagaaggactacgtgagggtctgtgctcggaaaccctggcatcggcccccagtgccagtcagacgctctgggcaggccaagaaccccgtatctgctgggggtagctctgcacctccccctaaggccccagcaccacctcccaagcctgagacccctgaaaagacgacatctgagaagcccccagagcagactcctgagacggccatgcctgagccccctgcccccgagaagccctccctcctgcggcctgttgagaaggaaaaggagaaggagaaggtgacacgtggagagcggccattgcggggtgagcgggccaccagcggacggcagacacggccagagcggagtctcgccacgggacaacctgccacatcccggctgcccaaagcccggcctaccaaggtgaaggctgaaccgccccctaagaagaggaagaaatggctgaaggaggcaggcggcaacgctacagcaggcgggggcccaccaggcagctcctcggactcggagtcctcccctggagcccccagcgaggacgagcgggcagtacctgggcgtctgctcaaaaccagggcgatgcgggagatgtaccggagctacgtggagatgttggtgagcacagcacttgacccagacatgatccaggccctggaggacacgcatgacgagctgtacctgccccccatgcggaagatagacggcctgctgaatgagcacaagaagaaagtcctgaagcggctgtcgctaagcccagccctgcaggatgctctgcacacgttcccacagctgcaagtggagcagagtggggagggctctccggaagagggggctgtgcggctgcggcctgctggggaaccctacaaccgcaagacgctcagcaagctcaagaggagcgtggtcagagcccaggagttcaaggttgagctggaaaagtcgggatactatacactctaccattcgctccaccactataaataccacaccttcctgcgctgccgggaccagaccctggccatcgagggcggcgccgaggacctgggccaggaggaggtggtccagcagtgcatgcggaaccagccgtggctggaacagctctttgactccttcagtgacctgctggcccaagcacaggcccacagccgctgcgggtgaccccgccccagcttgtgaggggggcgcctcctccatgaaccgagaattgggacagaaccgtgtcctcaggagctaacacctgggctccatcgccggggaaagggggtcatgggtcagggtgtgtctgtgctgccccctccagggcagggttcaaagtccgactccccccctctcccaagccccctccactccctccccattcctcccactgttcggtgtacagagaaattatttatatatatgtataaatgtctatttagtaacggtttccctctccccttgccccgaccccccctccacagccacagcccccgccccctccaccttgtacataatgtataggaaaagtctatgtatggctggggggggtggggtggcttcagagagctgggggaccccttccccccaagtcccccctgcaggccaagatctttgctaaaggccattccctccgcagggcatttggcgtcgggtgggaggggaaaacgcatcttgttaattatttttaatcttatttattgtacatacctggggcaggggcttggggaggtggaggggggagaagggtcccctctctctgcccctcccactccttttctacggcgatttgtctgtgtctggcccccacccactgcccatcccccattgttgtctggatgtggttctattttttatcggtctcctttcccctcctccccgttctcgcccccgccccaccccctgctcccactaccctttgtctcttgctctttcttgggcttctgtacaactcaacttgtatacactgtgtacacacaaccagccaaacgaaaacccaacggcaaacacttt

SEQ ID NO: 5939 - DNA, 1778 bp, Homo sapiens
gggagaccgctgggcggggacgcgaggagggaaggggcgtctgtgggcgggacctcccgggattggagtgaagagggtatctgcttgacagtggatccctggggatctacgctgagttcggagatgctccagctcgggccgcccctgtctgagcggagctttgcggcgctgaagcttacaggggaaggaaaagcctcgcccggccgacaggccgggtggtcctcgcaggccaggcctcccgaccctctgtgtttgtgtcgcgagcccttgagccgcatccaccggacctcttccaccctgaggcggcgatcaaggacaacccctggcccagaggagggcccttcacaaaaggtggaccgggccccccagcccaccctggtggtgatgctggaagacatcgccagtcctagaccccccgctgagggcttcattgatgagacccccaacttcatcatcccagcacaaagagctgagcccatgaggatagttcgccagccaacgcctccacctggggacctagaacccccattccagccatctgctctgcctgcagaccctctggagagcccaccaacagccccagatcctgctctggagctcccatccaccccaccaccgtccagccttttacgcccccgcctcagtccctggggcttggccccgctcttccgttccgtccgctccaagctggagagctttgctgacatcttcctcacgcccaacaaaaccccacagcccccacccccgtcccccccaatgaagctggagttgaagatcgccatctcagaggccgagcagtctggggctgctgagggcactgcgtctgtcagcccccggcccccaatccgccagtggcgaactcaggaccacaataccccagcacttctccctaagccctctctgggccgaagctactcctgccctgatctggggccccctggcccaggtacctgcacctggccacctgctccaccccaaccaagccgaccacggccgcggcggcacactgtgggtggtggggaaatggcccgagccccgccaccccctcggccctgtctccggaaagaggtcttccctctcggaggagtgggagcctccccttctctcaccacatcttgctcgtccacggcatccacttccttctccgaaccagcagaacccaggttgggttcaaccaaagggaaggagccaagagcctcaaaggaccaggtgctttcagaacctgagaccaagaccatgggaaaggtttctcgattcagaatacgcagaacaccagcccgtcctcagctaaaccttacaccaatgggactgcctcgaccaatcaggttgaacaagaaggagttcagcttggaagaaatttacaccaacaagaattaccaatcacccacaaccaggaggacctttgagaccatctttgaggaaccccgggagcgcaatgggactctgattttcaccagctcaaggaagctccggcgggctgtggaatttcgggacagcagccttcctcgatcacgaagaccgtcccgtggggtccgggctgcagggggcaggactgttcctcccaatgtggcccccagccctgatgtgggccccctgctccagcagcggctggaggagctagatgccttgctcctggaggaagaaacagtagatcgggagcagccccactggacctaggtgccccatctgttggtcatccatcctgaagggacaggaaacctcccaggcagttatttttttttctctatatttctagtaaagttttcgatatgtttctg

SEQ ID NO: 5940 - DNA, 2145 bp, Homo sapiens
gacgcgaggagggaaggggcgtctgtgggcgggacctcccgggattggagtgaagagggtatctgcttgacagtggatccctggggatctacgctgagttcggagatgctccagctcgggccgcccctgtctgagcggagctttgcggcgctgaagcttacaggggaaggaaaagcctcgcccggcgtctgattggcggaaccgcgctgccgcagcctgggattccccagggacccccccggagccgccgcgtctcccatggacttgcccggggactccagcccgcctggccagccgcgtctgtgccgccagcctctgactcgagcattatggggagccaggagcccgaaacggccgaggctgcagctcccgggggccccttctcccctggaaaaggcctctcggcgggtcctggccgtggtgctagaagatgtcatggctgttcacatggtccccgtggtgccctcaaagcagacctccataccacagcaccacagctaccatcaggatcctgtccacaggcagccgcctgcctcgccaccccggcaggccgggtggtcctcgcaggccaggcctcccgaccctctgtgtttgtgtcgcgagcccttgagccgcatccaccggacctcttccaccctgaggcggcgatcaaggacaacccctggcccagaggagggcccttcacaaaaggtggaccgggccccccagcccaccctggtggtgatgctggaagacatcgccagtcctagaccccccgctgagggcttcattgatgagacccccaacttcatcatcccagcacaaagagctgagcccatgaggatagttcgccagccaacgcctccacctggggacctagaacccccattccagccatctgctctgcctgcagaccctctggagagcccaccaacagccccagatcctgctctggagctcccatccaccccaccaccgtccagccttttacgcccccgcctcagtccctggggcttggccccgctcttccgttccgtccgctccaagctggagagctttgctgacatcttcctcacgcccaacaaaaccccacagcccccacccccgtcccccccaatgaagctggagttgaagatcgccatctcagaggccgagcagtctggggctgctgagggcactgcgtctgtcagcccccggcccccaatccgccagtggcgaactcaggaccacaataccccagcacttctccctaagccctctctgggccgaagctactcctgccctgatctggggccccctggcccaggtacctgcacctggccacctgctccaccccaaccaagccgaccacggccgcggcggcacactgtgggtggtggggaaatggcccgagccccgccaccccctcggccctgtctccggaaagaggtcttccctctcggaggagtgggagcctccccttctctcaccacatcttgctcgtccacggcatccacttccttctccgaaccagcagaacccaggttgggttcaaccaaagggaaggagccaagagcctcaaaggaccaggtgctttcagaacctgagaccaagaccatgggaaaggtttctcgattcagaatacgcagaacaccagcccgtcctcagctaaaccttacaccaatgggactgcctcgaccaatcaggttgaacaagaaggagttcagcttggaagaaatttacaccaacaagaattaccaatcacccacaaccaggaggacctttgagaccatctttgaggaaccccgggagcgcaatgggactctgattttcaccagctcaaggaagctccggcgggctgtggaatttcgggacagcagccttcctcgatcacgaagaccgtcccgtggggtccgggctgcagggggcaggactgttcctcccaatgtggcccccagccctgatgtgggccccctgctccagcagcggctggaggagctagatgccttgctcctggaggaagaaacagtagatcgggagcagccccactggacctaggtgccccatctgttggtcatccatcctgaagggacaggaaacctcccaggcagttatttttttttctctatatttctagtaaagttttcgatatgtttctgattcttttgtatctctagctgagtttaa

SEQ ID NO: 5941 - DNA, 2122 bp, Homo sapiens
gcggcaggtgccaggcagggcgcgagtgatccgctgatcgaggcggtggcagcgggaggacacccgctccgggcgaccggccgggggcgccctttcgcgccccagggctgcggccgctgggctacggggagccgcgggcggaccatgaagggcggagccccagggaaggggccggccctcaccccccgctcccccgctccccccttaccccaggccgcagcctgggattccccagggacccccccggagccgccgcgtctcccatggacttgcccggggactccagcccgcctggccagccgcgtctgtgccgccagcctctgactcgagcattatggggagccaggagcccgaaacggccgaggctgcagctcccgggggccccttctcccctggaaaaggcctctcggcgggtcctggccgtggtgctagaagatgtcatggctgttcacatggtccccgtggtgccctcaaagcagacctccataccacagcaccacagctaccatcaggatcctgtccacaggcagccgcctgcctcgccaccccggcaggccgggtggtcctcgcaggccaggcctcccgaccctctgtgtttgtgtcgcgagcccttgagccgcatccaccggacctcttccaccctgaggcggcgatcaaggacaacccctggcccagaggagggcccttcacaaaaggtggaccgggccccccagcccaccctggtggtgatgctggaagacatcgccagtcctagaccccccgctgagggcttcattgatgagacccccaacttcatcatcccagcacaaagagctgagcccatgaggatagttcgccagccaacgcctccacctggggacctagaacccccattccagccatctgctctgcctgcagaccctctggagagcccaccaacagccccagatcctgctctggagctcccatccaccccaccaccgtccagccttttacgcccccgcctcagtccctggggcttggccccgctcttccgttccgtccgctccaagctggagagctttgctgacatcttcctcacgcccaacaaaaccccacagcccccacccccgtcccccccaatgaagctggagttgaagatcgccatctcagaggccgagcagtctggggctgctgagggcactgcgtctgtcagcccccggcccccaatccgccagtggcgaactcaggaccacaataccccagcacttctccctaagccctctctgggccgaagctactcctgccctgatctggggccccctggcccaggtacctgcacctggccacctgctccaccccaaccaagccgaccacggccgcggcggcacactgtgggtggtggggaaatggcccgagccccgccaccccctcggccctgtctccggaaagaggtcttccctctcggaggagtgggagcctccccttctctcaccacatcttgctcgtccacggcatccacttccttctccgaaccagcagaacccaggttgggttcaaccaaagggaaggagccaagagcctcaaaggaccaggtgctttcagaacctgagaccaagaccatgggaaaggtttctcgattcagaatacgcagaacaccagcccgtcctcagctaaaccttacaccaatgggactgcctcgaccaatcaggttgaacaagaaggagttcagcttggaagaaatttacaccaacaagaattaccaatcacccacaaccaggaggacctttgagaccatctttgaggaaccccgggagcgcaatgggactctgattttcaccagctcaaggaagctccggcgggctgtggaatttcgggacagcagccttcctcgatcacgaagaccgtcccgtggggtccgggctgcagggggcaggactgttcctcccaatgtggcccccagccctgatgtgggccccctgctccagcagcggctggaggagctagatgccttgctcctggaggaagaaacagtagatcgggagcagccccactggacctaggtgccccatctgttggtcatccatcctgaagggacaggaaacctcccaggcagttatttttttttctctatatttctagtaaagttttcgatatgtttctg

SEQ ID NO: 5942 - DNA, 6643 bp, Homo sapiens
atagagacgaagaggtggcggcggccggagcgcccccggcctctgtcggctccgtaggctcaggtagacctggcgacgacggggctgcagctgcaggggctgagctggctgggcaagcgcgggccgcggaggaggtctcaggggtgaatcatttgatgtaaaagacttgactccataatctgcatctgtcctaatgctgtcatctggagtagagactcagccagttccacttgattcctccatgtctgccgtggtacaggaattatactctgaactcccagtaagtgtctccagagagcttcatgctgaccctgagccaagtgtgattccagatgtaaaacctggagcctcaagctctcttttaagtcagaatagggcattgcccttggagctgcagaggactcatgtggagagttgttgtgaagaaacctatgagaccttggatcatgggagtgagcctgggcgatgtgggctagtggactccacagcaggaggttctgtggcatctgggatcttggatagggcaaagagaagcgagagcatggagccaaaggtcttcagagatccagggggccaggcaggaattataagagaaccctctgagggagcaaaggaagatccacatcaacattccacagctgctgaagaaaagactagcccgagtcaggaggatctcctgatgcagtccagcaaagaactttcacatgtggacctccctgaagattttctaaggagcaaagaaggaaatgtacagattacagctgaaactctgctaaaatccgccgaagtacaaggtatgaaggtcaatgggactaagacggataataatgaaggacacaaaaatggcaatgtgagtaaagatctctcagctggatgcggtgaattccaagaagtagacaaaatcatgaccagtgatgaggtttcagaaaccagcacattagttaccccagaacctttaacctttgtggaccctgtattaacagaagcaactcctaaagaaaaagaatgtgaagaattaaaaagttgtccttggttgtcattaccaggaaacagtgccatttctaatgtggacaatgggaaggaagagttgtgtaaaccaaacctggtctgtgaagcagatgacaatcaccaacagcttcatggccaccataatgaacaacccagttctacacatgatagtcccacagccacaagccctttgaaagaaaattctgaagtttcatgtttcacatcagacttgtctggtccagaatccagaacaatatccttagaaaactgtggttttgaaggtggtggtttgctaaagagatctgctgaaaagacagacagttcttatttttataggggggatgatcaagggaagaacttggcttctagagaagaaaatgaggaacggcttttgattcctaggagtgaaagaggtggaccttttctttttaatgccagggaaccagaaaaggagattagtggtcgttgttctggtgaaaaagagcctgttgtttctccaaaggaaaatatccacaataactgcattcaagacagtctccatacagggaactctagttctttaatgcccaattcttttactgaagccacagaagtaatgttaaataaaaatgatttgaaaattactgtacacgttcaaggtaacttgacaaaccctgaggaccataaagaaacttttactaatatgagccatcctggtggacactctgaagaaagcagtttttcctccttgatgcagattgaagaggcaggacagacaacccctgtagagcccaatatattaagtaaatctttttacactaaagactgtaactccttagtcagcatccagagaaatctggaaggcaacacccagttaaatgaagcatcatgtaatgattttctgtttgaaagaaaatccattgtgagtttaatgccagaggatcaaataagtcctgtaagtgaggtattaaaacccaagcaaggtactgctctgttgctaccatccccagaatttgattacagacctgagtcagaaaaagttatacagacctcacatgatgatattccacttttagatgaacagagcatagcctgtgagatgaatgaactttcttgtaccaatgaactggttgtaaacaaagtagaaagtgaatgtgttttaaatcaacaagtgtcccttaattctcaagaacatgcaaatttgccaactgactctctactgcatttaaacaaagagatgcctttagcaacaggcagagatgcccatcagagccatcaccctccattagagggtagagcagatgtcattgctgatatacaaaccattcccattcagacaaaaataaaagacatctctccaccaggtaaccaaacctgtggtgcctcttcaaactgtcccaccttaaacatcaaaccagtaagcctagagagaaaaaaggaaatggctgattcaggaacaaaagctctacattccaggctgcgctcaaataagagagaagcagctggctttcctcaagtggtctctgtcatagaatgtcacagcgttcaatctcaggatatctctagctgtcatcgtgtaagaaaaaatgtatcccaggaaaacatgtgttctgcttctgctgctttcaagtccagcaaaatcagcctgcaagttgataactctttgataacaaaatatgaaaatgcatttcagcaccgtgatcactgctgccaaggaacaggacactctgtggaaaaaagcagctgtaaagtgagttacacatcacaggaaagggaacttgatgggaaagaaacgaatggcagccttccaggagataagatcagaaacaaaatggtagcaggcttgttaaatagtggaatttcaaacaaaaccattcacacctccagtagcatcaaactcagtgaggaagggctggaaggaaaggagcaggatgtatccaaagaaactgtattttgtaagtataacatctctgatcatgctatacaagaactaaaccagactgtaaacattccaggtcctgaaaaagtgttggaccagtctcctactgttatgttctccagttttaaaaatgtaaaatcagttgaaacactcgatcagaaggcagatgaagtccttgactgtcagagtaaccaaaacagaccagatgaatgcaaaagtgaaggtcagtcagccaaggagatgctaagtagtgaccagagagagactgtcaccgagcctcacggggaggtaaaccacaaccaaaaggatctgctggtcagctcaggcagtaataactcactaccttgtggtagtccaaagaaatgcaatttgaaaggagcctttgtcaagatgtctggttgtgatgagtccacagaaggtatggtagacatcgtctacacggactgtagtaataagcttgcagaaggtgtgctggacgtgaaggcatctaatctactggattgtggtgcaaggcaagagaaactggcatttcaagaggactccaggagtaccttgtctcggagagaactggatgctgcacatacaggaacaactggtcaggattcagatttcccagttactgctgcttctacagtggactttctcaaaataaaaaaatcatgtgaagaaaacgtatgcagatctttaaaagactgtgaaatggaaaagtgtccagactcttgtgcccatgagatggagtctgttgcagatcatgaaccaaataaaagaatattgggcagagtaaatttgtctttaaatgatagccattatggacagcaagataaaggaacatctctcagagaaacacaagaaatgactgaaggatcaagactagaaccaaactctgagtttggcaaagaaagtacctttggaatttcctcaaaagagtcgatgtcttgccatgatgaaagctctgtttccctaagaagcctgaaatccattgaaataatgccttctcaagaaaattcagaaactaatgttaacagtgaagaaactgacctgaaaaatctttgtaaaccaaaagatggtgaaatgctttgtgaaaatgtaaaggactgcacagtccttcctgagatgaaggaaatagtatcaagagattggagtaattctagtgacagagacagcgtatgtacctgtgtggaaaagaatgcttgcaaagcttgtcaccctcacgagaattcctctgacagacatttgcctttgacagtgaaaacagatattaaagtgaaaggagaagaaaccgaagagcatcagaggggacgactgggttacttaactgttggggagcaatctgaggagttggttaccagagaaactggcgatggcgatcccgtgagcaacatctctcagacccattttaaatgccgggggatacttaatcatgctgaaaaacagcagagccctgaggttttggactacatgttgcagaaagaagagaaatatatacgtcaacaaaaagcacatacgatatcgcaacagtgcatatcatctagtctgttgttagatgatgcacaaaatcagaaccaaccgaaggctgacaaagatgagtccaccatgatcaatgaaatcaccctagcaaagctggccaaggacagcattgtggcacagactcagaagttagaagaccagaaggaggaaaggttacatcatccattaaggaaggacactgagtcatgcacaagtccttgccttcttggtgcccctcggaaagcacaagacccctcctctgctgggtgtgatcaaatacatggtgcctttgcgaagaaaggagttcttcccttaaagaagcagccccatcgaacttgtaagaaagtttcctatcaggagcaaatcattgttgggagaaaaataggtaaaatcagaagttctgcctttttaaagagttcttccaatcccatccccacaaaagcgcacagacttctcagtttgtgtactctgtctgcacctacacgattagaacctgaaacagcacctaccaagagcttggttagtcacataccaaagcagatgtctacaccgtgccatcccttgaggagcctgaattttaggaagactaccaaagaatcagccttactaaacaagctgtccatccttgcctccaaactggccccagccatgaagactcagaagctaagataccgacggtgttcctctgaacttcttccaatggctaaaagctacaagcgcctcagatataaaagactcctggacggattttcatccagcacagagcagctgaatccatatttggcagctagtggatgggataagaggcctaacagtaagcccatggcactttattctctcgaatccatcaagatgaccttcatagatttgagcaacaagatgccgtccctgctgtttggttctgaaatcttcccagtatcctttcatgtgaaatcatccagctcagattgcacgactgagtcctcaaggacttttcctgagcactgtgctccggcaaggcttgccttaggagaggccctccagtgcccgtctcaacctcccaagtggaccttttctttcttcttgtcccacggttgccctgggatggcaacattcagggaagacactggcgtccatagtcagacccacactcaggctcctccccagcctccagctcctctccaagactatggaggcactgccatagtccagaccagagcagactgctctgtccttggccttcacacacttctagcactttgttccccaggatgttaccgaatctggacaaaaaaacggagcttctccagccacatgcctaccatgcagaggctcttcatgacccagtttacacagggcctgaaagggttacggtctccagcctccatagcagacaaggtcttctgttctctgccctactcggtgggcagagtcctatccatttggagccagcatggtccttctgtctgctccttcgaaatctcttctcttcattcccctcactgcaagcggcaaccaagtctgggcaccacaagcagccacaccatgttaccatatgtgcctcttccaggcatggaagctacatataacaccagcggcagtcagacgaggctggagcctccattccctgccttggtaccaaagtcttgcttggtagcagaatcagctgtcagcaagctcctgctttcagcctctgagttccaggttcgtggattggatgagctggatggtgtgaaagcagcatgcccctgcccacagagcagccccccagaacagaaagaggctgagccagagaagaggccaaagaaagtctcacagattcgcatccggaaaaccattcctaggccagatcctaatcttacccccatgggccttcctcgacccaaaaggttaaagaagaaggagtttagtttagaagagatatataccaacaagaattataaatctcctcctgcaaacagggacctggattctagctgcccgagcactgacagcgaaaccgggcacttcctggtattcggatatgcgcagcgccaagcgcagccgcacccactgctggcctcacgccgtctgattggctgcagctctccggaggggcggggccatccgagaagctatccatattggaggaggctgctagtcctttgctggtacctgccgggctggagagcggggagggtcacgtggttaagactcgccacgtgggccgggcgcggtgactcaagcctgtaa

SEQ ID NO: 5943 - DNA, 10719 bp, Homo sapiens
atagagacgaagaggtggcggcggccggagcgcccccggcctctgtcggctccgtaggctcaggtagacctggcgacgacggggctgcagctgcaggggctgagctggctgggcaagcgcgggccgcggaggaggtctcaggggtgaatcatttgatgtaaaagacttgactccataatctgcatctgtcctaatgctgtcatctggagtagagactcagccagttccacttgattcctccatgtctgccgtggtacaggaattatactctgaactcccagtaagtgtctccagagagcttcatgctgaccctgagccaagtgtgattccagatgtaaaacctggagcctcaagctctcttttaagtcagaatagggcattgcccttggagctgcagaggactcatgtggagagttgttgtgaagaaacctatgagaccttggatcatgggagtgagcctgggcgatgtgggctagtggactccacagcaggaggttctgtggcatctgggatcttggatagggcaaagagaagcgagagcatggagccaaaggtcttcagagatccagggggccaggcaggaattataagagaaccctctgagggagcaaaggaagatccacatcaacattccacagctgctgaagaaaagactagcccgagtcaggaggatctcctgatgcagtccagcaaagaactttcacatgtggacctccctgaagattttctaaggagcaaagaaggaaatgtacagattacagctgaaactctgctaaaatccgccgaagtacaaggtatgaaggtcaatgggactaagacggataataatgaaggacacaaaaatggcaatgtgagtaaagatctctcagctggatgcggtgaattccaagaagtagacaaaatcatgaccagtgatgaggtttcagaaaccagcacattagttaccccagaacctttaacctttgtggaccctgtattaacagaagcaactcctaaagaaaaagaatgtgaagaattaaaaagttgtccttggttgtcattaccaggaaacagtgccatttctaatgtggacaatgggaaggaagagttgtgtaaaccaaacctggtctgtgaagcagatgacaatcaccaacagcttcatggccaccataatgaacaacccagttctacacatgatagtcccacagccacaagccctttgaaagaaaattctgaagtttcatgtttcacatcagacttgtctggtccagaatccagaacaatatccttagaaaactgtggttttgaaggtggtggtttgctaaagagatctgctgaaaagacagacagttcttatttttataggggggatgatcaagggaagaacttggcttctagagaagaaaatgaggaacggcttttgattcctaggagtgaaagaggtggaccttttctttttaatgccagggaaccagaaaaggagattagtggtcgttgttctggtgaaaaagagcctgttgtttctccaaaggaaaatatccacaataactgcattcaagacagtctccatacagggaactctagttctttaatgcccaattcttttactgaagccacagaagtaatgttaaataaaaatgatttgaaaattactgtacacgttcaaggtaacttgacaaaccctgaggaccataaagaaacttttactaatatgagccatcctggtggacactctgaagaaagcagtttttcctccttgatgcagattgaagaggcaggacagacaacccctgtagagcccaatatattaagtaaatctttttacactaaagactgtaactccttagtcagcatccagagaaatctggaaggcaacacccagttaaatgaagcatcatgtaatgattttctgtttgaaagaaaatccattgtgagtttaatgccagaggatcaaataagtcctgtaagtgaggtattaaaacccaagcaaggtactgctctgttgctaccatccccagaatttgattacagacctgagtcagaaaaagttatacagacctcacatgatgatattccacttttagatgaacagagcatagcctgtgagatgaatgaactttcttgtaccaatgaactggttgtaaacaaagtagaaagtgaatgtgttttaaatcaacaagtgtcccttaattctcaagaacatgcaaatttgccaactgactctctactgcatttaaacaaagagatgcctttagcaacaggcagagatgcccatcagagccatcaccctccattagagggtagagcagatgtcattgctgatatacaaaccattcccattcagacaaaaataaaagacatctctccaccaggtaaccaaacctgtggtgcctcttcaaactgtcccaccttaaacatcaaaccagtaagcctagagagaaaaaaggaaatggctgattcaggaacaaaagctctacattccaggctgcgctcaaataagagagaagcagctggctttcctcaagtggtctctgtcatagaatgtcacagcgttcaatctcaggatatctctagctgtcatcgtgtaagaaaaaatgtatcccaggaaaacatgtgttctgcttctgctgctttcaagtccagcaaaatcagcctgcaagttgataactctttgataacaaaatatgaaaatgcatttcagcaccgtgatcactgctgccaaggaacaggacactctgtggaaaaaagcagctgtaaagtgagttacacatcacaggaaagggaacttgatgggaaagaaacgaatggcagccttccaggagataagatcagaaacaaaatggtagcaggcttgttaaatagtggaatttcaaacaaaaccattcacacctccagtagcatcaaactcagtgaggaagggctggaaggaaaggagcaggatgtatccaaagaaactgtattttgtaagtataacatctctgatcatgctatacaagaactaaaccagactgtaaacattccaggtcctgaaaaagtgttggaccagtctcctactgttatgttctccagttttaaaaatgtaaaatcagttgaaacactcgatcagaaggcagatgaagtccttgactgtcagagtaaccaaaacagaccagatgaatgcaaaagtgaaggtcagtcagccaaggagatgctaagtagtgaccagagagagactgtcaccgagcctcacggggaggtaaaccacaaccaaaaggatctgctggtcagctcaggcagtaataactcactaccttgtggtagtccaaagaaatgcaatttgaaaggagcctttgtcaagatgtctggttgtgatgagtccacagaaggtatggtagacatcgtctacacggactgtagtaataagcttgcagaaggtgtgctggacgtgaaggcatctaatctactggattgtggtgcaaggcaagagaaactggcatttcaagaggactccaggagtaccttgtctcggagagaactggatgctgcacatacaggaacaactggtcaggattcagatttcccagttactgctgcttctacagtggactttctcaaaataaaaaaatcatgtgaagaaaacgtatgcagatctttaaaagactgtgaaatggaaaagtgtccagactcttgtgcccatgagatggagtctgttgcagatcatgaaccaaataaaagaatattgggcagagtaaatttgtctttaaatgatagccattatggacagcaagataaaggaacatctctcagagaaacacaagaaatgactgaaggatcaagactagaaccaaactctgagtttggcaaagaaagtacctttggaatttcctcaaaagagtcgatgtcttgccatgatgaaagctctgtttccctaagaagcctgaaatccattgaaataatgccttctcaagaaaattcagaaactaatgttaacagtgaagaaactgacctgaaaaatctttgtaaaccaaaagatggtgaaatgctttgtgaaaatgtaaaggactgcacagtccttcctgagatgaaggaaatagtatcaagagattggagtaattctagtgacagagacagcgtatgtacctgtgtggaaaagaatgcttgcaaagcttgtcaccctcacgagaattcctctgacagacatttgcctttgacagtgaaaacagatattaaagtgaaaggagaagaaaccgaagagcatcagaggggacgactgggttacttaactgttggggagcaatctgaggagttggttaccagagaaactggcgatggcgatcccgtgagcaacatctctcagacccattttaaatgccgggggatacttaatcatgctgaaaaacagcagagccctgaggttttggactacatgttgcagaaagaagagaaatatatacgtcaacaaaaagcacatacgatatcgcaacagtgcatatcatctagtctgttgttagatgatgcacaaaatcagaaccaaccgaaggctgacaaagatgagtccaccatgatcaatgaaatcaccctagcaaagctggccaaggacagcattgtggcacagactcagaagttagaagaccagaaggaggaaaggttacatcatccattaaggaaggacactgagtcatgcacaagtccttgccttcttggtgcccctcggaaagcacaagacccctcctctgctgggtgtgatcaaatacatggtgcctttgcgaagaaaggagttcttcccttaaagaagcagccccatcgaacttgtaagaaagtttcctatcaggagcaaatcattgttgggagaaaaataggtaaaatcagaagttctgcctttttaaagagttcttccaatcccatccccacaaaagcgcacagacttctcagtttgtgtactctgtctgcacctacacgattagaacctgaaacagcacctaccaagagcttggttagtcacataccaaagcagatgtctacaccgtgccatcccttgaggagcctgaattttaggaagactaccaaagaatcagccttactaaacaagctgtccatccttgcctccaaactggccccagccatgaagactcagaagctaagataccgacggtgttcctctgaacttcttccaatggctaaaagctacaagcgcctcagatataaaagactcctggacggattttcatccagcacagagcagctgaatccatatttggcagctagtggatgggataagaggcctaacagtaagcccatggcactttattctctcgaatccatcaagatgaccttcatagatttgagcaacaagatgccgtccctgctgtttggttctgaaatcttcccagtatcctttcatgtgaaatcatccagctcagattgcacgactgagtcctcaaggacttttcctgagcactgtgctccggcaaggcttgccttaggagaggccctccagtgcccgtctcaacctcccaagtggaccttttctttcttcttgtcccacggttgccctgggatggcaacattcagggaagacactggcgtccatagtcagacccacactcaggctcctccccagcctccagctcctctccaagactatggaggcactgccatagtccagaccagagcagactgctctgtccttggccttcacacacttctagcactttgttccccaggatgttaccgaatctggacaaaaaaacggagcttctccagccacatgcctaccatgcagaggctcttcatgacccagtttacacagggcctgaaagggttacggtctccagcctccatagcagacaaggtcttctgttctctgccctactcggtgggcagagtcctatccatttggagccagcatggtccttctgtctgctccttcgaaatctcttctcttcattcccctcactgcaagcggcaaccaagtctgggcaccacaagcagccacaccatgttaccatatgtgcctcttccaggcatggaagctacatataacaccagcggcagtcagacgaggctggagcctccattccctgccttggtaccaaagtcttgcttggtagcagaatcagctgtcagcaagctcctgctttcagcctctgagttccaggttcgtggattggatgagctggatggtgtgaaagcagcatgcccctgcccacagagcagccccccagaacagaaagaggttaaagaagaaggagtttagtttagaagagatatataccaacaagaattataaatctcctcctgcaaacaggtgtttagagaccatctttgaggaacccaaggaacgaaatggtacactaatctcaatcagccaacagaagaggaagcgagttctagaatttcaggattttacagtcccgcgaaagaggagagctcgaggcaaagtcaaggtggcaggcagctttaccagggcccagaaggcagctgtgcagagtcgagagctggatgctcttttgatacagaaactaatggaactggagaccttctttgccaaggaagaggagcaggaacaatcatcaggctgttgagaagcgattcagtttgagggtctcaattttagggtttttttgttttgttttgtttttgggttttttttttttttttggacctccttggaaaaggttgcctaattttgccctaccgccaaaccactcaaaaatgcacagtccatgaatttttacctatttcaaggtgcaacctttttagaaactggtgaaggagggtcctctacttttactgctgagtatagaacctcaggaatgctccctttctcctggaaatggacctgaacgacatccagccacctcctcagtctctgccatccacaggaggaagcagcagcctatcttcagtaacactaggattccaaggacacacaggatttgcacgtccatatgaaagttccgctttgtttacggtggtgctagaccaagattattagaaacgtggcctagggagggggacctggcgtcctgtcctgtgtggtctcactggctcatttcagtagttgaggaaagatgagctgttgtgttttcttatcttttgtctgcccaggacctattgatgtgagtgtatgtgagagtgtttgtgtgtgtgtggctttttcccatcgttttctcccctctgtgactgggtcactagtgccagaggagcccgtccaggccccattcgaagtaagttgcactttttaatgttgtggtgtggattattttcatttgttttattttcttttttgttgttgtttttgtactattattgctgcatgtgtggagcctttaaatgtgattttaaaacatttttttaaggagaaaaacaatacatgtcttaagaatacatgataggcatttgacccagttgatcgctgcatggaagagacatttttcctattcatgtgtttcaggcaatcccttccccatctccagcttctagtgtaactcattagagggagcactttttttcatctgggttctcattcttgcccaccaaatacatgtatttattttagtgatttaagtaagagcaggtttctctcccgatcattgaaaaactactatggttgggtgtggtcttaatggtttttatctgaaatggtgttaggtaacaaaattgagtacaacggcttgggcagtgatacaggctgacccacagtatttgtggctttccaggcagcccgcttcaagtgtggggagagagtcggggtcatgtttcagacccagagatgtgttcctgcagtgggatctcaaaaatccccagccagccttctttgagggccacctcattgtactctgggctcctacgtcacatctaccggaactgtcaaatgctggagttagccgagtttctgggtttgtgcctgcaggagtctgtgggcagagggatgctgtgggtcagcagcctcgaggtcttgttccttttccactgaagtcctgtgtgtccatatcctgctccccttcccctccttctctaggggtttctctttctctctcaaaacaagagtttagagaattaacattccatggctagtgagtgggatgcaaaagtcatcgtcaggacaccagcatcacctcttcatatcctcctgggagccactggcatggagcagccgccgatgggaaccgtcagagttctagggacatttccaagtcagtctattagagaagagtgagtggcacgtcctggaatgttggccaactctcctaggtttcttttgcttccccatttgctagtggatggggagatgggttgggggtggggggtctctatgtgccttgcttttgcaggttgacagtctatgccacactggagcagaaaaactgacatgagccagagggaaaagtgtgccacggctatgttctaggcccactgcctcagacatagcattgagacgagtgaaatacacacttggtcatccacggaggcttccaaggccatggccaaatacagttagaagagagccaggcttccgtaccagctctgaatgatgctaaccagattctgtcattctacatccactttgcccagactgtatagacacgacctatgtttcacctcaatacctctcccttcctgggacagggttcttagacactaaatgcttctctctgacttttttgcttaagggagtgggatgagtagtacattttgcccttgtccaggcatgtttaaggagctcctactggacaggttgcagactagcagtgagtcaacagagccctgtttgccagctctgttgccagtatagatgcagtgatgtggcggctatgtttcccagagacaacagtgggcacagctatagtgtcaccaacatggcagagatagtttcaactgtgcctgttacaggtgtggcactcgaaggaccagaagcagcggtttggaacatgggtaactgggagcagaggactggaagaaacagagctgggctccttccctgtcctgacaatgtaggagaggagttgttgtgaggccagccctgcccgtcgttgaaattctggacctaccctctagctaggtcccttcccctgctccaaagttgagaagggggccccactgcaaacttgaaattacttacctgaaggtgatgtatatacctaggctccagctgcgctcagccacacctgtcttaacattcagtttcggcactgagccagctgcagtgttgtcaggggtccccaggcccgtggtccctaaccacgatgggacatggtaatcggctgctggcacaccacctgcccagagctacaggaggtctggttctggggtggagttggtacagtttctgagtatgggaacttccctccccaagtggtgggaagttacagttaactacagcttactcaactatcacttccagaggtttagtgtttttaatatgggaaagaggagaaatctcaggtctaatcagggttctgcccatcagcttttcactgaaactttcaactgtgttttgttttttgtttttttttccatctttcagtttctagctgtgtttgccttctccctccgcgttccctcctctttttttgcttttggtctcctttccagcttcatgtctccatgagttcagctgtacctcatctcctgttaaagcagatcatgtccactttttcttactgaccttactctaagctacagtagctgagggaggtacggtgaagacatgtagcgtttgccttattcggagcctgaggagcccagaaacccatgctgtgaatcccaaaactcagcgctcctcaagagctgtgaaaatcatgatactttgtcacaattttgcctgaaagggtctttggcacgggctccagagccaacctgaggtccattccagatcccactatctgggcgtgagacctcccccgtggctccttccttgcccactgagccaagagcagcagggagcgtacaggacgggagcagcagatccaaggccgcggtgcagccaatgaatgcacggccgtcgctccgtctccaggctggaattccgtctcataatcaatgccatgtacattaagatctgcgaaagaccaacttttaggcagtgatacttttctcccattccctggggtggggggagtatgcagttggtgctttctgtaattcccttgttctgttttgtttctgtaagcttttcccctggtgtcatggaaaggacttcttaaataaccacattgtgggtggctgtatccaaagtttaaataattggccagaagtgcagagtatcctttcctggattcgtgtcagaaaagggctccttgccacaactgaacttactgtataaaaacctggctagggagatttaattttactaaaattacagtttaatgttaccgtctagccacaaatcaagcagcaaaagctattttgatgatgaaagggggtccccgttgagctggccatctagtgcagtgtgctctcagattccatgtttgttgattgtgtgtcttcacaagcccctctctggtgctgaattggatttgaattcttggtgagaggcctcagcatctccttgggctggtctgggccagtaaaaatagctgcctgacatgtttatatattatcatggtcagtagttcaatgaaatttgtacatttttggtaacattggtatacatgatgcccctgcagttccttttctgtttggtagtttgtgactctaagatttccactgttatgtgtgttaatttatgaaaataaatttttttgaaaacctttc

SEQ ID NO: 5944 - DNA, 10826 bp, Homo sapiens
gagacgaagaggtggcggcggccggagcgcccccggcctctgtcggctccgtaggctcaggtagacctggcgacgacggggctgcagctgcaggggctgagctggctgggcaagcgcgggccgcggaggaggtctcaggggtgaatcatttgatgtaaaagacttgactccataatctgcatctgtcctaatgctgtcatctggagtagagactcagccagttccacttgattcctccatgtctgccgtggtacaggaattatactctgaactcccagtaagtgtctccagagagcttcatgctgaccctgagccaagtgtgattccagatgtaaaacctggagcctcaagctctcttttaagtcagaatagggcattgcccttggagctgcagaggactcatgtggagagttgttgtgaagaaacctatgagaccttggatcatgggagtgagcctgggcgatgtgggctagtggactccacagcaggaggttctgtggcatctgggatcttggatagggcaaagagaagcgagagcatggagccaaaggtcttcagagatccagggggccaggcaggaattataagagaaccctctgagggagcaaaggaagatccacatcaacattccacagctgctgaagaaaagactagcccgagtcaggaggatctcctgatgcagtccagcaaagaactttcacatgtggacctccctgaagattttctaaggagcaaagaaggaaatgtacagattacagctgaaactctgctaaaatccgccgaagtacaaggtatgaaggtcaatgggactaagacggataataatgaaggacacaaaaatggcaatgtgagtaaagatctctcagctggatgcggtgaattccaagaagtagacaaaatcatgaccagtgatgaggtttcagaaaccagcacattagttaccccagaacctttaacctttgtggaccctgtattaacagaagcaactcctaaagaaaaagaatgtgaagaattaaaaagttgtccttggttgtcattaccaggaaacagtgccatttctaatgtggacaatgggaaggaagagttgtgtaaaccaaacctggtctgtgaagcagatgacaatcaccaacagcttcatggccaccataatgaacaacccagttctacacatgatagtcccacagccacaagccctttgaaagaaaattctgaagtttcatgtttcacatcagacttgtctggtccagaatccagaacaatatccttagaaaactgtggttttgaaggtggtggtttgctaaagagatctgctgaaaagacagacagttcttatttttataggggggatgatcaagggaagaacttggcttctagagaagaaaatgaggaacggcttttgattcctaggagtgaaagaggtggaccttttctttttaatgccagggaaccagaaaaggagattagtggtcgttgttctggtgaaaaagagcctgttgtttctccaaaggaaaatatccacaataactgcattcaagacagtctccatacagggaactctagttctttaatgcccaattcttttactgaagccacagaagtaatgttaaataaaaatgatttgaaaattactgtacacgttcaaggtaacttgacaaaccctgaggaccataaagaaacttttactaatatgagccatcctggtggacactctgaagaaagcagtttttcctccttgatgcagattgaagaggcaggacagacaacccctgtagagcccaatatattaagtaaatctttttacactaaagactgtaactccttagtcagcatccagagaaatctggaaggcaacacccagttaaatgaagcatcatgtaatgattttctgtttgaaagaaaatccattgtgagtttaatgccagaggatcaaataagtcctgtaagtgaggtattaaaacccaagcaaggtactgctctgttgctaccatccccagaatttgattacagacctgagtcagaaaaagttatacagacctcacatgatgatattccacttttagatgaacagagcatagcctgtgagatgaatgaactttcttgtaccaatgaactggttgtaaacaaagtagaaagtgaatgtgttttaaatcaacaagtgtcccttaattctcaagaacatgcaaatttgccaactgactctctactgcatttaaacaaagagatgcctttagcaacaggcagagatgcccatcagagccatcaccctccattagagggtagagcagatgtcattgctgatatacaaaccattcccattcagacaaaaataaaagacatctctccaccaggtaaccaaacctgtggtgcctcttcaaactgtcccaccttaaacatcaaaccagtaagcctagagagaaaaaaggaaatggctgattcaggaacaaaagctctacattccaggctgcgctcaaataagagagaagcagctggctttcctcaagtggtctctgtcatagaatgtcacagcgttcaatctcaggatatctctagctgtcatcgtgtaagaaaaaatgtatcccaggaaaacatgtgttctgcttctgctgctttcaagtccagcaaaatcagcctgcaagttgataactctttgataacaaaatatgaaaatgcatttcagcaccgtgatcactgctgccaaggaacaggacactctgtggaaaaaagcagctgtaaagtgagttacacatcacaggaaagggaacttgatgggaaagaaacgaatggcagccttccaggagataagatcagaaacaaaatggtagcaggcttgttaaatagtggaatttcaaacaaaaccattcacacctccagtagcatcaaactcagtgaggaagggctggaaggaaaggagcaggatgtatccaaagaaactgtattttgtaagtataacatctctgatcatgctatacaagaactaaaccagactgtaaacattccaggtcctgaaaaagtgttggaccagtctcctactgttatgttctccagttttaaaaatgtaaaatcagttgaaacactcgatcagaaggcagatgaagtccttgactgtcagagtaaccaaaacagaccagatgaatgcaaaagtgaaggtcagtcagccaaggagatgctaagtagtgaccagagagagactgtcaccgagcctcacggggaggtaaaccacaaccaaaaggatctgctggtcagctcaggcagtaataactcactaccttgtggtagtccaaagaaatgcaatttgaaaggagcctttgtcaagatgtctggttgtgatgagtccacagaaggtatggtagacatcgtctacacggactgtagtaataagcttgcagaaggtgtgctggacgtgaaggcatctaatctactggattgtggtgcaaggcaagagaaactggcatttcaagaggactccaggagtaccttgtctcggagagaactggatgctgcacatacaggaacaactggtcaggattcagatttcccagttactgctgcttctacagtggactttctcaaaataaaaaaatcatgtgaagaaaacgtatgcagatctttaaaagactgtgaaatggaaaagtgtccagactcttgtgcccatgagatggagtctgttgcagatcatgaaccaaataaaagaatattgggcagagtaaatttgtctttaaatgatagccattatggacagcaagataaaggaacatctctcagagaaacacaagaaatgactgaaggatcaagactagaaccaaactctgagtttggcaaagaaagtacctttggaatttcctcaaaagagtcgatgtcttgccatgatgaaagctctgtttccctaagaagcctgaaatccattgaaataatgccttctcaagaaaattcagaaactaatgttaacagtgaagaaactgacctgaaaaatctttgtaaaccaaaagatggtgaaatgctttgtgaaaatgtaaaggactgcacagtccttcctgagatgaaggaaatagtatcaagagattggagtaattctagtgacagagacagcgtatgtacctgtgtggaaaagaatgcttgcaaagcttgtcaccctcacgagaattcctctgacagacatttgcctttgacagtgaaaacagatattaaagtgaaaggagaagaaaccgaagagcatcagaggggacgactgggttacttaactgttggggagcaatctgaggagttggttaccagagaaactggcgatggcgatcccgtgagcaacatctctcagacccattttaaatgccgggggatacttaatcatgctgaaaaacagcagagccctgaggttttggactacatgttgcagaaagaagagaaatatatacgtcaacaaaaagcacatacgatatcgcaacagtgcatatcatctagtctgttgttagatgatgcacaaaatcagaaccaaccgaaggctgacaaagatgagtccaccatgatcaatgaaatcaccctagcaaagctggccaaggacagcattgtggcacagactcagaagttagaagaccagaaggaggaaaggttacatcatccattaaggaaggacactgagtcatgcacaagtccttgccttcttggtgcccctcggaaagcacaagacccctcctctgctgggtgtgatcaaatacatggtgcctttgcgaagaaaggagttcttcccttaaagaagcagccccatcgaacttgtaagaaagtttcctatcaggagcaaatcattgttgggagaaaaataggtaaaatcagaagttctgcctttttaaagagttcttccaatcccatccccacaaaagcgcacagacttctcagtttgtgtactctgtctgcacctacacgattagaacctgaaacagcacctaccaagagcttggttagtcacataccaaagcagatgtctacaccgtgccatcccttgaggagcctgaattttaggaagactaccaaagaatcagccttactaaacaagctgtccatccttgcctccaaactggccccagccatgaagactcagaagctaagataccgacggtgttcctctgaacttcttccaatggctaaaagctacaagcgcctcagatataaaagactcctggacggattttcatccagcacagagcagctgaatccatatttggcagctagtggatgggataagaggcctaacagtaagcccatggcactttattctctcgaatccatcaagatgaccttcatagatttgagcaacaagatgccgtccctgctgtttggttctgaaatcttcccagtatcctttcatgtgaaatcatccagctcagattgcacgactgagtcctcaaggacttttcctgagcactgtgctccggcaaggcttgccttaggagaggccctccagtgcccgtctcaacctcccaagtggaccttttctttcttcttgtcccacggttgccctgggatggcaacattcagggaagacactggcgtccatagtcagacccacactcaggctcctccccagcctccagctcctctccaagactatggaggcactgccatagtccagaccagagcagactgctctgtccttggccttcacacacttctagcactttgttccccaggatgttaccgaatctggacaaaaaaacggagcttctccagccacatgcctaccatgcagaggctcttcatgacccagtttacacagggcctgaaagggttacggtctccagcctccatagcagacaaggtcttctgttctctgccctactcggtgggcagagtcctatccatttggagccagcatggtccttctgtctgctccttcgaaatctcttctcttcattcccctcactgcaagcggcaaccaagtctgggcaccacaagcagccacaccatgttaccatatgtgcctcttccaggcatggaagctacatataacaccagcggcagtcagacgaggctggagcctccattccctgccttggtaccaaagtcttgcttggtagcagaatcagctgtcagcaagctcctgctttcagcctctgagttccaggttcgtggattggatgagctggatggtgtgaaagcagcatgcccctgcccacagagcagccccccagaacagaaagaggctgagccagagaagaggccaaagaaagtctcacagattcgcatccggaaaaccattcctaggccagatcctaatcttacccccatgggccttcctcgacccaaaaggttaaagaagaaggagtttagtttagaagagatatataccaacaagaattataaatctcctcctgcaaacaggtgtttagagaccatctttgaggaacccaaggaacgaaatggtacactaatctcaatcagccaacagaagaggaagcgagttctagaatttcaggattttacagtcccgcgaaagaggagagctcgaggcaaagtcaaggtggcaggcagctttaccagggcccagaaggcagctgtgcagagtcgagagctggatgctcttttgatacagaaactaatggaactggagaccttctttgccaaggaagaggagcaggaacaatcatcaggctgttgagaagcgattcagtttgagggtctcaattttagggtttttttgttttgttttgtttttgggttttttttttttttttggacctccttggaaaaggttgcctaattttgccctaccgccaaaccactcaaaaatgcacagtccatgaatttttacctatttcaaggtgcaacctttttagaaactggtgaaggagggtcctctacttttactgctgagtatagaacctcaggaatgctccctttctcctggaaatggacctgaacgacatccagccacctcctcagtctctgccatccacaggaggaagcagcagcctatcttcagtaacactaggattccaaggacacacaggatttgcacgtccatatgaaagttccgctttgtttacggtggtgctagaccaagattattagaaacgtggcctagggagggggacctggcgtcctgtcctgtgtggtctcactggctcatttcagtagttgaggaaagatgagctgttgtgttttcttatcttttgtctgcccaggacctattgatgtgagtgtatgtgagagtgtttgtgtgtgtgtggctttttcccatcgttttctcccctctgtgactgggtcactagtgccagaggagcccgtccaggccccattcgaagtaagttgcactttttaatgttgtggtgtggattattttcatttgttttattttcttttttgttgttgtttttgtactattattgctgcatgtgtggagcctttaaatgtgattttaaaacatttttttaaggagaaaaacaatacatgtcttaagaatacatgataggcatttgacccagttgatcgctgcatggaagagacatttttcctattcatgtgtttcaggcaatcccttccccatctccagcttctagtgtaactcattagagggagcactttttttcatctgggttctcattcttgcccaccaaatacatgtatttattttagtgatttaagtaagagcaggtttctctcccgatcattgaaaaactactatggttgggtgtggtcttaatggtttttatctgaaatggtgttaggtaacaaaattgagtacaacggcttgggcagtgatacaggctgacccacagtatttgtggctttccaggcagcccgcttcaagtgtggggagagagtcggggtcatgtttcagacccagagatgtgttcctgcagtgggatctcaaaaatccccagccagccttctttgagggccacctcattgtactctgggctcctacgtcacatctaccggaactgtcaaatgctggagttagccgagtttctgggtttgtgcctgcaggagtctgtgggcagagggatgctgtgggtcagcagcctcgaggtcttgttccttttccactgaagtcctgtgtgtccatatcctgctccccttcccctccttctctaggggtttctctttctctctcaaaacaagagtttagagaattaacattccatggctagtgagtgggatgcaaaagtcatcgtcaggacaccagcatcacctcttcatatcctcctgggagccactggcatggagcagccgccgatgggaaccgtcagagttctagggacatttccaagtcagtctattagagaagagtgagtggcacgtcctggaatgttggccaactctcctaggtttcttttgcttccccatttgctagtggatggggagatgggttgggggtggggggtctctatgtgccttgcttttgcaggttgacagtctatgccacactggagcagaaaaactgacatgagccagagggaaaagtgtgccacggctatgttctaggcccactgcctcagacatagcattgagacgagtgaaatacacacttggtcatccacggaggcttccaaggccatggccaaatacagttagaagagagccaggcttccgtaccagctctgaatgatgctaaccagattctgtcattctacatccactttgcccagactgtatagacacgacctatgtttcacctcaatacctctcccttcctgggacagggttcttagacactaaatgcttctctctgacttttttgcttaagggagtgggatgagtagtacattttgcccttgtccaggcatgtttaaggagctcctactggacaggttgcagactagcagtgagtcaacagagccctgtttgccagctctgttgccagtatagatgcagtgatgtggcggctatgtttcccagagacaacagtgggcacagctatagtgtcaccaacatggcagagatagtttcaactgtgcctgttacaggtgtggcactcgaaggaccagaagcagcggtttggaacatgggtaactgggagcagaggactggaagaaacagagctgggctccttccctgtcctgacaatgtaggagaggagttgttgtgaggccagccctgcccgtcgttgaaattctggacctaccctctagctaggtcccttcccctgctccaaagttgagaagggggccccactgcaaacttgaaattacttacctgaaggtgatgtatatacctaggctccagctgcgctcagccacacctgtcttaacattcagtttcggcactgagccagctgcagtgttgtcaggggtccccaggcccgtggtccctaaccacgatgggacatggtaatcggctgctggcacaccacctgcccagagctacaggaggtctggttctggggtggagttggtacagtttctgagtatgggaacttccctccccaagtggtgggaagttacagttaactacagcttactcaactatcacttccagaggtttagtgtttttaatatgggaaagaggagaaatctcaggtctaatcagggttctgcccatcagcttttcactgaaactttcaactgtgttttgttttttgtttttttttccatctttcagtttctagctgtgtttgccttctccctccgcgttccctcctctttttttgcttttggtctcctttccagcttcatgtctccatgagttcagctgtacctcatctcctgttaaagcagatcatgtccactttttcttactgaccttactctaagctacagtagctgagggaggtacggtgaagacatgtagcgtttgccttattcggagcctgaggagcccagaaacccatgctgtgaatcccaaaactcagcgctcctcaagagctgtgaaaatcatgatactttgtcacaattttgcctgaaagggtctttggcacgggctccagagccaacctgaggtccattccagatcccactatctgggcgtgagacctcccccgtggctccttccttgcccactgagccaagagcagcagggagcgtacaggacgggagcagcagatccaaggccgcggtgcagccaatgaatgcacggccgtcgctccgtctccaggctggaattccgtctcataatcaatgccatgtacattaagatctgcgaaagaccaacttttaggcagtgatacttttctcccattccctggggtggggggagtatgcagttggtgctttctgtaattcccttgttctgttttgtttctgtaagcttttcccctggtgtcatggaaaggacttcttaaataaccacattgtgggtggctgtatccaaagtttaaataattggccagaagtgcagagtatcctttcctggattcgtgtcagaaaagggctccttgccacaactgaacttactgtataaaaacctggctagggagatttaattttactaaaattacagtttaatgttaccgtctagccacaaatcaagcagcaaaagctattttgatgatgaaagggggtccccgttgagctggccatctagtgcagtgtgctctcagattccatgtttgttgattgtgtgtcttcacaagcccctctctggtgctgaattggatttgaattcttggtgagaggcctcagcatctccttgggctggtctgggccagtaaaaatagctgcctgacatgtttatatattatcatggtcagtagttcaatgaaatttgtacatttttggtaacattggtatacatgatgcccctgcagttccttttctgtttggtagtttgtgactctaagatttccactgttatgtgtgttaatttatgaaaataaatttttttgaaaacctttcaaa

SEQ ID NO: 5945 - DNA, 1678 bp, Homo sapiens
gtggcagcggtgaccgcctcctgggttattttcttttctcccccagctgccccagggttctggtttcccgaatcacttggcaaataaccagcaggtgggcagatgtcttttttgcgttcctacggacgcgtaggcaagttcgatgcgccggagtgaacagccagggtcccatctctcagccggctcccgggcggtgctagcagggaagagggacgcgccggcgaatgaaacactactagcccggaaagccgccctggaccttccacccgggcagcgagtctggcggcccctcgccgccgccccctccgaccagaacagactgcgctgcgagccccgggcttccgccgcagcgcgcagcaattggaggtgccagaggagaccagcagcagcacttgatttagctgggctgcgggaattccgacctgtacactttccagaagcctgatctctccaagtccgcgcccagggactcgagccccggcttccaggttgacccgagcgcgcccccttcgtgctctcggccgcgttcaccgcgcgaggcctccgggtcctgttaagcccgagcagcacaggccgctgcctcagcatccaccccgcagcccacgtgtggcaagccggggaaggggtggagtgaacggccggagaccacgtggagaaaggggccgctttggcccttccatctgggtgccgggagcccctaggccctccggccatggccgacagcggcgatgctggcagctccggcccctggtggaaatcgctcaccaacagcagaaagaaaagcaaggaagccgcagtgggggtgccgcctcccgcccagcccgctcccggggagcccacgccacctgcgccgcccagcccggactggaccagcagctcccgggagaaccagcaccccaatctcctcgggggcgccggcgagccccccaaaccagacaagttatacggggacaaatccggcagcagccgccgcaatttgaagatctcgcgctccggccgctttaaggagaagaggaaagtgcgcgccacgctgctcccggaggcgggcaggtccccggaggaggcaggctttcctggtgacccccacgaggacaagcagtagccccaatagcctgcgcgctccaggactgcctacccagcactaccccaaacccccagttccaaacccgagacttcaggcccgcccccttacgcgttgtctcattccaccaaattcagaatatttacacaatgccttcatgattttatttttctggaaattgaagtgtcaattgggttctcaatatttcatgactccaaggatgcattaaatatttatttgtggtaagagaagatacctgccgcggaggagggtggcataattatttttttttcaaaaagctattctggggccctggccccctggctcctgtcacagctcagcttgaactctgtagcctctcaaatgaagaaggtggctgttatttaggactctgtggaaagcaaatcacagtgctgtttttaatgcctgagaaatgcactttaggggtagacttataccttaagtgaaggagtgggggaggaagaagcattcttaagtagaagcattttaaaataaggcaggattgcttttaatgttaaactacaaaactgtacagcctattttagtgtggactattaaaacccttgcactgtaagg

SEQ ID NO: 5946 - DNA, 503 bp, Homo sapiens
agtaaaaggaagaattaggatggcggttttcaagggaagttaagtctagacatgcttctttgaaagtcacaaggcagaagtggtcaaaagtagaatttaaaagaaccaaaacaaatatcataagcttgtccttctctcctactgggatataaattctcctaagtatctcatcgaaaaggctcctgggacgaaagtcgatgggggcaaatcttggagggaaatttcgtgactgtttgaccatggactaattaataccgttcacctgtagagaggatgcacttggttcccagcgccctcctcccagcacaggccgctgcctcagcatccaccccgcagcccacgtgtggcaagccggggaaggggtggagtgaacggccggagaccacgtggagaaaggggccgctttggcccttccatctgggtgccgggagcccctaggccctccggccatggccgacagcggcgatgctggcagctccggcccctggtggaaatcgctcacc

SEQ ID NO: 5947 - DNA, 1382 bp, Homo sapiens
ccgagtctcaccctcccaggcagctcctacactcaactgcttctctaggaaaggtctcacctccagcctggagcagtcgggattacagaaagccccatccttggcttagggagcgccatgacgactgaaattggttggtggaagctgactttcctccggaaaaagaaatccactcccaaagtgctgtatgagatccctgacacctatgcccaaacagagggagatgcagaacccccgaggcctgacgctggaggccccaacagcgactttaacacccgcctggagaagattgtggacaagagcacaaagggcaagcacgtcaaggtctccaactcaggacgcttcaaggagaagaagaaagtgagagccacgctggcagagaaccctaacctctttgatgatcacgaggaaggacggtcatcaaagtgaagggctgaggagggtgctagcacctcttggctccctgccatcagccagatctgagacaggaccttgccacgctggcctctttggccatagctgaagctgtggggccagttgatacctgctggcaggaaatggctgttttttaggtttgtatttatgtgccgccacttttgtaaggcctgggagatcccagggtcctccaccctccccctgaccacatacaaaggcactctagttcaagagtgaaaagtctcacccaggaggaacagccctccttgaagcaatggcagggccagcagggaggtgggcatggcagggaatggagagagtgagccagacagacttcacctccttactggacacagggtcaagggcgagtttcaattgctgctccctttactttctctacctgtgactactccctggaccaatcctgaggagggcacattttccagaagccacgtgataggggctggtttctgtggagccagaggcagagacactgaacttgagctcacctcctaacaccggcagtaaacttcctggaactttgccctcaggtgcggaggggacagaggaccctggcactctgttagggtgctgtagaagactagattgatggtagtttggcctgttagttcctgttttggccatgacttttgcagatggcaagtcacacaccctcaaagggaagctacacgggccaaatcgggggagtgggtggggaattttctcctctccctttcctactataatagtatttaagacatatcagctccagagatgagtcctggagccttgaattttgtttaacaaaataattgtaggtttctctctgtaataacaacgctggaaaggcagagaacctcttttatgctcatgtcttgcatttattgagatgactgtttctcatgcctttatgttccttcatgtaagtaaagtggacctttgtgctc

SEQ ID NO: 5948 - DNA, 1826 bp, Homo sapiens
gccgcccggccgagcgcggagcgcagccactcgccgctgcccagggagcgcccaagatgtggggggaccggggcggcagcggccgtagcagcgccagggacgggggcacgcagcagcctccgctcgcccgcctgtcctgacctgcctcgcttgcccccaaagaatgtcagccaagtccaaggggaacccctcctcgtcctgtccagccgagggaccgccggcagcctccaaaaccaaggtgaaggaacagatcaagatcatcgtggaggatttggaattagtcctgggcgacctgaaggacgtggccaaggaacttaaggagatgaagtcccactctgttgcccaggctagagtgcaatggcacaatctgggctcactgcaacctctgcctcccaggttcaagctattctcctgcctcagcctgcctcagtgcgccactacgcctgggtggttgaccagattgacaccctgacctctgacctacagctggaggatgagatgactgacagctccaaaacggacacgctgaatagtagctcaagtggcacaacagcctccagcctagagaagatcaaagtgcaggctaatgcaccgcttattaaacccccagcacacccgtctgctatcctcacggtcctgagaaagccaaaccctccaccacctcctccaaggttgacacctgtgaagtgtgaagaccccaaaagggtggttccaactgccaatcctgtaaaaaccaatggcacccttctacgaaatggaggcttaccaggtggacctaacaaaattccaaatggagatatctgctgcatacccaacagtaacttggacaaggctccagtccagcttctgatgcatagacctgaaaaagacagatgtccccaggcagggcctcgagaacgagttcggtttaatgaaaaagtacagtaccatggctattgtcctgactgtgatacccggtataacataaaaaacagggaggtccacttacacagtgaacctgtccacccaccgggaaagattcctcaccaaggccctcccctccctcctacaccccatctccctcctttcccactagaaaatgggggaatgggaataagccacagtaacagcttcccccctatcagacctgcaactgtgcctcctcccactgcaccaaaaccacagaagacgatcttgaggaagtcaaccactacaaccgtgtgatgtatgccattaaaaaaattgtttttttaattttctatattataaacataaaataagtaatgagcactttctactcaagcaataaaaagcccaaatatattaatcctgcattcagcaaagtggcataaaaatcacctggtaagtatgcagcacattgcttatatcctgggtatgcattattttaaatgttgtatcattaaaaacctcagaatgatgaaaaatatgaatgatgcattgtttttgcaattgacctatgacaaactgtgaacctgcagatttcacctattttgatttactataagagctgggatttgattcattttatttatgcctaagtcatctatgcattaacatgtcatattcttaactttgatctaatgctttttactaggaaattttaatactgaaggactattttattatttttttctaaagatgtttgtcactagtttttcattattaaatgctgaggccaataccaagaagtttattttctatattatacaattatgaattacatgctcagctatatatgtaataaaatactttggtctgtggaaatattgttaaatcaataaacaatagtaaataatgacaaaagcaaatgttcctcagaattaaaa

SEQ ID NO: 5949 - DNA, 1747 bp, Homo sapiens
gagccgagcgccgcgtctcgggagttgatggcagcaccactgtgcggccgcccggccgagcgcggagcgcagccactcgccgctgcccagggagcgcccaagatgtggggggaccggggcggcagcggccgtagcagcgccagggacgggggcacgcagcagcctccgctcgcccgcctgtcctgacctgcctcgcttgcccccaaagaatgtcagccaagtccaaggggaacccctcctcgtcctgtccagccgagggaccgccggcagcctccaaaaccaaggtgaaggaacagatcaagatcatcgtggaggatttggaattagtcctgggcgacctgaaggacgtggccaaggaacttaaggaggtggttgaccagattgacaccctgacctctgacctacagctggaggatgagatgactgacagctccaaaacggacacgctgaatagtagctcaagtggcacaacagcctccagcctagagaagatcaaagtgcaggctaatgcaccgcttattaaacccccagcacacccgtctgctatcctcacggtcctgagaaagccaaaccctccaccacctcctccaaggttgacacctgtgaagtgtgaagaccccaaaagggtggttccaactgccaatcctgtaaaaaccaatggcacccttctacgaaatggaggcttaccaggtggacctaacaaaattccaaatggagatatctgctgcatacccaacagtaacttggacaaggctccagtccagcttctgatgcatagacctgaaaaagacagatgtccccaggcagggcctcgagaacgagttcggtttaatgaaaaagtacagtaccatggctattgtcctgactgtgatacccggtataacataaaaaacagggaggtccacttacacagtgaacctgtccacccaccgggaaagattcctcaccaaggccctcccctccctcctacaccccatctccctcctttcccactagaaaatgggggaatgggaataagccacagtaacagcttcccccctatcagacctgcaactgtgcctcctcccactgcaccaaaaccacagaagacgatcttgaggaagtcaaccactacaaccgtgtgatgtatgccattaaaaaaattgtttttttaattttctatattataaacataaaataagtaatgagcactttctactcaagcaataaaaagcccaaatatattaatcctgcattcagcaaagtggcataaaaatcacctggtaagtatgcagcacattgcttatatcctgggtatgcattattttaaatgttgtatcattaaaaacctcagaatgatgaaaaatatgaatgatgcattgtttttgcaattgacctatgacaaactgtgaacctgcagatttcacctattttgatttactataagagctgggatttgattcattttatttatgcctaagtcatctatgcattaacatgtcatattcttaactttgatctaatgctttttactaggaaattttaatactgaaggactattttattatttttttctaaagatgtttgtcactagtttttcattattaaatgctgaggccaataccaagaagtttattttctatattatacaattatgaattacatgctcagctatatatgtaataaaatactttggtctgtggaaatattgttaaatcaataaacaatagtaaataatgacaaaagcaaatgttcctcagaattaaaa

SEQ ID NO: 5950 - DNA, 1179 bp, Homo sapiens
ttaacagaagctccattacctactcccacctccccacatgatgaaacagggaaacagtgctgcaggcatacagtgacaacaggacatcaggaaatgcccaagaagtttgttaggtgctgtgtcatgaatcaagtcttcattttaatgtgttctaattgttgtaaaacaagagggaatggtatttggaatttagctatatttatcttctcaatcaaattctacttcagaggtggttgaccagattgacaccctgacctctgacctacagctggaggatgagatgactgacagctccaaaacggacacgctgaatagtagctcaagtggcacaacagcctccagcctagagaagatcaaagtgcaggctaatgcaccgcttattaaacccccagcacacccgtctgctatcctcacggtcctgagaaagccaaaccctccaccacctcctccaaggttgacacctgtgaagtgtgaagaccccaaaagggtggttccaactgccaatcctgtaaaaaccaatggcacccttctacgaaatggaggcttaccaggtggacctaacaaaattccaaatggagatatctgctgcatacccaacagtaacttggacaaggctccagtccagcttctgatgcatagacctgaaaaagacagatgtccccaggcagggcctcgagaacgagttcggtttaatgaaaaagtacagtaccatggctattgtcctgactgtgatacccggtataacataaaaaacagggaggtccacttacacagtgaacctgtccacccaccgggaaagattcctcaccaaggccctcccctccctcctacaccccatctccctcctttcccactagaaaatgggggaatgggaataagccacagtaacagcttcccccctatcagacctgcaactgtgcctcctcccactgcaccaaaaccacagaagacgatcttgaggaagtcaaccactacaaccgtgtgatgtatgccattaaaaaaattgtttttttaattttctatattataaacataaaataagtaatgagcactttctactcaagcaataaaaagcccaaatatattaatcctgcattcagcaaagtggcataaaaatcacctggtaagtatgcagcacattgcttatatcctgggtatgcattattttaaatgttgtat

SEQ ID NO: 5951 - DNA, 1298 bp, Homo sapiens
agcatgtctggtatccagcttttaatccgtaatgccaggcactcccaaataaaaggaaccaatcaactgatgcatgcattctctagcaggtcattccagaagctccattacctactcccacctccccacatgatgaaacagggaaacagtgctgcaggcatacagtgacaacaggacatcaggaaatgcccaagaagtttgttaggtgctgtgtcatgaatcaagtcttcattttaatgtgttctaattgttgtaaaacaagagggaatggtatttggaatttagctatatttatcttctcaatcaaattctacttcagaggtggttgaccagattgacaccctgacctctgacctacagctggaggatgagatgactgacagctccaaaacggacacgctgaatagtagctcaagtggcacaacagcctccagcctagagaagatcaaagtgcaggctaatgcaccgcttattaaacccccagcacacccgtctgctatcctcacggtcctgagaaagccaaaccctccaccacctcctccaaggttgacacctgtgaagtgtgaagaccccaaaagggtggttccaactgccaatcctgtaaaaaccaatggcacccttctacgaaatggaggcttaccaggtggacctaacaaaattccaaatggagatatctgctgcatacccaacagtaacttggacaaggctccagtccagcttctgatgcatagacctgaaaaagacagatgtccccaggcagggcctcgagaacgagttcggtttaatgaaaaagtacagtaccatggctattgtcctgactgtgatacccggtataacataaaaaacagggaggtccacttacacagtgaacctgtccacccaccgggaaagattcctcaccaaggccctcccctccctcctacaccccatctccctcctttcccactagaaaatgggggaatgggaataagccacagtaacagcttcccccctatcagacctgcaactgtgcctcctcccactgcaccaaaaccacagaagacgatcttgaggaagtcaaccactacaaccgtgtgatgtatgccattaaaaaaattgtttttttaattttctatattataaacataaaataagtaatgagcactttctactcaagcaataaaaagcccaaatatattaatcctgcattcagcaaagtggcataaaaatcacctggtaagtatgcagcacattgcttatatcctgggtatgcattattttaaatgttgtatcattaaaaacctcagaatgatgaaaaa

SEQ ID NO: 5952 - DNA, 559 bp, Homo sapiens
ggctgccggcggcgtcgcggagctggtagcagagtcccagcgcgccgctcactactgaatggggtcctggtgcggttctcggtggttgaccagattgacaccctgacctctgacctacagctggaggatgagatgactgacagctccaaaacggacacgctgaatagtagctcaagtggcacaacagcctccagcctagagaagatcaaagtgcaggctaatgcaccgcttattaaacccccagcacacccgtctgctatcctcacggtcctgagaaagccaaaccctccaccacctcctccaaggttgacacctgtgaagtgtgaagaccccaaaagggtggttccaactgccaatcctgtaaaaaccaatggcacccttctacgaaatggaggcttaccaggtggacctaacaaaattccaaatggagatatctgctgcatacccaacagtaacttggacaaggctccagtccagcttctgatgcatagacctgaaaaagacagatgtccccaggcagggcctcgagaacgagttcggtttaatgaaaaagtacagt

SEQ ID NO: 5953 - DNA, 1530 bp, Homo sapiens
agtttcccaatcaggtagtgagagtggcacgaaccagccgttctcctgagccaccccccgcgcccccggactcctcaatatcccaggtgggaacgctcaccagggacatccagcgcccgtcgccctgtacgtcctgcaccggcgtgggcttgctggctgggttctcctctccactcatcttggcgccgcagctcctgcaggatgagcgagtcgggtcggcccgggagtgttccgaacggagctggctccgccacgcccactcctacccctcgcggcaacaaaggaccgtcccaacgctagcacacccgcggaggacgaaggccgatacagggcgccgcctcctctccagggacggaagccttcacttaggaggacaccatggatacccagggaccagtctcccagccttttcagcagcctgagaaacctggtcgtgtccgtcgtcggaagactaggcgggaacgtaacaaggccctggtgggcagccgccggccattagcccaccacgatcctcctgtggccattcgggatccacctgtggtccctactgcctccaagctcgtggtcataacccagggccggctgagccgggagcaccggggtctcttcaaccacgaggtgaaatccctagatgttgcaaggctgcttagcagtgggaccctggtgccaggcagccccacactccccgccaagccctccccaagcccaggcagggcccaggaaccagccccacggtccagggacaaagagaaccaggtgcctggaggttcgggcccaggcccacccagttccccagagttgtctggcgtggggcagctgctggcagagctgcagtgtcagctgagtttgccacaggccttcccccggaggaacctgattcaggatgccagggatgccatcgtgcacaccttgcaggcctgtcatggttgtgtgcctgaccttgccctggtgcttcggggctgccagccacccttgccaggggccaagcctggggtctctgagagaaagatgacacccttctggattaatagccctgatcaagtcccagagcaggagaggcaaaggaagcaacaagggacaaaggagttcaccttccccatgccctacacctccagcatgcccactgcgcacagggggagtctggcaccgccaagaggtccctggccaccatactttccctcactgtcttcgccatctggaacagcctggggtcccccaacagcgtttgacttgttaaaaagcatctggctggtagccacgccaccccctcctcggccctggggggttggcctccctcagcccctgcctcagccttcatcacccctgttgccccgaacctctgtcctggactggagccccagccccccttccccactgcccagcctctcctgggtagtagcccagagcagtccggaagcctggtcttttccacccatgagactgtactgaggagaggctgaggctagggctggggacagatatcttgtactcccagtgacctcaataaagtacttttcatggtcctcttga

SEQ ID NO: 5954 - DNA, 1956 bp, Homo sapiens
cctagcctcaagcgatactcccgcctcagcctcccaaagtgctaggattacagatttgagccaccatgcctggcctcatctggtcattctaaatagtattcccaccacaccccaaaacatctccctattcacttgttttgttttgttttgtttttgagatggagtctcactctattgcccagactgaagtgcagtggcacaatcgtgactcactgcaacttctgccttctgggttcaagcaattctcctgcctcagcctcctgagtagctgggattacaggcgtgcaccaccatgcccagctaattttttttttttttgagatggagtcttgctctgttgcccaggctggagtgcaatggcatgatctcagctcaccgcaacctccacctcctgggttcaagtgattctcctgcctcagcctcttgagtagctggaattacaggtgcatgccaccacgtctggctaatttttgtatttttagtagagatggggtttcactatgttggccaggctggtctcgaactcctgacctcaggtaatctgcctgccttggcctcccaaagtactaggattataggtatgggccactgcggctggccaatttttgtattttcagtaaagacagcattttgccatgttggctaggctggtctaaagtgacctggcctaagtgatcggcctgccttggcctaccccagtgttggtattacaggcataagccaccgcgcccagccctccctattcactttgctactccccttgacttatctgcatgctgatggccaccctatctttatattccaggacaccatggatacccagggaccagtctcccagccttttcagcagcctgagaaacctggtcgtgtccgtcgtcggaagactaggcgggaacgtaacaaggccctggtgggcagccgccggccattagcccaccacgatcctcctgtggccattcgggatccacctgtggtccctactgcctccaagctcgtggtcataacccagggccggctgagccgggagcaccggggtctcttcaaccacgaggtgaaatccctagatgttgcaaggctgcttagcagtgggaccctggtgccaggcagccccacactccccgccaagccctccccaagcccaggcagggcccaggaaccagccccacggtccagggacaaagagaaccaggtgcctggaggttcgggcccaggcccacccagttccccagagttgtctggcgtggggcagctgctggcagagctgcagtgtcagctgagtttgccacaggccttcccccggaggaacctgattcaggatgccagggatgccatcgtgcacaccttgcaggcctgtcatggttgtgtgcctgaccttgccctggtgcttcggggctgccagccacccttgccaggggccaagcctggggtctctgagagaaagatgacacccttctggattaatagccctgatcaagtcccagagcaggagaggcaaaggaagcaacaagggacaaaggagttcaccttccccatgccctacacctccagcatgcccactgcgcacagggggagtctggcaccgccaagaggtccctggccaccatactttccctcactgtcttcgccatctggaacagcctggggtcccccaacagcgtttgacttgttaaaaagcatctggctggtagccacgccaccccctcctcggccctggggggttggcctccctcagcccctgcctcagccttcatcacccctgttgccccgaacctctgtcctggactggagccccagccccccttccccactgcccagcctctcctgggtagtagcccagagcagtccggaagcctggtcttttccacccatgagactgtactgaggagaggctgaggctagggctggggacagatatcttgtactcccagtgacctcaataaagtacttttcatggtc

SEQ ID NO: 5955 - DNA, 1847 bp, Homo sapiens
atataagagggacggcgctcggcctccagcagtcggctttctgctgggctcggagccagaacctgctgcgtgctccctccagactccctggctgcgggtggactacctcagagctacagcggtgaacctgtggacacctccgactcctcgggcctctcttcgtcgaagagtctcctaattttcagatctccggagccagctgtgggaagatcagcccctcccgccgattgctcatggaggaaccaaggccttcgaagcgacttcgctccatggcccctaatcaagcctcaggtgggcctcctccagagccaggctgctgtgttgcggaccctgaaggctccgtggaagcagatgggcccgcacagccagcccaacccgcaaaacccatcgcttacgtgaaacccttcagacggcagcccccagctcgcccagagtcaccccctcctgcagagagaggccggcgccggggaggaagccggcggccagggcgaggccgtggcagaagggctgggccccgcggggacgctggccagagacagggggcagaaggcttgatggcaccggacgtgcacatccaactggaccaccatggagagccaggccaccagggggaaccggaaatcacggagaccgcagccttctccctttctgaaacaggtcctccgcctggaactgtgcaggaaggccctggccccgacgtggcgcaacctgagctggggtttcaggagccgcccgctgctcctgggcctcaggctgttgactggcaacccgtcttgaccctctatccctgcatcgggtttagggctctgggtgactcagcggttttacaagtcattcaaaccccccagggcacctacgtgcaaggggtcccagtgttcctcaccgacattgcgtattgaccactatctgccacccacgttgttcccagcctcccttccttccacctggacgttccccccagccccacttctgctccactcctcccccgactggacctgaagcctgagcttcccctgaacttggagtacgcaacttacaacatgcaagctgccaaacaccctttctgtacaaggcgattggaatggaactgtcatgtacagtgaaagtacacgtcacgtttttcagccaagaagaagccaacccagacaacctggaagaagtgggatgcaacaaggatcactaagcatggaaattaggaaactgtattcttaagtccagagaagtacgattctggaaaaaggattgatgacctagaattaaaattccagaagacactcatatagacatgtgggacatgcgaaaactcagaaggagctagaagttactaaagtgcttctctagtgcctggagacgatagactggctgaatataagagcaataaaaatctagactgacacatttttaagtctcaacgtgggtaccctttgggaaccactaaatgaattggaatagaaggtaaaatttcaaacagattgaggaaaaaggggatcaaaggacatgtgacgaatcagacaaaaggtgttggggtgggggggggggcggttaacggaagcaaggagagtgcatgactcactggaaccgctaaaccaggaatcagtaatttgacggcagtgtccttggcttcctcctggctttaatgggaatattttgaatgtttcaccattaaccaagatgttggctgtaggtgtctcttagatgtttaagttgagttagttcccatcttttcagagtttgataaatgttgtattatgaacttttgtattttgtattttattaggtaggctgttgttggctggttttcactcctttgtaaacgtccaaataaaatacagataactttttacatc

SEQ ID NO: 5956 - DNA, 1847 bp, Homo sapiens; identical to SEQ ID NO: 5955

SEQ ID NO: 5957 - DNA, 1013 bp, Homo sapiens
ggacacctccgactcctcgggcctctcttcgtcgaagagtctcctaattttcagatctccggagccagctgtgggaagatcagcccctcccgccgattgctcatggaggaaccaaggccttcgaagcgacttcgctccatggcccctaatcaagcctcaggtgggcctcctccagagccaggctgctgtgttgcggaccctgaaggctccgtggaagcagatgggcccgcacagccagcccaacccgcaaaacccatcgcttacgtgaaacccttcagacggcagcccccagctcgcccagagtcaccccctcctgcagagagaggccggcgccggggaggaagccggcggccagggcgaggccgtggcagaagggctgggccccgcggggacgctggccagagacagggggcagaaggcttgatggcaccggacgtgcacatccaactggaccaccatggagagccaggccaccagggggaaccggaaatcacggagaccgcagccttctccctttctgaaacaggtcctccgcctggaactgtgcaggaaggccctggccccgacgtggcgcaacctgagctggggtttcaggagccgcccgctgctcctgggcctcaggctgttgactggcaacccgtcttgaccctctatccctgcatcgggtttagggctctgggtgactcagcggttttacaagtcattcaaaccccccagggcacctacgtgcaaggggtcccagtgttcctcaccgacattgcgtattgaccactatctgccacccacgttgttcccagcctcccttccttccacctggacgttccccccagccccacttctgctccactcctcccccgactggacctgaagcctgagcttcccctgaacttggagtacgcaacttacaacatgcaagctgccaaacaccctttctgtacaaggcgattggaatggaactgtcatgtacagtgaaagtacacgtcacgtttttcagccaagaagaagccaaccca

SEQ ID NO: 5958 - DNA, 1847 bp, Homo sapiens; identical to SEQ ID NO: 5955

SEQ ID NO: 5959 - DNA, 1013 bp, Homo sapiens; identical to SEQ ID NO: 5957

SEQ ID NO: 5960 - DNA, 1847 bp, Homo sapiens; identical to SEQ ID NO: 5955

SEQ ID NO: 5961 - DNA, 1013 bp, Homo sapiens; identical to SEQ ID NO: 5957

SEQ ID NO: 5962 - DNA, 1847 bp, Homo sapiens; identical to SEQ ID NO: 5955

SEQ ID NO: 5963 - DNA, 1614 bp, Homo sapiens
atggaggaaccaaggccttcgaagcgacttcgctccatggcccctaatcaagcctcaggtgggcctcctccagagccaggctgctgtgttgcggaccctgaaggctccgtggaagcagatgggcccgcacagccagcccaacccgcaaaacccatcgcttacgtgaaacccttcagacggcagcccccagctcgcccagagtcaccccctcctgcagagagaggccggcgccggggaggaagccggcggccagggcgaggccgtggcagaagggctgggccccgcggggacgctggccagagacagggggcagaaggcttgatggcaccggacgtgcacatccaactggaccaccatggagagccaggccaccagggggaaccggaaatcacggagaccgcagccttctccctttctgaaacaggtcctccgcctggaactgtgcaggaaggccctggccccgacgtggcgcaacctgagctggggtttcaggagccgcccgctgctcctgggcctcaggctgttgactggcaacccgtcttgaccctctatccctgcatcgggtttagggctctgggtgactcagcggttttacaagtcattcaaaccccccagggcacctacgtgcaaggggtcccagtgttcctcaccgacattgcgtattgaccactatctgccacccacgttgttcccagcctcccttccttccacctggacgttccccccagccccacttctgctccactcctcccccgactggacctgaagcctgagcttcccctgaacttggagtacgcaacttacaacatgcaagctgccaaacaccctttctgtacaaggcgattggaatggaactgtcatgtacagtgaaagtacacgtcacgtttttcagccaagaagaagccaacccagacaacctggaagaagtgggatgcaacaaggatcactaagcatggaaattaggaaactgtattcttaagtccagagaagtacgattctggaaaaaggattgatgacctagaattaaaattccagaagacactcatatagacatgtgggacatgcgaaaactcagaaggagctagaagttactaaagtgcttctctagtgcctggagacgatagactggctgaatataagagcaataaaaatctagactgacacatttttaagtctcaacgtgggtaccctttgggaaccactaaatgaattggaatagaaggtaaaatttcaaacagattgaggaaaaaggggatcaaaggacatgtgacgaatcagacaaaaggtgttggggtgggggggggggcggttaacggaagcaaggagagtgcatgactcactggaaccgctaaaccaggaatcagtaatttgacggcagtgtccttggcttcctcctggctttaatgggaatattttgaatgtttcaccattaaccaagatgttggctgtaggtgtctcttagatgtttaagttgagttagttcccatcttttcagagtttgataaatgttgtattatgaacttttgtattttgtattttattaggtaggctgttgttggctggttttcactcctttgtaaacgtccaaataaaatacagataactttttacatc

SEQ ID NO: 5964 - DNA, 1170 bp, Homo sapiens
atgcatgcctgttcatccacagctcttcatccacggcccttcatccacggcttttcattcacaacttttcttcaacagctcttcccccacggctcatccacggctcttcacccatggcccttcatccacggctcttcacccatggcccttcatccacggctcttcacccacggcccttcatccacggctcttcacccatgtcccttcacccacggctcttcacccatgtcccttcatccacggctcttcacccacagtccttcatccatgcctcttcacccacggcccttcgtccatgcctcttcacccacggcccttcgtccatgcctcttcacccacggcccttcgtccatgcctcttcacccacggcccttcgtccatgcctcttcacccacggcccttcctccatgcctcttcacccacggcccttcctccatgcctcttcacccacggcccttcctccatgcctcttcacccacggcccttcctccatgcctcttcacccacggcccttcctccatgcctcttcacccacggcccttcgtccatgcctcttcacccacggcccttcgtccatgcctcttcacccacggcccttcgtccatgcctcttcacccacggcccttcgtccatgcctcttcacccacggcccttcctccatgcctcttcacccacggcccttcctccatgcctcttcacccacggcccttcgtccatgcctcttcacccacggcccttcgtccatgcctcttcacccacggcccttcgtccatgcctcttcacccacggcccttcctccatgcctcttcacccacggcccttcgtccatgcctcttcacccacggcccttcctccatgcctcttcacccacggcccttcgtccatgcctcttcacccacggcccttcgtccatgcctcttcacccacggcccttcgtccatgcctcttcacccacggcccttcgtccatgcctcttcatccacgtctcttcacccacggcccttcatccatgcctcttcatccaagtctcttcatctacgcctcttcagccacagctcttgcctggtgggcttctcacagcagggcaatgtcttgctgctgtctgccagggccaccttcaacacctgtcttcttgtttctaacatgtactttctaataatctcttactaa

SEQ ID NO: 5965 - DNA, 1167 bp, Homo sapiens
atgcatgcctgttcatccacagctcttcatccacggcccttcatccacggcttttcattcacaacttttcttcaacagctcttcccccacggctcatccacggctcttcacccatggcccttcatccacggctcttcacccatggcccttcatccacggctcttcacccacggcccttcatccacggctcttcacccatgtcccttcacccacggctcttcacccatgtcccttcatccacggctcttcacccacagtccttcatccatgcctcttcacccacggcccttcgtccatgcctcttcacccacggcccttcgtccatgcctcttcacccacggcccttcgtccatgcctcttcacccacggcccttcgtccatgcctcttcacccacggcccttcctccatgcctcttcacccacggcccttcctccatgcctcttcacccacggcccttcctccatgcctcttcacccacggcccttcctccatgcctcttcacccacggcccttcctccatgcctcttcacccacggcccttcgtccatgcctcttcacccacggcccttcgtccatgcctcttcacccacggcccttcgtccatgcctcttcacccacggcccttcgtccatgcctcttcacccacggcccttcctccatgcctcttcacccacggcccttcctccatgcctcttcacccacggcccttcgtccatgcctcttcacccacggcccttcgtccatgcctcttcacccacggcccttcgtccatgcctcttcacccacggcccttcctccatgcctcttcacccacggcccttcgtccatgcctcttcacccacggcccttcctccatgcctcttcacccacggcccttcgtccatgcctcttcacccacggcccttcgtccatgcctcttcacccacggcccttcgtccatgcctcttcacccacggcccttcgtccatgcctcttcatccacgtctcttcacccacggcccttcatccatgcctcttcatccaagtctcttcatctacgcctcttcagccacagctcttgcctggtgggcttctcacagcagggcaatgtcttgctgctgtctgccagggccaccttcaacacctgtcttcttgtttctaacatgtactttctaataatctcttac

SEQ ID NO: 5966 - DNA, 1392 bp, Homo sapiens
aggcaaacagaaccccaccaggttctcagcctgttctccggttgggccacttgcactcccactgccgccctcctggcctgtctggaccgggccccccgctgccccatgcagcaccccaaaccgttctgtgcccctgcagctccccaggaaggtttcagcccgcagagtctggagggggctgaggtgctgggcaaccagcctgctcccacctgtgccgagcctcctcccgctatgggctccttgaacctgtatcatcccccagacccagagaaagaggtgtttccagccccaccagcaggtttccagatggccccatgcgggtgcttcttcgacccccgcatctatcggatcgagtggaccacccccgacctgggccagtcagccctgtataagctggcagcaagcagcggggggccagcgggggtcccctccgccccaggcagctacctcctggagcctcagccctacctcaaggccccggggctgcctccatacccccactaccagcaggcacccggggggccccagtttctcttgccctacttcccgcctgagggccccgggccagaggctctgggttttgtgggggacgcagggcccgccgccttcgtggagctgcccctaccgcccctagaggaaggcccggccccgctgccacccccaccccccaaggagaacaagccgccccctgtactcatcacgctgcctgcagagcccacactgcccccagacgcctacagccacctccagggtcacctcggccacttccctgggcccgaacccctggccttccccgtcaaggagctgcagggcagtggggcccgacctggggtgcccctgtacccaccgggcctcagcgagctcaaggtggccgaggtcaaggagggggccctgctgggagcaggcaaggccaaggcccccaagacggccagagctttggcactgcctgacaaggttctgctggaggacgccatgaagctcttcgactgcctgccaggcgcctctgagcctgagggtaccctgtgcgaggtccctgggccggccctgcctgacagcagtggtgggaactcagccgatgacatccgctcgctgtgcctgcccgaggagctgctgtcctttgactacagcgtgcctgagatcctggacaccgtgtccaacgttgactacttcttcaacttcaaggcgctcgacgaggagcagccgccccacccggggccccctgccaccaacaccccggcccccattctgtctggcaagagaaaggcctcgacggccaagaagggaaagccgggaaggaaggccaggcagccggcaggcccagccagcgccactcccccggggcccagggaggacctgggagccaccccgcattaaagcacatttgacctttca

SEQ ID NO: 5967 - DNA, 2307 bp, Homo sapiens
atgggcagccggccccgcagccccagcgccttccctgcgccctggtggggacagcagccaggaggacccggccctgccaagcgcctccgattggaggagcccgcgggccccgaaccccgcgtggcgcccagcctggaagacccggcgggtaccccggccgtgggcgcgctcacctccatagtggtcctggccgcgggctgtgccctgcgtgtgcccctggacgacgtcgacctggtgctggagctcccgccaacgtcgatcctgcgagtgtctctcgatggacacaccctcatcctgatcccagaggtcctcctgagctctgtcgacgaacgctcaggagcgcaggacgactcgtctgctgggctggaagtggacgttttcctgggcgctctcagggaggacgtcgtcgttgagcaggaagtcttctgcgcatctgtcccagagatcgccgcccaggaagaggcctacgaggaggacgcggaccccgagtttccggagctccagatggactccgcagccggctcagccgctgggctctactcctccgccagaagtatgttcagcccctaccgggagggccccatcccagaaccctgtgctctggcccccaaccccagttcagagggacactctccaggccccttcttcgacccggaattccgccttctggagcctgtccccagctcacctctccaacctctacctccctctccgcgcgtggggagtccaggtccccacgcgcacccgccgctcccgaaacgccctccgtgcaaggcccgcagacgactgttccaggaatgaactgcttcccacaatcccttgccaccggctgcgggttcttgtggatcctccaagactcactgtgaggacttgccacagcccggaaatgcagcatcttcattcatcgacagcgggcagttggattactgttgtttgggtgggttggttggttggctggctggctggttggttttttggcagaattccttggtaagtggcaggcaaggacatgaaaaaagaaaagcagattctggtaagcacctttaccaagaagagtagaccacacataaccagtcatggattttcagatcccttgcctttgctgcaggagctgttacttctgcctttgtcaccttcagccaactgtatcctcagtttcacccctactcttgcttaaagctcccttcagttttctttaaaattcccccctttttttttatcacttccatacacctatccgttctctccaatccagatcattgtctttccttctttttgcagttaggaatttacctatacgatttctcccaacatcctctgaggtgcttctgaccactgattttattttccacttgctctccttaactccttttcctggacctggacaatcaagataaatgcatattagattagatagtaaacaaacaacattcaaatgtaatgaatgcactggaccttttggaagtgtttctgcaaataagaatttaagggccgggcgcgatggctcacgcctgtaatcccagcactttgggaggccgaggcgtgtggatcacctgcagtcaggagttcgagactagcctggccaacatggcgaaactccgtctctactaaaaatacgaaaattagccgggcatggtggcgtgtgcctgtaatcccagctactagcagggatgaggcaggaggagtgcttgaacctgagaggcagaggttgcaatgagccgagatcgtgccattgcactccagcctgggcaacagagtgagactccatctcaaaaaaaaaaaaaagaaaacgaaaaaacaatttaaaaattagtgaaagcaatatttaatgagggaaagtaggaagttgtgacactttcattccagcagcatcttgtacaatgacatattctatgtactttaaccaatgggtattcctgaatttcagggcagtgtgggcttcatcttgatttcctctcaggggtactcactcaccttcaccgcatggacatttggtctaatttatttttgagagtttttttcatgctcttgagtccatcaccctgaattggcagtcgttatttcttagtattatttccttaatgtctttttaactataaaggaaaggaaatattacagataatgttgtcatatcctttgatccccactcttctcccccattcccaggggattcacatcatgacacaaagttgatggatatcattctagtcaatatatgaaagctacatatacatatatatatgtatagatataaataagcaatgtttatgttgttttctggacaattaaatttacataactacctca

SEQ ID NO: 5968 - DNA, 1896 bp, Homo sapiens
gtctgcatcaggaaggcccaagggtccaacgagctaagctgagcccggtggccggcgaggcaccaccagcagcccagactacggtcccccaggaggcgccccgggagctccgaggactcgccccgcgtcgcgcggtcctgcgccccgctcgtcccaaccagcctcccctaccaccgacatctgttacttcaaagaggacttcaccgccgcgctccccacgtccgctgctaggcccaggagcgccgtccacagcgccgtcgaggcgatggtcagccggccccgcagccccagcgccttccctgctccctggtggggacagcagccaggaggacccggccctgccaagcgcctccgattggaggagcccgcgggccccgaaccccgcgcggcacccagcctggaagacccggcgggggacccggccgtggacgcgctcacctccatagtggtcctggccgcgggctgtgccctgcgtgtgcccctggacgacgtcgacctggtgctggagcccgcaccaacgtcgatcctgcgagtgtctctcggtggacacaccctcatcctgatcccagaggtcctcctgagctccgtcgacgaacgctcaggagcgcagcacgactcgtctgccgggctggaagtggacgttttcctgggcgctgtcagggaggacgtcgtcgtcgagctggaattctgcgcatctgtcccagagatcgccgcccaggaagaggcctacgaggaggacgcggaccccgagttcccggagctccggatggactccccaaccggctcagccgctgggctctacccctcctctagaagtatgttcatcccctaccgggagggccccatcccagaaccctgtgctctggcccccaaccccagttcagagagacgttctccacgccccatctttgacctggaattccgccttctggagcctgtccccagctcacctctccaacctctacctccctctccgtgcgtggggagtccaggtccccacgcgcgctcgccgctcccggaacgccctccgtgcaaggcccggagacgcctgttccaggcatagacccccacccccacgtacacacaacaatcctggccgctctgctggaggccctctaggattgcgggaatctctcacattgagtatccaacaacctggaaattgggcaccgcgtgttcggacaattgctttttcgctgcacactaccgatagtaggagatgaagacgtcagcaagaaaaggtatattctagacctcatctttaaatagaaaatctgcgcaaggataccagaaaatgtgtccagatttctgggcttctttacaaggtcatattcagatcccttcattctccctcgttttgcatcagttgtttctctcaaattccagtctttctccagcatcatactgccactcccgtttctccccaaaccaagaaatcaccagatctcttacgttgttagttaccttgcatttttttcccatgaattttggaagacttagccatggcttttcttggggtttttccaactgctctccaaggaaactgccaaatagtatgcttactatacaagactgtatgttgcttcttcctaggaaccccttatcctgctgaagttttcttctagtcttctaattctaaatgaaaatttgtgttgaattttatcagatgttttcagcatgcattgtgttatgtatttttttttaatttgttaatctggtgatttcacccaatggaaagtgtttgcattcctgctattccacattattttataccttttaaaatctaccctgagttttttctcatgtaaaccaaacttctaacttttaaaatgttagtttattactgtagttgcctcatatttttatataggagataaaagattactggtaaagctg

SEQ ID NO: 5969 - DNA, 2791 bp, Homo sapiens
aacataattggctttgcagtgcgcatccgggtctgcgtcaggaaggcccaagtttccatcgcgcgaggctgagccacacagcgtgcgaggttcccccagcagcagcaccgactccgatctccgggaggcgcccccagagctccgaggactcgccccgcgtcgcgcggtcctgccgacacctgttacctcaaagaggacttcgccgccccgagccccccgcacccacgtcccctgccaggcccaggagcgccgtccgcagcgccgtcgaggtgatgggcagccggccctgcagccccagcgcctgccttgcgccctggtggggacagcagccaggaggaccaggccctgccaagcgcagccgattggaggagcccgcgggccccgaatcccgagcggcgcccagcccggaagacccggcggggaccccggccgtggacgcgctcacctccatggtggtcctggacgcgggctgtgccctgcgtgtgcccctggaggacgtcgacctggtgctggagctcgcgccaatgtcggtcctgcgagtgtctcttggtggacacaccctcatcgtgatccccgaggtcctcctgagctccgtcgacgaatgctcaggagcgcagggcgactggtctgccggcctggaagtggacgttttcctgggcgctcacggggaagacgtcgtcgtcgagcaggaagtctgcgcatctgtcccagagatcgctgccgaggaagaggcctacgaggaggacgcggactctgagttcccggagctctggatggactccgcagccggctcagccgctgggctctacccctccgctagaagtatgttcagcccctaccgggagggccccatccgagggccctgtgctctggcccccaaccccagttcagagagacgctctccacgccccatcttcgacctggaattccatcttctggagcctgtccccagctcacctctccaacctctacctccctctccgagtccaggtccccacgcgcgcccggagctcccagagcgccctccgtgcaaggtccgaagacgcctgttccaggaatgagttgcctcccacaatcccttgccaccctgctgggctccaggagaccgtctcctgatagccgttgtgtgtatgttgcgcaacctacaaggatctcggagagtggataacggatagatgcttttttgatacaggctgcgttgcagaattctggatcagtggctgacttagaaagtctggaaaaaaaagatcctcctcctcagcataaaaatacgctagttgaaatacagtctactttcagactgtgagattgctgcttcgggcctgttttgtttggaagtcacccctaggcagctccattccccctggttttgctttgaacctcagttccagcacatttctctaaaaatccgccctttccccagcacgttaccatggcacaccttttctcccaagttaatttactacatttattttgtttaatgggttttggccctagtctctgggctagtttatgacgaccttctcaacatggaatttttccctatggtggcctgagcccttttgggtgatcttgcacatagttgtacctggacaaatgtttgttgtttgcaaaacagaccgaactgggaataatgatcatgtaccctcctttttttcatgattggtttagcaaattgtttatgttattgggctttatttcccccctaactcttagagccagctcttttccattcatttcttcttctatgtttttaatataattattttatcctggaaaagcttataattctaagactctgtgtgtgtatgtgtgtgtgtgttgtttgtttgtttgttttttgagacaagagtttcactcttgttgcctaggctggagtgcaatggcacaatctcagctcactgcaacctttgcctcccaggttcaagcaattctcccgcctcagcctcccaggtagctgggatcacaggcatgcgccaccacacacgactaattttgtatttttagtagagacggggtttcaccatgttggccaggctggtctcgaactcctgacttcaggtgatccatccacctcagcctcccaaagtgctgggattacaggcacgagccatcgcacccagccggaaataatttgtttcttaggttgatgtatcaaatgcaattactgaatttctttaatggtgtatgtgtagattctcaattgattgattgattgattgataaaaacaatatctccaaataatgagaatattgtcttttttgacaagcttcatacatcttatttttctttaatcttttatattggacattacttcaagtccagattgaacagtatggttaatatgggcattcctgttttatgccttgtgttaatgcttctaaattttaccataaagtatgatctttacatggttgttagataacccttaatctattgaagcagttaattttcagtctttcagatcatgaaaaactgttgaatttttgctttgtttttgcctgttactacaaagatgttatcaagttgttttaaatgttgacatttaattatttgtgtgtatacaataatacaatacaatagctagatggaacctttgggccacaagagtacgtacagaaacctggcaagagcgctaatgagaccaggctttgggcttcagggatttaaaacaattggatgctttatgaggacttgagaagacacaagtggaaggagaaaggcagtaactgtagggtgcatttaaggttttaaatgttaaaaattaaagaaacttttttttctgtatgc

SEQ ID NO: 5970 - DNA, 2657 bp, Homo sapiens
aacataattggctttgcagtgcgcatccgggtctgcgtcaggaaggcccaagtttccatcgcgcgaggctgagccacacagcgtgcgaggttcccccagcagcagcaccgactccgatctccgggaggcgcccccagagctccgaggactcgccccgcgtcgcgcggtcctgccgacacctgttacctcaaagaggacttcgccgccccgagccccccgcacccacgtcccctgccaggcccaggagcgccgtccgcagcgccgtcgaggtgatgggcagccggccctgcagccccagcgcctgccttgcgccctggtggggacagcagccaggaggaccaggccctgccaagcgcagccgattggaggagcccgcgggccccgaatcccgagcggcgcccagcccggaagacccggcggggaccccggccgtggacgcgctcacctccatggtggtcctggacgcgggctgtgccctgcgtgtgcccctggaggacgtcgacctggtgctggagctcgcgccaatgtcggtcctgcgagtgtctcttggtggacacaccctcatcgtgatccccgaggtcctcctgagctccgtcgacgaatgctcaggagcgcagggcgactggtctgccggcctggaagtggacgttttcctgggcgctcacggggaagacgtcgtcgtcgagcaggaagtctgcgcatctgtcccagagatcgctgccgaggaagaggcctacgaggaggacgcggactctgagttcccggagctctggatggactccgcagccggctcagccgctgggctctacccctccgctagaagtatgttcagcccctaccgggagggccccatccgagggccctgtgctctggcccccaaccccagttcagagagacgctctccacgccccatcttcgacctggaattccatcttctggagcctgtccccagctcacctctccaacctctacctccctctccgagtccaggtccccacgcgcgcccggagctcccagagcgccctccgtgcaaggtccgaagacgcctgttccaggaatgagttgcctcccacaatcccttgccaccctgctgggctccaggagaccgtctcctgatagccgttgtgtgtatgttgcgcaacctacaaggatctcggagagtggataacggatagatgcttttttgatacaggctgcgttgcagaattctggatcagtggctgacttagaaagtctggaaaaaaaagatcctcctcctcagcataaaaatacgctagttgaaatacagtctactttcagactgtgagattgctgcttcgggcctgttttgtttggaagtcacccctaggcagctccattccccctggttttgctttgaacctcagttccagcacatttctctaaaaatccgccctttccccagcacgttaccatggcacaccttttctcccaagttaatttactacatttattttgtttaatgggttttggccctagtctctgggctagtttatgacgaccttctcaacatggaatttttccctatggtggcctgagcccttttgggtgatcttgcacatagttgtacctggacaaatgtttgttgtttgcaaaacagaccgaactgggaataatgatcatgtaccctcctttttttcatgattggtttagcaaattgtttatgttattgggctttatttcccccctaactcttagagccagctcttttccattcatttcttcttctatgtttttaatataattattttatcctggaaaagcttataattctaagactctgtgtgtgtatgtgtgtgtgtgttgtttgtttgtttgttttttgagacaagagtttcactcttgttgcctaggctggagtgcaatggcacaatctcagctcactgcaacctttgcctcccaggttcaagcaattctcccgcctcagcctcccagagtgctgggattacaggcacgagccatcgcacccagccggaaataatttgtttcttaggttgatgtatcaaatgcaattactgaatttctttaatggtgtatgtgtagattctcaattgattgattgattgattgataaaaacaatatctccaaataatgagaatattgtcttttttgacaagcttcatacatcttatttttctttaatcttttatattggacattacttcaagtccagattgaacagtatggttaatatgggcattcctgttttatgccttgtgttaatgcttctaaattttaccataaagtatgatctttacatggttgttagataacccttaatctattgaagcagttaattttcagtctttcagatcatgaaaaactgttgaatttttgctttgtttttgcctgttactacaaagatgttatcaagttgttttaaatgttgacatttaattatttgtgtgtatacaataatacaatacaatagctagatggaacctttgggccacaagagtacgtacagaaacctggcaagagcgctaatgagaccaggctttgggcttcagggatttaaaacaattggatgctttatgaggacttgagaagacacaagtggaaggagaaaggcagtaactgtagggtgcatttaaggttttaaatgttaaaaattaaagaaacttttttttctgtatgc

SEQ ID NO: 5971 - DNA, 1255 bp, Homo sapiens
gccgtagcgggcagggctcgagcactggagtagagcagtccgacaggtagagaagtgagactggctgcggcacagggcgggttagggctccaggcagggcttgagcgggacgagggggcgggctccgaggcgggctagatgcctgggctggatgaagtccgagtctgggaagagaaccgtgttgtggcgggaggaggcggtgattggggtggtggggctaagcgcgggggcggggctggagcgaggggggcggggtagcacctccgcctgtcggtggtggggcggaggctggagggggtgggcctaggatgcggaggcggcagctcgcgtgggggcgtgaccatgctggcgggggcggggccggaggcgggcggtttagagagcggggcggtctgcggggtgggggcggggcctggtgggggcggggcctgtgcggtctgcggcgcggagccgagtgggctgcggggatgcgggggaccagctgcgtgggcggcggcgccgagagccccggaggcgcggggctgagcgagggcccgcgggggcgctggctgcgcttggctccggtatgcgcctacttcctctgcgtctcgctagctgccgtgctgctcgccgtgtactacggtctcatctgggtacccacgcggtctcccgcggcacccgccggcccacagcccagcgcgccgtcccctccgtgtgctgcccgcccgggcgtgccgcctgtcccggcgcccgccgctgcctccctctcctgcctcctgggagtccccggcgggccgcgaccccagctccagctgccgctgagccgccgccgccgctacagcgaccctgaccgccgtccgagccgccagacacccagagagacgccagaggccgcggaggggcgaagacccgggtaactctcccttccaccccaacccggatcgccagccctcgagagctctgtgctccacgccgaggatgcaccgtctctggattggtccggccttcttcctaatgacatcgctcagcgtctctggagccgtcatcccgcggaatgggggcccagggggtgtcagctcggggccttgcctcttgcagctactctgtggtcaggccgggtcctccaccatcaggaagatcccatcctgagctctgtctcctgcccctcctgctgtgggatgctgagcacagagcccacagcccatctgcctcttcacctccctgaatccgtgtccatctgcaataaacgacagcctcggctgcctcgtgctgtgtc

SEQ ID NO: 5972 - DNA, 1209 bp, Homo sapiens
atggcccgaactgaccagaagcccccgtgcagaggtggctgctggggacagccaggtcaccccaacacgggtggggcagctgcacaccccacttaccaccccatgggtcacaggcctcgaacgtgcatcctgctacgtggagaccagaccacaggtggccaagctccgtctcgggaaataagcctggggccctgggcggccggcactcacttcctggctatctctaccaccccatggggcaggaagacacccgcctgcatttctgagctcccaaccagctcaggaacagcgcagccgctcgcaaatgcagtgtgcgaggtacagaccgttccagggcctggcctgcgcccacagggaactcctgccatgcgggccccttctcacaaggggacaccgcccacccccaacccctggggcccagagcagccccagaacagacacaagcatcccaaaaagggggtcactgggggcccctcgccgccgcctcctgccgcctcccgatatggccaaacacccgggcgcgagccccgcgtgcaggcgccgggcctgggcccctgtggccgtcccgccagcggccgtcttctgtccctgcatttagagaagggggatggcaaagggacccgccagcggatccctcttacagatgctgccgtgggcggcgaccgcacagacatcccctctgctattgctgcgggaccggcaaggacgccggaccgacacggcctccccatccctgggtccaccccgactcccatggtggggagcggccggcttggagcccctgtgggacggagtggaggtggagcaagtgcccggagctctcggccatcatgtgcgaatgttttgctccgtgctgacgcctccctcggcaccgtcctgtctgtgttgtggactgggcagctctcacggggttgggcgcttctgcccccgggggacgctggccggcatctggagacgtctgtgatctccgctggtgttgccgcaggcatctggctggtggagcccggggaggccgcccaggaccctgcgacccgcaggaccgccccgccgcggaggacggccagccccgaacccccagcgcccggggcacccctgcctgcctgccctgggcggatccccggggccgcgcggttcgggccgcgctcctgcccgctggggtctcccgccgtcctcgccgtcaccaccgggtggagccacaggtccgtgtga

SEQ ID NO: 5973 - DNA, 1229 bp, Homo sapiens
agtccacagcctttgttgagtcttgttgaagatcaggctctgcaaatcaccctaggatgtccttcagtgagcagcagtgcaagcagccatgtgtgccccctccatgcctcccaaagacccaggagcagtgccaagcaaaggctgaggaggtgtgcctccccacatgccagcacccctgccaagataagtgtctagtgcaggcccaggaggtatgtctttctcagtgccaggaatcaagtcaagaaaaatgcccacagcaaggccaagagccatacctacctccatgccaagaccagtgtccacctcagtgtgcagagccatgccaggagctattccagacaaaatgtgtggaggtttgcccacagaaagtccaggagaagtgctcatcccctggcaagggaaagtagctgctcatatgtcatctgggttcaagaagatggccagcagatgaaaccctgaccccagcccacgctctggtgaccttcttctgtgggtacctctgtgtgcaatgtaccttcttgcctcctggcttccttagcattccaggacttggtctgtgtctctgaagacagttctttctgtatttcatcaccctctgtgaataagcattgttctcagcagtctgatggaaggtctcaaatgtaggaatggtgtggttgtcagggaagaccacagaagcctagcacagcttccttggtgcaaaaattcacccagctctgggtgtgtaacagccaaggataccttcattcatctttcagagtttcaggctctcaaataagcctcaaaacaaactgaattctgatggactttccacttatcaccaccaccaccacctccaccaccaccaccaccacaggtgttgagacaaagcggcttgcggtgtttcaaaaatcaaaaatttggtgattttgtctctgtacactaaaaagaacagcaaattattgaactttgaaatgttggttgtgcttttttaaaatgaaccgaaagtatgtaaacgattgaatccaaacaaccagaagggaaagataagatggatgtttggtgcccttgtcaatctctgtgcttcatagctggtctaatgtgggcccttagttctcaccatgtacactctttagagatgtgatttgtgtctgtgtgatgcaggctggtctgttctccagcttccttgccttcttctccctggtgaaggtaaaatacataataaagctgatcctaaggctgatatctga

SEQ ID NO: 5974 - DNA, 4493 bp, Homo sapiens
tctttccacctcccttccagtccgctcccggttcctggctccagctaggctcggcagaaataggagcgcgcaggcgcgacgtgcggctcgcagaacggcgagtagcggagcgggacccgctggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaacccaagaga

SEQ ID NO: 5975 - DNA, 4600 bp, Homo sapiens
agaaataggagcgcgcaggcgcgacgtgcggctcgcagaacggcgagtagcggagcgggacccgctgtgagtgtggcggccgcgctgggttcctagctggggaaacgtgatccaggcgaagcgccccaggaaggattggggatgctcaccccatttagagaaagaaatccacctccccaaccccaatcaagaacctgctattgtatatcatcatagagccagattacctagggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaacccaag

SEQ ID NO: 5976 - DNA, 4481 bp, Homo sapiens
gcgagtagcggagcgggacccgctgatgctcaccccatttagagaaagaaatccacctccccaaccccaatcaagaacctgctattgtatatcatcatagagccagattacctagggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaaccc

SEQ ID NO: 5977 - DNA, 4509 bp, Homo sapiens
agaaataggagcgcgcaggcgcgacgtgcggctcgcagaacggcgagtagcggagcgggacccgctgtgagtgtggcggccgcgctgggttcctagctggggaaacgtgatccaggcgaagcgccccaggaaggattgggggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaacccaag

SEQ ID NO: 5978 - DNA, 436 bp, Homo sapiens
agacttcctgcccctgctctgcactctcaggtattccctgctcttactccaaaaagatggacccaggtccgaaggggcactgccactgtggggggcatggccatcctccaggtcactgcgggccaccccctggccatggcccagggccctgcgggccacccccccaccatggtccagggccctgcgggccaccccctggccatggcccagggccctgcgggccacccccccaccatggtccagggccctgcgggcctccccctggccatggcccaggtcacccaccccctggtccacatcactgaggaagtagaagaaaacaggacacaagatggcaagcctgagagaattgcccagctgacctggaatgaggcctaaaccacaatcttctcttcctaataaacagcctcctagaggccacattctattctttaaa

SEQ ID NO: 5979 - DNA, 430 bp, Homo sapiens
agacttcctgcccctgctctgcactctcaggtattccctgctcttactccaaaaagatggacccaggtaaggggcactgccactgtggggggcatggccatcctccaggtcactgcgggccaccccctggccatggcccagggccctgcgggccacccccccaccatggtccagggccctgcgggccaccccctggccatggcccagggccctgcgggccacccccccaccatggtccagggccctgcgggcctccccctggccatggcccaggtcacccaccccctggtccacatcactgaggaagtagaagaaaacaggacacaagatggcaagcctgagagaattgcccagctgacctggaatgaggcctaaaccacaatcttctcttcctaataaacagcctcctagaggccacattctattcttt

SEQ ID NO: 5980 - DNA, 4950 bp, Homo sapiens
cagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacataccacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctgtgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgcgatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaa

SEQ ID NO: 5981 - DNA, 11042 bp, Homo sapiens
gcagatcgggagcggtgccgagaaaaatttccttactagatgacatttcatcgcaatgtccgatcgtttggggcaaattaccaagggcaaggatgggaaaagcaagtactcgactctcagcctgtttgataagtataaaggaaaatcagtagacgcgattagatcctcagttattcctagacatggcttacagagtcttgggaaagttgctgcagcccggcgcatgccaccgcctgcaaacctgccaagcttgaagtctgaaaacaaaggaaacgaccccaacatcgtgatagtacccaaggacgggacgggatgggcaaacaagcaggatcagcaagacccaaagagttccagtgcgacggcctctcagccgccggagtcgctgccgcagccgggtttgcagaaatctgtctccaatttgcagaaaccgacacagtcaatcagtcaggagaatacaaattcagtgccaggtggaccaaagtcatgggcacagctgaatggaaagccagtaggacacgaaggtggtttaaggggctcaagccgactgttatccttctctcccgaggaatttccgacgctgaaagcagctggagggcaggacaaggctggcaaagaaaagggcgtcttagatctgtcgtatgggccaggaccaagcctccgccctcagaatgtgacaagctggagggagggcggtgggcgacacataatttctgccacgtctctgagcacctccccaactgagctgggcagcaggaactcgagtacgggagatggagccccctcctcggcatgtaccagcgattctaaggacccctctctccgcccggctcagcctgtccgaaaaggggcttcacagttcatgggaaatgtataccacccacctacataccatgacatgcttcctgcttttatgtgttcgccgaagtcatcagaaaaccagggtacagtggaacgaggctcttttccccttcctcagctccgccttgaacctcgagttccttttagacagttccagatgaatgaccaagacggaaaagaaaacaggctgggattgtctcgcccactccgcccactaaggcagctggtggagcgggcaccacggcccaccattatcaatgcggaaaacctgaagggccttgacgatctggacgccgatgccgatgatggctgggcaggcctccatgaagaagtggactattctgagaaactgaagttcagtgatgatgaagaggaggaagaagttgtgaaggacggcaggccaaagtggaacagttgggaccctaggaggcagcggcagttgtcaatgagctctgcagacagtgcggacgctaagcggactcgagaggaagggaaggactgggctgaagcagtgggtgcgtcccgtgtggtccgaaaggcgccagaccctcagccaccgcccaggaagcttcatggctgggcaccaggccctgactaccagaagtcatcaatgggcagcatgttccggcaacagtccatcgaggacaaggaggacaagcccccaccaaggcagaagttcattcagtcagagatgtccgaggcggtggagcgagcccgaaagcgccgggaagaagaggagcgccgagcccgggaggagaggctggccgcctgtgctgccaaactcaagcagctggaccagaagtgtaagcaggcacgaaaggcaggtgaggcccggaagcaggcagagaaggaagtgccctggtctccaagtgctgagaaggcatctccccaggaaaacggccctgctgtccacaaaggctccccagaattccctgcccaagagacccccaccacattcccagaagaggcacccacagtgtccccagcagtggcacagagcaacagcagtgaggaagaggccagagaggctgggtcccctgcacaggagttcaagtatcagaagtcccttcctccccgattccagcgccagcagcagcaacaacagcaggagcagctgtacaagatgcagcactggcagccggtgtaccccccgccgtcccacccccagcgcaccttttacccacaccacccccagatgttgggcttcgatcccaggtggatgatgatgccttcctacatggacccacgtatcacgcccactcggaccccggtggacttctacccctccgccctgcatccctcaggactgatgaagcccatgatgccccaggagtccctcaatgggacaggctgtcgctctgaggatcagaactgtgtgcccccactccaagaaagaaaagtgacccccatcgactcaccccctgtgtggagcccagagggctacatggcactgcagagcaagggctacccgctcccgcacccgaagtcgagtgacaccttggctatggacatgcgtgtcaggaatgaaagctctttctctgcctcactcggaagggcagggggcgtaagtgctcagcgcgatctctttgaggagagaggggaggagtacttgagtgcttttgacaagaaggcccaagcagactttgacagctgtatctcttctcaaagaataggccaggagcttttgtttccaccccaagaaaatgttcaggatgcaggtgctcctgggggtcacacccaaaacctcaggtgttccccattggagcctgactttgtcccagatgagaaaaagccagagtgtggcagttgggatgttagccaccagccagagaccgctgacacagcccatggtgttgagcgggagacaccccgggaggggacggcctttaacatctcctcctgggacaagaacgggagccccaacaaacagccatcctcggagcctgaatggactcccgagccccggagctccagcagccagcacccggagcagacgggcaggacccggaggtcgggacccatcaagaaaccagtcctgaaagccctcaaggtggaagacaaggagaaggagcttgagaagattaagcaggagctaggggaggagagtacccggctggccaaggagaaggagcagagccccacggcagaaaaggatgaggacgaagagaacgatgcctctctggccaactcctccaccaccactttggaggacaaaggccctggccatgccacttttggccgcgaggccaccaaatttgaagaggaggagaaacctgacaaggcctgggaagccagacccccacgagagtccagcgatgttccccccatgaagagaaataactggatctttattgatgaggagcaagcctttggggtcagaggacaggcccggggccggggccgtggtttcagagagttcacttttcgtggtcggcctgctggcggaaatgggagcggcctctgtggtgggggggtcctgggggcccgcagcatctactgcagcagtcagcgcagcggccgtggccggggcctgcgagagtttgcgcggccagaggactgccccagagccaagccccgacggagagttgccagtgagacccatagcgagggctcagagtatgaagaacttcccaagcgccgccggcagaggggctccgagaacgggaatgaaggctcgctcctggagagggaggagagcaccttgaagaagggcgactgcagagattcttggcggtccaacaaggggtgctctgaggaccacagcggtctagatgccaagagccgaggccctcgggcctttgggcgagccctccctccccggctgagcaattgcgggtatggacggagaaccttcgtctccaaagagtcaccccactggcagagcaaaagtccaggcagctcttggcaggaatatggcccttccgacacatgcggatcccggcgacctacagacagagactatgtcccagattcctacagacaccctgacgcatttggtggccggggctttgaggacagccgcgcggaggacaagagatccttcttccaagatgaacacgtggcagattctgaaaatgcagagaaccggcccttcaggagaaggcgccccccacgccaagataagccccctcgattccggcgcctccggcaagagcgggagtccctgggcctgtggggacccgaggaggagccccacctgctggcaggtcagtggccaggcaggcccaaactgtgttctggggacaagagtggcactgtgggccgcaggtcccctgagctctcctaccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttgaaagtgaaaagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcctagctctgctagccccagtgggaagccctctggatcagcagttaacatgggctctgtgcagggacactacgtgcaacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacataccacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctgtgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgcgatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttattt

SEQ ID NO: 5982 - DNA, 6187 bp, Homo sapiens
tcatcagaaaaccagggtacagtggaacgaggctcttttccccttcctcagctccgccttgaacctcgagttccttttagacagttccagatgaatgaccaagacggaaaagaaaacaggctgggattgtctcgcccactccgcccactaaggcagctggtggagcgggcaccacggcccaccattatcaatgcggaaaacctgaagggccttgacgatctggacgccgatgccgatgatggctgggcaggcctccatgaagaagtggactattctgagaaactgaagttcagtgatgatgaagaggaggaagaagttgtgaaggacggcaggccaaagtggaacagttgggaccctaggaggcagcggcagttgtcaatgagctctgcagacagtgcggacgctaagcggactcgagaggaagggaaggactgggctgaagcagtgggtgcgtcccgtgtggtccgaaaggcgccagaccctcagccaccgcccaggaagcttcatggctgggcaccaggccctgactaccagaagtcatcaatgggcagcatgttccggcaacagtccatcgaggacaaggaggacaagcccccaccaaggcagaagttcattcagtcagagatgtccgaggcggtggagcgagcccgaaagcgccgggaagaagaggagcgccgagcccgggaggagaggctggccgcctgtgctgccaaactcaagcagctggaccagaagtgtaagcaggcacgaaaggcaggtgaggcccggaagcaggcagagaaggaagtgccctggtctccaagtgctgagaaggcatctccccaggaaaacggccctgctgtccacaaaggctccccagaattccctgcccaagagacccccaccacattcccagaagaggcacccacagtgtccccagcagtggcacagagcaacagcagtgaggaagaggccagagaggctgggtcccctgcacaggagttcaagtatcagaagtcccttcctccccgattccagcgccagcagcagcaacaacagcaggagcagctgtacaagatgcagcactggcagccggtgtaccccccgccgtcccacccccagcgcaccttttacccacaccacccccagatgttgggcttcgatcccaggtggatgatgatgccttcctacatggacccacgtatcacgcccactcggaccccggtggacttctacccctccgccctgcatccctcaggactgatgaagcccatgatgccccaggagtccctcaatgggacaggctgtcgctctgaggatcagaactgtgtgcccccactccaagaaagaaaagtgacccccatcgactcaccccctgtgtggagcccagagggctacatggcactgcagagcaagggctacccgctcccgcacccgaagtcgagtgacaccttggctatggacatgcgtgtcaggaatgaaagctctttctctgcctcactcggaagggcagggggcgtaagtgctcagcgcgatctctttgaggagagaggggaggagtacttgagtgcttttgacaagaaggcccaagcagactttgacagctgtatctcttctcaaagaataggccaggagcttttgtttccaccccaagaaaatgttcaggatgcaggtgctcctgggggtcacacccaaaacctcaggtgttccccattggagcctgactttgtcccagatgagaaaaagccagagtgtggcagttgggatgttagccaccagccagagaccgctgacacagcccatggtgttgagcgggagacaccccgggaggggacggcctttaacatctcctcctgggacaagaacgggagccccaacaaacagccatcctcggagcctgaatggactcccgagccccggagctccagcagccagcacccggagcagacgggcaggacccggaggtcgggacccatcaagaaaccagtcctgaaagccctcaaggtggaagacaaggagaaggagcttgagaagattaagcaggagctaggggaggagagtacccggctggccaaggagaaggagcagagccccacggcagaaaaggatgaggacgaagagaacgatgcctctctggccaactcctccaccaccactttggaggacaaaggccctggccatgccacttttggccgcgaggccaccaaatttgaagaggaggagaaacctgacaaggcctgggaagccagacccccacgagagtccagcgatgttccccccatgaagagaaataactggatctttattgatgaggagcaagcctttggggtcagaggacaggcccggggccggggccgtggtttcagagagttcacttttcgtggtcggcctgctggcggaaatgggagcggcctctgtggtgggggggtcctgggggcccgcagcatctactgcagcagtcagcgcagcggccgtggccggggcctgcgagagtttgcgcggccagaggactgccccagagccaagccccgacggagagttgccagtgagacccatagcgagggctcagagtatgaagaacttcccaagcgccgccggcagaggggctccgagaacgggaatgaaggctcgctcctggagagggaggagagcaccttgaagaagggcgactgcagagattcttggcggtccaacaaggggtgctctgaggaccacagcggtctagatgccaagagccgaggccctcgggcctttgggcgagccctccctccccggctgagcaattgcgggtatggacggagaaccttcgtctccaaagagtcaccccactggcagagcaaaagtccaggcagctcttggcaggaatatggcccttccgacacatgcggatcccggcgacctacagacagagactatgtcccagattcctacagacaccctgacgcatttggtggccggggctttgaggacagccgcgcggaggacaagagatccttcttccaagatgaacacgtggcagattctgaaaatgcagagaaccggcccttcaggagaaggcgccccccacgccaagataagccccctcgattccggcgcctccggcaagagcgggagtccctgggcctgtggggacccgaggaggagccccacctgctggcaggtcagtggccaggcaggcccaaactgtgttctggggacaagagtggcactgtgggccgcaggtcccctgagctctcctaccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttgaaagtgaaaagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggg

SEQ ID NO: 5983 - DNA, 9157 bp, Homo sapiens
gcgccgaggctccaccgcgcagcgacgagcgagcccgggaggagggagggagcgagcgagcgagcagcccgcgccgccgcctcgcaatccgccgccatcccgccgcccccgtgcccgaccgccgcccgactgccatcgcccggcccggccgcgcccgcggaaccagaccaggcagatcgggagcggtgccgagaaaaatttccttactagatgacatttcatcgcaatgtccgatcgtttggggcaaattaccaagggcaaggatgggaaaagcaagtactcgactctcagcctgtttgataagtataaaggaaaatcagtagacgcgattagatcctcagttattcctagacatggcttacagagtcttgggaaagttgctgcagcccggcgcatgccaccgcctgcaaacctgccaagcttgaagtctgaaaacaaaggaaacgaccccaacatcgtgatagtacccaaggacgggacgggatgggcaaacaagcaggatcagcaagacccaaagagttccagtgcgacggcctctcagccgccggagtcgctgccgcagccgggtttgcagaaatctgtctccaatttgcagaaaccgacacagtcaatcagtcaggagaatacaaattcagtgccaggtggaccaaagtcatgggcacagctgaatggaaagccagtaggacacgaaggtggtttaaggggctcaagccgactgttatccttctctcccgaggaatttccgacgctgaaagcagctggagggcaggacaaggctggcaaagaaaagggcgtcttagatctgtcgtatgggccaggaccaagcctccgccctcagaatgtgacaagctggagggagggcggtgggcgacacataatttctgccacgtctctgagcacctccccaactgagctgggcagcaggaactcgagtacgggagatggagccccctcctcggcatgtaccagcgattctaaggacccctctctccgcccggctcagcctgtccgaaaaggggcttcacagttcatgggaaatgtataccacccacctacataccatgacatgcttcctgcttttatgtgttcgccgaagtcatcagaaaaccagggtacagtggaacgaggctcttttccccttcctcagctccgccttgaacctcgagttccttttagacagttccagatgaatgaccaagacggaaaagaaaacaggctgggattgtctcgcccactccgcccactaaggcagctggtggagcgggcaccacggcccaccattatcaatgcggaaaacctgaagggccttgacgatctggacgccgatgccgatgatggctgggcaggcctccatgaagaagtggactattctgagaaactgaagttcagtgatgatgaagaggaggaagaagttgtgaaggacggcaggccaaagtggaacagttgggaccctaggaggcagcggcagttgtcaatgagctctgcagacagtgcggacgctaagcggactcgagaggaagggaaggactgggctgaagcagtgggtgcgtcccgtgtggtccgaaaggcgccagaccctcagccaccgcccaggaagcttcatggctgggcaccaggccctgactaccagaagtcatcaatgggcagcatgttccggcaacagtccatcgaggacaaggaggacaagcccccaccaaggcagaagttcattcagtcagagatgtccgaggcggtggagcgagcccgaaagcgccgggaagaagaggagcgccgagcccgggaggagaggctggccgcctgtgctgccaaactcaagcagctggaccagaagtgtaagcaggcacgaaaggcaggtgaggcccggaagcaggcagagaaggaagtgccctggtctccaagtgctgagaaggcatctccccaggaaaacggccctgctgtccacaaaggctccccagaattccctgcccaagagacccccaccacattcccagaagaggcacccacagtgtccccagcagtggcacagagcaacagcagtgaggaagaggccagagaggctgggtcccctgcacaggagttcaagtatcagaagtcccttcctccccgattccagcgccagcagcagcaacaacagcaggagcagctgtacaagatgcagcactggcagccggtgtaccccccgccgtcccacccccagcgcaccttttacccacaccacccccagatgttgggcttcgatcccaggtggatgatgatgccttcctacatggacccacgtatcacgcccactcggaccccggtggacttctacccctccgccctgcatccctcaggactgatgaagcccatgatgccccaggagtccctcaatgggacaggctgtcgctctgaggatcagaactgtgtgcccccactccaagaaagaaaagtgacccccatcgactcaccccctgtgtggagcccagagggctacatggcactgcagagcaagggctacccgctcccgcacccgaagtcgagtgacaccttggctatggacatgcgtgtcagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcctagctctgctagccccagtgggaagccctctggatcagcagttaacatgggctctgtgcagggacactacgtgcaacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacataccacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctgtgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgcgatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaa

SEQ ID NO: 5984 - DNA, 6267 bp, Homo sapiens
tcatcagaaaaccagggtacagtggaacgaggctcttttccccttcctcagctccgccttgaacctcgagttccttttagacagttccagatgaatgaccaagacggaaaagaaaacaggctgggattgtctcgcccactccgcccactaaggcagctggtggagcgggcaccacggcccaccattatcaatgcggaaaacctgaagggccttgacgatctggacgccgatgccgatgatggctgggcaggcctccatgaagaagtggactattctgagaaactgaagttcagtgatgatgaagaggaggaagaagttgtgaaggacggcaggccaaagtggaacagttgggaccctaggaggcagcggcagttgtcaatgagctctgcagacagtgcggacgctaagcggactcgagaggaagggaaggactgggctgaagcagtgggtgcgtcccgtgtggtccgaaaggcgccagaccctcagccaccgcccaggaagcttcatggctgggcaccaggccctgactaccagaagtcatcaatgggcagcatgttccggcaacagtccatcgaggacaaggaggacaagcccccaccaaggcagaagttcattcagtcagagatgtccgaggcggtggagcgagcccgaaagcgccgggaagaagaggagcgccgagcccgggaggagaggctggccgcctgtgctgccaaactcaagcagctggaccagaagtgtaagcaggcacgaaaggcaggtgaggcccggaagcaggcagagaaggaagtgccctggtctccaagtgctgagaaggcatctccccaggaaaacggccctgctgtccacaaaggctccccagaattccctgcccaagagacccccaccacattcccagaagaggcacccacagtgtccccagcagtggcacagagcaacagcagtgaggaagaggccagagaggctgggtcccctgcacaggagttcaagtatcagaagtcccttcctccccgattccagcgccagcagcagcaacaacagcaggagcagctgtacaagatgcagcactggcagccggtgtaccccccgccgtcccacccccagcgcaccttttacccacaccacccccagatgttgggcttcgatcccaggtggatgatgatgccttcctacatggacccacgtatcacgcccactcggaccccggtggacttctacccctccgccctgcatccctcaggactgatgaagcccatgatgccccaggagtccctcaatgggacaggctgtcgctctgaggatcagaactgtgtgcccccactccaagaaagaaaagtgacccccatcgactcaccccctgtgtggagcccagagggctacatggcactgcagagcaagggctacccgctcccgcacccgaagtcgagtgacaccttggctatggacatgcgtgtcaggaatgaaagctctttctctgcctcactcggaagggcagggggcgtaagtgctcagcgcgatctctttgaggagagaggggaggagtacttgagtgcttttgacaagaaggcccaagcagactttgacagctgtatctcttctcaaagaataggccaggagcttttgtttccaccccaagaaaatgttcaggatgcaggtgctcctgggggtcacacccaaaacctcaggtgttccccattggagcctgactttgtcccagatgagaaaaagccagagtgtggcagttgggatgttagccaccagccagagaccgctgacacagcccatggtgttgagcgggagacaccccgggaggggacggcctttaacatctcctcctgggacaagaacgggagccccaacaaacagccatcctcggagcctgaatggactcccgagccccggagctccagcagccagcacccggagcagacgggcaggacccggaggtcgggacccatcaagaaaccagtcctgaaagccctcaaggtggaagacaaggagaaggagcttgagaagattaagcaggagctaggggaggagagtacccggctggccaaggagaaggagcagagccccacggcagaaaaggatgaggacgaagagaacgatgcctctctggccaactcctccaccaccactttggaggacaaaggccctggccatgccacttttggccgcgaggccaccaaatttgaagaggaggagaaacctgacaaggcctgggaagccagacccccacgagagtccagcgatgttccccccatgaagagaaataactggatctttattgatgaggagcaagcctttggggtcagaggacaggcccggggccggggccgtggtttcagagagttcacttttcgtggtcggcctgctggcggaaatgggagcggcctctgtggtgggggggtcctgggggcccgcagcatctactgcagcagtcagcgcagcggccgtggccggggcctgcgagagtttgcgcggccagaggactgccccagagccaagccccgacggagagttgccagtgagacccatagcgagggctcagagtatgaagaacttcccaagcgccgccggcagaggggctccgagaacgggaatgaaggctcgctcctggagagggaggagagcaccttgaagaagggcgactgcagagattcttggcggtccaacaaggggtgctctgaggaccacagcggtctagatgccaagagccgaggccctcgggcctttgggcgagccctccctccccggctgagcaattgcgggtatggacggagaaccttcgtctccaaagagtcaccccactggcagagcaaaagtccaggcagctcttggcaggaatatggcccttccgacacatgcggatcccggcgacctacagacagagactatgtcccagattcctacagacaccctgacgcatttggtggccggggctttgaggacagccgcgcggaggacaagagatccttcttccaagatgaacacgtggcagattctgaaaatgcagagaaccggcccttcaggagaaggcgccccccacgccaagataagccccctcgattccggcgcctccggcaagagcgggagtccctgggcctgtggggacccgaggaggagccccacctgctggcaggtcagtggccaggcaggcccaaactgtgttctggggacaagagtggcactgtgggccgcaggtcccctgagctctcctaccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttgaaagtgaaaagatccccagacgaggccttgcctggaggtcttagtggctgcagcagtgggagtggccactccccctgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcctagctctgctagccccagtgggaagccctctggatcagcagttaacatgggctctgtgcagggacactacgtgcaacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggg

SEQ ID NO: 5985 - DNA, 535 bp, Homo sapiens
tgtgaaggacggcaggccaaagtgaagtcatcaatgggcagcatgttccggcaacagtccatcgaggacaaggaggacaagcccccaccaaggcagaagttcattcagtcagagatgtccgaggcggtggagcgagcccgaaagcgccgggaagaagaggagcgccgagcccgggaggagaggctggccgcctgtgctgccaaactcaagcagctggaccagaagtgtaagcaggcacgaaaggcaggtgaggcccggaagcaggcagagaaggaagtgccctggtctccaagtgctgagaaggcatctccccaggaaaacggccctgctgtccacaaaggctccccagaattccctgcccaagagacccccaccacattcccagaagaggcacccacagtgtccccagcagtggcacagagcaacagcagtgaggaagaggccagagaggctgggtcccctgcacaggagttcaagtatcagaagtcccttcctccccgattccagcgccagcagcagcaacaacagcaggagc

SEQ ID NO: 5986 - DNA, 1762 bp, Homo sapiens
tggccggggctttgaggacagccgcgcggaggacaagagatccttcttccaagatgaacacgtggcagattctgaaaatgcagagaaccggcccttcaggagaaggcgccccccacgccaagataagccccctcgattccggcgcctccggcaagagcgggagtccctgggcctgtggggacccgaggaggagccccacctgctggcaggtcagtggccaggcaggcccaaactgtgttctggggacaagagtggcactgtgggccgcaggtcccctgagctctcctaccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttgaaagtgaaaagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaag

SEQ ID NO: 5987 - DNA, 525 bp, Homo sapiens
gaaagaaaagtgacccccatcgactcaccccctgtgtggagcccagagggctacatggcactgcagagcaagggctacccgctcccgcacccgaagtcgagtgacaccttggctatggacatgcgtgtcaggaatgaaagctctttctctgcctcactcggaagggcagggggcgtaagtgctcagcgcgatctctttgaggagagaggggaggagtacttgagtgcttttgacaagaaggcccaagcagactttgacagctgtatctcttctcaaagaataggccaggagcttttgtttccaccccaagaaaatgttcaggatgcaggtgctcctgggggtcacacccaaaacctcaggtgttccccattggagcctgactttgtcccagatgagaaaaagccagagtgtggcagttgggatgttagccaccagccagagaccgctgacacagcccatggtgttgagcgggagacaccccgggaggggacggcctttaacatctcctcctgggacaagaacggg

SEQ ID NO: 5988 - DNA, 5057 bp, Homo sapiens
atgtccgatcgtttggggcaaattaccaagggcaaggatgggaaaagcaagtactcgactctcagcctgtttgataagtataaaggaaaatcagtagacgcgattagatcctcagttattcctagacatggcttacagagtcttgggaaagttgctgcagcccggcgcatgccaccgcctgcaaacctgccaagcttgaagtctgaaaacaaaggaaacgaccccaacatcgtgatagtacccaaggacgggacgggatgggcaaacaagcaggatcagcaagacccaaagagttccagtgcgacggcctctcagccgccggagtcgctgccgcagccgggtttgcagaaatctgtctccaatttgcagaaaccgacacagtcaatcagtcaggagaatacaaattcagtgccaggtggaccaaagtcatgggcacagctgaatggaaagccagtaggacacgaaggtggtttaaggggctcaagccgactgttatccttctctcccgaggaatttccgacgctgaaagcagctggagggcaggacaaggctggcaaagaaaagggcgtcttagatctgtcgtatgggccaggaccaagcctccgccctcagaatgtgacaagctggagggagggcggtgggcgacacataatttctgccacgtctctgagcacctccccaactgagctgggcagcaggaactcgagtacgggagatggagccccctcctcggcatgtaccagcgattctaaggacccctctctccgcccggctcagcctgtccgaaaaggggcttcacagttcatgggaaatgtataccacccacctacataccatgacatgcttcctgcttttatgtgttcgccgaagtcatcagaaaaccagggtacagtggaacgaggctcttttccccttcctcagctccgccttgaacctcgagttccttttagacagttccagatgaatgaccaagacggaaaagaaaacaggctgggattgtctcgcccactccgcccactaaggcagctggtggagcgggcaccacggcccaccattatcaatgcggaaaacctgaagggccttgacgatctggacgccgatgccgatgatggctgggcaggcctccatgaagaagtggactattctgagaaactgaagttcagtgatgatgaagaggaggaagaagttgtgaaggacggcaggccaaagtggaacagttgggaccctaggaggcagcggcagttgtcaatgagctctgcagacagtgcggacgctaagcggactcgagaggaagggaaggactgggctgaagcagtgggtgcgtcccgtgtggtccgaaaggcgccagaccctcagccaccgcccaggaagcttcatggctgggcaccaggccctgactaccagaagtcatcaatgggcagcatgttccggcaacagtccatcgaggacaaggaggacaagcccccaccaaggcagaagttcattcagtcagagatgtccgaggcggtggagcgagcccgaaagcgccgggaagaagaggagcgccgagcccgggaggagaggctggccgcctgtgctgccaaactcaagcagctggaccagaagtgtaagcaggcacgaaaggcaggtgaggcccggaagcaggcagagaaggaagtgccctggtctccaagtgctgagaaggcatctccccaggaaaacggccctgctgtccacaaaggctccccagaattccctgcccaagagacccccaccacattcccagaagaggcacccacagtgtccccagcagtggcacagagcaacagcagtgaggaagaggccagagaggctgggtcccctgcacaggagttcaagtatcagaagtcccttcctccccgattccagcgccagcagcagcaacaacagcaggagcagctgtacaagatgcagcactggcagccggtgtaccccccgccgtcccacccccagcgcaccttttacccacaccacccccagatgttgggcttcgatcccaggtggatgatgatgccttcctacatggacccacgtatcacgcccactcggaccccggtggacttctacccctccgccctgcatccctcaggactgatgaagcccatgatgccccaggagtccctcaatgggacaggctgtcgctctgaggatcagaactgtgtgcccccactccaagaaagaaaagtgacccccatcgactcaccccctgtgtggagcccagagggctacatggcactgcagagcaagggctacccgctcccgcacccgaagtcgagtgacaccttggctatggacatgcgtgtcagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcctagctctgctagccccagtgggaagccctctggatcagcagttaacatgggctctgtgcagggacactacgtgcaacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggg

SEQ ID NO: 5989 - DNA, 1084 bp, Homo sapiens
gccgcccgactgccatcgcccggcccggccgcgcccgcggaaccagaccaggcagatcgggagcggtgccgagaaaaatttccttactagatgacatttcatcgcaatgtccgatcgtttggggcaaattaccaagggcaaggatgggaaaagcaagtactcgactctcagcctgtttgataagtataaaggaaaatcagtagacgcgattagatcctcagttattcctagacatggcttacagagtcttgggaaagttgctgcagcccggcgcatgccaccgcctgcaaacctgccaagcttgaagtctgaaaacaaaggaaacgaccccaacatcgtgatagtacccaaggacgggacgggatgggcaaacaagcaggatcagcaagacccaaagagttccagtgcgacggcctctcagccgccggagtcgctgccgcagccgggtttgcagaaatctgtctccaatttgcagaaaccgacacagtcaatcagtcaggagaatacaaattcagtgccaggtggaccaaagtcatgggcacagctgaatggaaagccagtaggacacgaaggtggtttaaggggctcaagccgactgttatccttctctcccgaggaatttccgacgctgaaagcagctggagggcaggacaaggctggcaaagaaaagggcgtcttagatctgtcgtatgggccaggaccaagcctccgccctcagaatgtgacaagctggagggagggcggtgggcgacacataatttctgccacgtctctgagcacctccccaactgagctgggcagcaggaactcgagtacgggagatggagccccctcctcggcatgtaccagcgattctaaggacccctctctccgcccggctcagcctgtccgaaaaggggcttcacagttcatgggaaatgtataccacccacctacataccatgacatgcttcctgcttttatgtgttcgccgaagtcatcagaaaaccagggtacagtggaacgaggctcttttccccttcctcagctccgccttgaacctcgagttccttttagacagttccagatgaatgaccaagacggg

SEQ ID NO: 5990 - DNA, 10355 bp, Homo sapiens
ctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtaaacggcgtgaagaggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccgctcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttccgggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattctactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccggcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcgcagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtcccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcatcttcagtcagaatttatatataaatgtatgcacccatttttttgagtgcatataatttagacctaaaaatccttatgattagatgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatga
